United States Patent 9,675,668 (MODIFIED POLYNUCLEOTIDES ENCODING HEPATITIS A VIRUS CELLULAR RECEPTOR 2) - sequence listing, part 17

SEQ ID NO: 34594 - DNA, 840 bp, Artificial Sequence
  Description of Artificial Sequence: Synthetic coding sequence
atgatcctgctgaacaacagccacaagctgctggccctgtacaagagcctggcccggagcatccctgagagcctgaaggtgtatggctctgtgtaccacatcaaccacggcaaccccttcaacatggaggtgctggtggacagctggccagagtaccagatggtgatcatccggccccagaagtctgaggaggtgctgaagaactgtgaaattgtgaactggaagcagaggctgcagatccagggcctgcaggagagcctgggggagggcatccgggtggccaccttcagcaagtctgtgaaggtggagcacagccgggccctgctgctggtgacagaggacatcctgaagctgaatgccagcagcaagagcaagctgggctcctgggccgagaccggccacccagatgatgaatttgaaagtgagacccccaacttcaagtatgcccagctggatgtgtcctacagcggcctggtgaatgacaactggaagaggggcaagaatgaaagaagcctgcactacatcaagcgctgcatcgaggacctgcctgctgcctgcatgctgggccctgagggcgtgcctgtgtcctgggtgaccatggaccccagctgtgaggtgggcatggcctacagcatggagaagtacagaagaacaggcaacatggcccgggtgatggtgcgctacatgaagtacctgcggcagaagaacatccccttctacatctctgtgctggaggagaatgaagacagcagaagatttgtgggccagtttggcttctttgaggccagctgtgagtggcaccagtggacctgctacccccagaacctggtgcccttctag

SEQ ID NO: 34595 - DNA, 207 bp, Artificial Sequence
  Description of Artificial Sequence: Synthetic coding sequence
atgatcctgctgaacaacagccacaagctgctggccctgtacaagagcctggcccggagcatccctgagagcctgaaggtgtatggctctgtgtaccacatcaaccacggcaaccccttcaacatggaggtgctggtggacagctggccagagtaccagatggtgatcatccggccccagaagcaggagatgacagatgacatgtag

SEQ ID NO: 34596 - DNA, 240 bp, Artificial Sequence
  Description of Artificial Sequence: Synthetic coding sequence
atgatcctgctgaacaacagccacaagctgctggccctgtacaagagcctggcccggagcatccctgagagcctgaaggtgtatggctctgtgtaccacatcaaccacggcaaccccttcaacatggaggtgctggtggacagctggccagagtaccagatggtgatcatccggccccagaagcaggagatgacagatgacatggacagctacaccaacgtgtacaggatgttctcctag

SEQ ID NO: 34597 - DNA, 885 bp, Artificial Sequence
  Description of Artificial Sequence: Synthetic coding sequence
atgctggtgctgcacaacagccagaagctgcagatcctgtacaagagcctggagaagagcatccctgagagcatcaaggtgtatggagccatcttcaacatcaaggacaagaaccccttcaacatggaggtgctggtggatgcctggccagactaccagatcgtcatcacccggccccagaagcaggagatgaaggatgaccaggaccactacaccaacacctaccacatcttcaccaaggccccagacaagctggaggaggtgctgagctacagcaatgtcatctcctgggagcagaccctgcagatccagggctgccaggagggcctggatgaggccatcaggaaggtggccaccagcaagtctgtgcaggtggactacatgaagaccatcctcttcatccctgagctgcccaagaagcacaagaccagcagcaatgacaagatggagctgtttgaggtggatgatgacaacaaggagggcaacttcagcaacatgttcctggatgccagccatgctggcctggtgaatgagcactgggccttcggcaagaatgaaagaagcctgaagtacatcgagcgctgcctgcaggacttcctgggcttcggcgtgctgggccctgagggccagctggtgtcctggatcgtgatggagcagagctgtgagctgaggatgggctacacagtgcccaagtaccgccaccagggcaacatgctgcagatcggctaccacctggagaagtacctgagccagaaggagatccccttctacttccacgtggccgacaacaatgagaagagcctgcaggccctgaacaacctgggcttcaagatctgcccctgtggctggcaccagtggaagtgcacccccaagaagtactgctag

SEQ ID NO: 34598 - DNA, 885 bp, Artificial Sequence; identical to SEQ ID NO: 34597
  Description of Artificial Sequence: Synthetic coding sequence

SEQ ID NO: 34599 - DNA, 867 bp, Artificial Sequence
  Description of Artificial Sequence: Synthetic coding sequence
atgctggtgctgaactgcagcaccaagctgctgatcctggagaagatgctgaagagctgcttccctgagagcctgaaggtgtatggagctgtgatgaacatcaacagaggcaaccccttccagaaggaggtggtgctggacagctggccagacttcaaggccgtcatcacccggcggcagcgggaggccgagacagacaacctggaccactacaccaatgcctatgctgtgttctacaaggatgtgcgggcctaccggcagctgctggaggagtgtgatgtgttcaactgggaccaggtgttccagatccagggcctgcagagcgagctgtatgatgtgtccaaggctgtggccaacagcaagcagctgaacatcaagctgaccagcttcaaggctgtgcacttcagccctgtgagcagcctgcctgacaccagcttcctgaagggccccagcccccggctgacctacctgtctgtggccaatgctgacctgctgaacagaacctggagccggggcggcaatgagcagtgcctgcgctacatcgccaacctgatcagctgcttccccagcgtgtgtgtgagagatgagaagggcaaccctgtgtcctggagcatcacagaccagtttgccaccatgtgccacggctacaccctgcctgagcacaggaggaagggctacagccggctggtggccctgaccctggccaggaagctgcagagccggggcttccccagccagggcaatgtgctggatgacaacacagccagcatcagcctgctgaagagcctgcatgctgagttcctgccctgccgcttccacaggctcatcctgaccccagccaccttcagcggcctgccccacctgtag

SEQ ID NO: 34600 - DNA, 471 bp, Artificial Sequence
  Description of Artificial Sequence: Synthetic coding sequence
atgctggtgctgaactgcagcaccaagctgctgatcctggagaagatgctgaagagctgcttccctgagagcctgaaggtgtatggagctgtgatgaacatcaacagaggcaaccccttccagaaggaggtggtgctggacagctggccagacttcaaggccgtcatcacccggcggcagcgggaggccgagacagacaacctggaccactacaccaatgcctatgctgtgttctacaaggatgtgcgggcctaccggcagctgctggaggagtgtgatgtgttcaactgggaccaggtgttccagatccagggcctgcagagcgagctgtatgatgtgtccaaggctgtggccaacagcaagcagctgaacatcaagctgaccagcttcaaggctgtgcacttcagccctgtgagcagcctgcctgacaccagcttcctgaagggccccagcccccggctgacctactag

SEQ ID NO: 34601 - DNA, 1683 bp, Artificial Sequence
  Description of Artificial Sequence: Synthetic coding sequence
atggagtgcctgtactacttcctgggcttcctgctgctggccgcccggctgcccctggatgctgccaagcgcttccatgatgtgctgggcaatgaaagaccttctgcctacatgagggagcacaaccagctgaatggctggagcagtgatgaaaatgactggaatgagaagctgtaccctgtgtggaagagaggagacatgcgctggaagaacagctggaagggcggccgggtgcaggccgtgctgaccagtgacagccctgccctggtgggcagcaacatcacctttgctgtgaacctgatcttcccccgctgccagaaggaggatgccaatggaaacatcgtgtatgagaagaactgcagaaatgaggccggcctgtctgctgacccctacgtgtacaactggacagcctggagcgaggacagtgatggagaaaatggcaccggccagagccaccacaacgtgtttcctgatggcaagcccttcccccaccaccctggctggaggcgctggaacttcatctacgtgttccacaccctgggccagtacttccagaagctgggccgctgcagcgtgcgggtgtctgtgaacacagccaacgtgaccctgggcccccagctgatggaggtgacagtgtaccgccgccacggccgggcctacgtgcccatcgcccaggtgaaggatgtgtatgtggtgacagaccagatccctgtgtttgtgaccatgttccagaagaatgacaggaacagcagtgatgagaccttcctgaaggacctgcccatcatgtttgatgtgctgattcatgaccccagccacttcctgaactacagcaccatcaactacaagtggagctttggagacaacacaggcctgtttgtgtccaccaaccacacagtgaaccacacctacgtgctgaatggcaccttcagcctgaacctgactgtgaaggccgccgcccctggcccctgccccccacctcctcctccaccccggcccagcaagcccacccccagcctgggccctgctggggacaaccccctggagctgagccgcatcccagatgagaactgccagatcaacagatatggccacttccaggccaccatcaccatcgtggagggcatcctggaggtgaacatcatccagatgacagatgtgctgatgcctgtgccctggccagagagcagcctgattgactttgtggtgacctgccagggcagcatccccacagaggtgtgcaccatcatcagtgaccccacctgtgagatcacccagaacacagtgtgcagccctgtggatgtggatgagatgtgcctgctgactgtgcggaggaccttcaatggaagtggcacctactgtgtgaacctgaccctgggagatgacaccagcctggccctgaccagcaccctcatctctgtgcctgaccgggaccctgccagccccctgaggatggccaacagcgccctgatctctgtgggctgcctggccatctttgtgaccgtcatcagcctgctggtgtacaagaagcacaaggagtacaaccccatcgagaacagccctggaaatgtggtgcgcagcaagggcctgagcgtcttcctgaacagagccaaggctgtgttcttccctggcaaccaggagaaggaccccctgctgaagaaccaggagttcaagggcgtgtcctag

SEQ ID NO: 34602 - DNA, 1719 bp, Artificial Sequence
  Description of Artificial Sequence: Synthetic coding sequence
atggagtgcctgtactacttcctgggcttcctgctgctggccgcccggctgcccctggatgctgccaagcgcttccatgatgtgctgggcaatgaaagaccttctgcctacatgagggagcacaaccagctgaatggctggagcagtgatgaaaatgactggaatgagaagctgtaccctgtgtggaagagaggagacatgcgctggaagaacagctggaagggcggccgggtgcaggccgtgctgaccagtgacagccctgccctggtgggcagcaacatcacctttgctgtgaacctgatcttcccccgctgccagaaggaggatgccaatggaaacatcgtgtatgagaagaactgcagaaatgaggccggcctgtctgctgacccctacgtgtacaactggacagcctggagcgaggacagtgatggagaaaatggcaccggccagagccaccacaacgtgtttcctgatggcaagcccttcccccaccaccctggctggaggcgctggaacttcatctacgtgttccacaccctgggccagtacttccagaagctgggccgctgcagcgtgcgggtgtctgtgaacacagccaacgtgaccctgggcccccagctgatggaggtgacagtgtaccgccgccacggccgggcctacgtgcccatcgcccaggtgaaggatgtgtatgtggtgacagaccagatccctgtgtttgtgaccatgttccagaagaatgacaggaacagcagtgatgagaccttcctgaaggacctgcccatcatgtttgatgtgctgattcatgaccccagccacttcctgaactacagcaccatcaactacaagtggagctttggagacaacacaggcctgtttgtgtccaccaaccacacagtgaaccacacctacgtgctgaatggcaccttcagcctgaacctgactgtgaaggccgccgcccctggcccctgccccccacctcctcctccaccccggcccagcaagcccacccccagcctggccaccaccctgaagagctatgacagcaacaccccaggccctgctggggacaaccccctggagctgagccgcatcccagatgagaactgccagatcaacagatatggccacttccaggccaccatcaccatcgtggagggcatcctggaggtgaacatcatccagatgacagatgtgctgatgcctgtgccctggccagagagcagcctgattgactttgtggtgacctgccagggcagcatccccacagaggtgtgcaccatcatcagtgaccccacctgtgagatcacccagaacacagtgtgcagccctgtggatgtggatgagatgtgcctgctgactgtgcggaggaccttcaatggaagtggcacctactgtgtgaacctgaccctgggagatgacaccagcctggccctgaccagcaccctcatctctgtgcctgaccgggaccctgccagccccctgaggatggccaacagcgccctgatctctgtgggctgcctggccatctttgtgaccgtcatcagcctgctggtgtacaagaagcacaaggagtacaaccccatcgagaacagccctggaaatgtggtgcgcagcaagggcctgagcgtcttcctgaacagagccaaggctgtgttcttccctggcaaccaggagaaggaccccctgctgaagaaccaggagttcaagggcgtgtcctag

SEQ ID NO: 34603 - DNA, 621 bp, Artificial Sequence
  Description of Artificial Sequence: Synthetic coding sequence
atggagtgcctgtactacttcctgggcttcctgctgctggccgcccggctgcccctggatgctgccaagcgcttccatgatgtgctgggcaatgaaagaccttctgcctacatgagggagcacaaccagctgaatggctggagcagtgatgaaaatgactggaatgagaagctgtaccctgtgtggaagagaggagacatgcgctggaagaacagctggaagggcggccgggtgcaggccgtgctgaccagtgacagccctgccctggtgggcagcaacatcacctttgctgtgaacctgatcttcccccgctgccagaaggaggatgccaatggaaacatcgtgtatgagaagaactgcagaaatgaggccggcctgtctgctgacccctacgtgtacaactggacagcctggagcgaggacagtgatggagaaaatggcaccggccagagccaccacaacgtgtttcctgatggcaagcccttcccccaccaccctggctggaggcgctggaacttcatctacgtgttccacaccctgggctggctgctgcagacccccaagctgctgctgtacctgagcctgaagttccagcccagcctcttcctgctgtacaactag

SEQ ID NO: 34604 - DNA, 1368 bp, Artificial Sequence
  Description of Artificial Sequence: Synthetic coding sequence
atggagtgcctgtactacttcctgggcttcctgctgctggccgcccggctgcccctggatgctgccaagcgcttccatgatgtgctgggcaatgaaagaccttctgcctacatgagggagcacaaccagctgaatggctggagcagtgatgaaaatgactggaacttcatctacgtgttccacaccctgggccagtacttccagaagctgggccgctgcagcgtgcgggtgtctgtgaacacagccaacgtgaccctgggcccccagctgatggaggtgacagtgtacagaagacatggccgggcctacgtgcccatcgcccaggtgaaggatgtgtatgtggtgacagaccagatccctgtgtttgtgaccatgttccagaagaatgacaggaacagcagtgatgagaccttcctgaaggacctgcccatcatgtttgatgtgctgattcatgaccccagccacttcctgaactacagcaccatcaactacaagtggagctttggagacaacacaggcctgtttgtgtccaccaaccacacagtgaaccacacctacgtgctgaatggcaccttcagcctgaacctgactgtgaaggctgctgcccctggcccctgccccccacctcctcctccaccccggcccagcaagcccacccccagcctggccaccaccctgaagagctatgacagcaacaccccaggccctgctggggacaaccccctggagctgagccgcatcccagatgagaactgccagatcaacagatatggccacttccaggccaccatcaccatcgtggagggcatcctggaggtgaacatcatccagatgacagatgtgctgatgcctgtgccctggccagagagcagcctgattgactttgtggtgacctgccagggcagcatccccacagaggtgtgcaccatcatcagtgaccccacctgtgagatcacccagaacacagtgtgcagccctgtggatgtggatgagatgtgcctgctgactgtgcggaggaccttcaacggcagcggcacctactgtgtgaacctgaccctgggagatgacaccagcctggccctgaccagcaccctcatctctgtgcctgaccgggaccctgccagccccctgaggatggccaacagcgccctgatctctgtgggctgcctggccatctttgtgaccgtcatcagcctgctggtgtacaagaagcacaaggagtacaaccccatcgagaacagccctggaaatgtggtgcgcagcaagggcctgtctgtgttcctgaacagagccaaggctgtgttcttccctggcaaccaggagaaggaccccctgctgaagaaccaggagttcaagggcgtgtcctag

SEQ ID NO: 34605 - DNA, 1824 bp, Artificial Sequence
  Description of Artificial Sequence: Synthetic coding sequence
atgatcctgcctgaggccctgtacctgatcaagattgaaagagaggccccccagatgcctgaggagcactgctgctcctggtggacaggccctgaggagttctccatggagtgcctgtactacttcctgggcttcctgctgctggccgcccggctgcccctggatgctgccaagcgcttccatgatgtgctgggcaatgaaagacccagcgcctacatgagggagcacaaccagctgaatggctggagcagtgatgaaaatgactggaatgagaagctgtaccctgtgtggaagagaggagacatgcgctggaagaacagctggaagggcggccgggtgcaggccgtgctgaccagtgacagccctgccctggtgggcagcaacatcacctttgctgtgaacctgatcttcccccgctgccagaaggaggatgccaacggcaacatcgtgtatgagaagaactgcagaaatgaagctggcctgtctgctgacccctacgtgtacaactggacagcctggagcgaagattctgatggagaaaatggaacaggccagagccaccacaacgtgtttcctgatggcaagcccttcccccaccaccctggctggaggcgctggaacttcatctacgtgttccacaccctgggccagtacttccagaagctgggccgctgcagcgtgcgggtgtctgtgaacacagccaacgtgaccctgggcccccagctgatggaggtgacagtgtacagaagacatggccgggcctacgtgcccatcgcccaggtgaaggatgtgtatgtggtgacagaccagatccctgtgtttgtgaccatgttccagaagaatgacaggaacagcagtgatgagaccttcctgaaggacctgcccatcatgtttgatgtgctgattcatgaccccagccacttcctgaactacagcaccatcaactacaagtggagctttggagacaacacaggcctgtttgtgtccaccaaccacacagtgaaccacacctacgtgctgaatggcaccttcagcctgaacctgactgtgaaggctgctgcccctggcccctgccccccacctcctcctccaccccggcccagcaagcccacccccagcctggccaccaccctgaagagctatgacagcaacaccccaggccctgctggggacaaccccctggagctgagccgcatcccagatgagaactgccagatcaacagatatggccacttccaggccaccatcaccatcgtggagggcatcctggaggtgaacatcatccagatgacagatgtgctgatgcctgtgccctggccagagagcagcctgattgactttgtggtgacctgccagggcagcatccccacagaggtgtgcaccatcatcagtgaccccacctgtgagatcacccagaacacagtgtgcagccctgtggatgtggatgagatgtgcctgctgactgtgcggaggaccttcaacggcagcggcacctactgtgtgaacctgaccctgggagatgacaccagcctggccctgaccagcaccctcatctctgtgcctgaccgggaccctgccagccccctgaggatggccaacagcgccctgatctctgtgggctgcctggccatctttgtgaccgtcatcagcctgctggtgtacaagaagcacaaggagtacaaccccatcgagaacagccctggaaatgtggtgcgcagcaagggcctgtctgtgttcctgaacagagccaaggctgtgttcttccctggcaaccaggagaaggaccccctgctgaagaaccaggagttcaagggcgtgtcctag

SEQ ID NO: 34606 - DNA, 1545 bp, Artificial Sequence
  Description of Artificial Sequence: Synthetic coding sequence
atggagtgcctgtactacttcctgggcttcctgctgctggccgcccggctgcccctggatgctgccaagcgcttccatgatgtgctgggcaatgaaagaccttctgcctacatgagggagcacaaccagctgaatggctggagcagtgatgaaaatgactggaatgagaagctgtaccctgtgtggaagagaggagacatgcgctggaagaacagctggaagggcggccgggtgcaggccgtgctgaccagtgacagccctgccctggtgggcagcaacatcacctttgctgtgaacctgatcttcccccgctgccagaaggaggatgccaatggaaacatcgtgtatgagaagaactgcagaaatggccagtacttccagaagctgggccgctgcagcgtgcgggtgtctgtgaacacagccaacgtgaccctgggcccccagctgatggaggtgacagtgtaccgccgccacggccgggcctacgtgcccatcgcccaggtgaaggatgtgtatgtggtgacagaccagatccctgtgtttgtgaccatgttccagaagaatgacaggaacagcagtgatgagaccttcctgaaggacctgcccatcatgtttgatgtgctgattcatgaccccagccacttcctgaactacagcaccatcaactacaagtggagctttggagacaacacaggcctgtttgtgtccaccaaccacacagtgaaccacacctacgtgctgaatggcaccttcagcctgaacctgactgtgaaggccgccgcccctggcccctgccccccacctcctcctccaccccggcccagcaagcccacccccagcctggccaccaccctgaagagctatgacagcaacaccccaggccctgctggggacaaccccctggagctgagccgcatcccagatgagaactgccagatcaacagatatggccacttccaggccaccatcaccatcgtggagggcatcctggaggtgaacatcatccagatgacagatgtgctgatgcctgtgccctggccagagagcagcctgattgactttgtggtgacctgccagggcagcatccccacagaggtgtgcaccatcatcagtgaccccacctgtgagatcacccagaacacagtgtgcagccctgtggatgtggatgagatgtgcctgctgactgtgcggaggaccttcaatggaagtggcacctactgtgtgaacctgaccctgggagatgacaccagcctggccctgaccagcaccctcatctctgtgcctgaccgggaccctgccagccccctgaggatggccaacagcgccctgatctctgtgggctgcctggccatctttgtgaccgtcatcagcctgctggtgtacaagaagcacaaggagtacaaccccatcgagaacagccctggaaatgtggtgcgcagcaagggcctgagcgtcttcctgaacagagccaaggctgtgttcttccctggcaaccaggagaaggaccccctgctgaagaaccaggagttcaagggcgtgtcctag

SEQ ID NO: 34607 - DNA, 1386 bp, Artificial Sequence
  Description of Artificial Sequence: Synthetic coding sequence
atggagtgcctgtactacttcctgggcttcctgctgctggccgcccggctgcccctggatgctgccaagcaggccggcctgtctgctgacccctacgtgtacaactggacagcctggagcgaagattctgatggagaaaatggaacaggccagagccaccacaacgtgtttcctgatggcaagcccttcccccaccaccctggctggaggcgctggaacttcatctacgtgttccacaccctgggccagtacttccagaagctgggccgctgcagcgtgcgggtgtctgtgaacacagccaacgtgaccctgggcccccagctgatggaggtgacagtgtacagaagacatggccgggcctacgtgcccatcgcccaggtgaaggatgtgtatgtggtgacagaccagatccctgtgtttgtgaccatgttccagaagaatgacaggaacagcagtgatgagaccttcctgaaggacctgcccatcatgtttgatgtgctgattcatgaccccagccacttcctgaactacagcaccatcaactacaagtggagctttggagacaacacaggcctgtttgtgtccaccaaccacacagtgaaccacacctacgtgctgaatggcaccttcagcctgaacctgactgtgaaggctgctgcccctggcccctgccccccacctcctcctccaccccggcccagcaagcccacccccagcctgggccctgctggggacaaccccctggagctgagccgcatcccagatgagaactgccagatcaacagatatggccacttccaggccaccatcaccatcgtggagggcatcctggaggtgaacatcatccagatgacagatgtgctgatgcctgtgccctggccagagagcagcctgattgactttgtggtgacctgccagggcagcatccccacagaggtgtgcaccatcatcagtgaccccacctgtgagatcacccagaacacagtgtgcagccctgtggatgtggatgagatgtgcctgctgactgtgcggaggaccttcaacggcagcggcacctactgtgtgaacctgaccctgggagatgacaccagcctggccctgaccagcaccctcatctctgtgcctgaccgggaccctgccagccccctgaggatggccaacagcgccctgatctctgtgggctgcctggccatctttgtgaccgtcatcagcctgctggtgtacaagaagcacaaggagtacaaccccatcgagaacagccctggaaatgtggtgcgcagcaagggcctgtctgtgttcctgaacagagccaaggctgtgttcttccctggcaaccaggagaaggaccccctgctgaagaaccaggagttcaagggcgtgtcctag

SEQ ID NO: 34608 - DNA, 960 bp, Artificial Sequence
  Description of Artificial Sequence: Synthetic coding sequence
atggtgggcaagatgtggcctgtgctgtggaccctgtgtgctgtgcgggtgacagtggatgccatctctgtggagaccccccaggatgtgctgcgggccagccagggcaagtctgtgaccctgccctgcacctaccacaccagcaccagcagccgggagggcctcatccagtgggacaagctgctgctgacccacacagagcgggtggtgatctggcccttcagcaacaagaactacatccatggagagctgtacaagaacagagtgtccatcagcaacaatgctgagcagagtgatgccagcatcaccatcgaccagctgaccatggctgacaatggcacctatgagtgcagcgtgtccctgatgtctgacctggagggcaacaccaagagccgggtgcggctgctggtgctggtgccccccagcaagccagaatgtggcatcgagggggagaccatcatcggcaacaacatccagctgacctgccagagcaaggagggcagccccaccccccagtacagctggaagcgctacaacatcctgaaccaggagcagcccctggcccagcctgccagcggccagcctgtgtccctgaagaacatcagcacagacaccagcggctactacatctgcaccagcagcaatgaggagggcacccagttctgcaacatcaccgtggccgtgcgcagccccagcatgaatgtggccctgtatgtgggcattgctgtgggcgtggtggccgccctgatcatcatcggcatcatcatctactgctgctgctgccggggcaaggatgacaacacagaggacaaggaggatgcccggcccaaccgggaggcctatgaggagcccccagagcagctgcgggagctgagccgggagcgggaggaggaggatgactaccggcaggaggagcagaggagcacaggccgggagagcccagaccacctggaccagtag

SEQ ID NO: 34609 - DNA, 1683 bp, Artificial Sequence
  Description of Artificial Sequence: Synthetic coding sequence
atgctgcggggcaccctgctgtgtgctgtgctgggcctgctgcgggcccagcccttcccctgccccccagcctgcaagtgtgtgttcagagatgctgcccagtgcagcggaggagatgtggcccgcatcagcgccctgggcctgcccaccaacctgacccacatcctgctgtttggcatgggccggggcgtgctgcagagccagagcttcagcggcatgacagtgctgcagaggctgatgatcagtgacagccacatctctgctgtggcccctggcaccttcagtgacctgatcaagctgaagaccctgcggctgagcaggaacaagatcacccacctgcccggggccctgctggacaagatggtgctgctggagcagctgttcctggaccacaatgccctgcggggcatcgaccagaacatgttccagaagctggtgaacctgcaggagctggccctgaaccagaaccagctggacttcctgcctgccagcctcttcaccaacctggagaacctgaagctgctggacctgagcggcaacaacctgacccacctgcccaagggcctgctgggcgcccaggccaagctggagcggctgctgctgcacagcaaccggctggtgtccctggacagcggcctgctgaacagcctgggcgccctgacagagctgcagttccacaggaaccacatccgcagcatcgcccctggggcctttgaccggctgcccaacctgagcagcctgaccctgagcaggaaccacctggccttcctgcccagcgccctcttcctgcacagccacaacctgaccctgctgaccctgtttgagaaccccctggccgagctgcccggggtgctgtttggagagatgggcggcctgcaggagctgtggctgaacagaacccagctgcggaccctgcctgctgctgccttcaggaacctgagccggctgcgctacctgggcgtgaccctgagcccccggctgagcgccctgccccagggcgccttccagggcctgggggagctgcaggtgctggccctgcacagcaatggcctgacagccctgcctgatggcctgctgcggggcctgggcaagctgcggcaggtgtccctgcggaggaaccggctgcgggccctgccccgggccctcttcaggaacctgagcagcctggagagcgtgcagctggaccacaaccagctggagaccctgcctggagatgtgtttggagccctgccccggctgacagaggtgctgctgggccacaacagctggaggtgtgactgtggcctgggccccttcctgggctggctgcggcagcacctgggcctggtgggcggggaggagcccccaagatgtgccggccctggggcccacgccggcctgcccctgtgggccctgcctggaggagatgctgaatgtcctggcccccggggccccccacccaggcctgctgctgacagcagcagcgaggcccctgtgcacccagccctggcccccaacagcagcgagccctgggtgtgggcccagcctgtgaccaccgggaagggccaggaccacagccccttctggggcttctacttcctgctgctggccgtgcaggccatgatcaccgtcatcatcgtgtttgccatgatcaagattggccagctgttcaggaagctgatccgggagcgggccctgggctag

SEQ ID NO: 34610 - DNA, 1683 bp, Artificial Sequence; identical to SEQ ID NO: 34609
  Description of Artificial Sequence: Synthetic coding sequence

SEQ ID NO: 34611 - DNA, 1869 bp, Artificial Sequence
  Description of Artificial Sequence: Synthetic coding sequence
atggctgctgcccccagggctggaagaagaagaggccagcccctgctggccctgctgctgctgctgctggcccccctgcccccaggggcccctcctggagcagatgcctacttccctgaggagcgctggagccctgagagccccctgcaggccccccgggtgctgattgccctgctggccagaaatgctgcccacgccctgcccaccaccctgggcgccctggagcggctgcggcacccccgggagaggacagccctgtgggtggccacagaccacaacatggacaacaccagcacagtgctgcgggagtggctggtggccgtgaagagcctgtaccacagcgtggagtggaggcctgctgaggagcccaggagctacccagatgaggagggccccaagcactggagcgacagccgctatgagcacgtgatgaagctgcggcaggccgccctgaagagcgcccgggacatgtgggccgactacatcctgtttgtggatgctgacaacctgatcctgaacccagacaccctgagcctgctgattgctgagaacaagacagtggtggcccccatgctggacagccgggccgcctacagcaacttctggtgtggcatgaccagccagggctactacaagaggaccccagcctacatccccatcaggaagagggacagaagaggctgctttgctgtgcccatggtgcacagcaccttcctgattgacctgaggaaggccgccagcaggaacctggccttctacccaccccacccagactacacctggagctttgatgacatcatcgtgtttgccttcagctgcaagcaggccgaggtgcagatgtatgtgtgcaacaaggaggagtatggcttcctgcctgtgcccctgcgggcccacagcaccctgcaggatgaagctgagagcttcatgcacgtgcagctggaggtgatggtgaagcaccccccagctgagcccagccgcttcatcagcgcccccaccaagaccccagacaagatgggctttgatgaggtgttcatgatcaacctgcggcggcggcaggaccggcgggagaggatgctgcgggccctgcaggcccaggagattgagtgccgcctggtggaggccgtggatggcaaggccatgaacaccagccaggtggaggccctgggcatccagatgctgcccggctacagagacccctaccacggccggcccctgaccaagggggagctgggctgcttcctgagccactacaacatctggaaggaggtggtggaccggggcctgcagaagagcctggtgtttgaagatgacctgcgctttgagatcttcttcaagaggcggctgatgaacctgatgagagatgtggagcgggagggcctggactgggacctgatctacgtgggcaggaagaggatgcaggtggagcaccctgagaaggctgtgccccgggtgaggaacctggtggaggccgactacagctactggaccctggcctacgtgatcagcctgcagggcgccaggaagctgctggccgctgagcccctgagcaagatgctgcctgtggatgagttcctgcctgtgatgtttgacaagcaccctgtgtctgagtacaaggcccacttcagcctgaggaacctgcacgccttctctgtggagcccctgctgatctaccccacccactacacaggagatgatggctacgtgtctgacacagagacctctgtggtgtggaacaatgaacatgtgaagacagactgggaccgggccaagagccagaagatgagggagcagcaggccctgagccgggaggccaagaacagtgatgtgctgcagagccccctggacagcgctgccagagatgagctgtag

SEQ ID NO: 34612 - DNA, 702 bp, Artificial Sequence
  Description of Artificial Sequence: Synthetic coding sequence
atggtgcacagcaccttcctgattgacctgaggaaggccgccagcaggaacctggccttctacccaccccacccagactacacctggagctttgatgacatcatcgtgtttgccttcagctgcaagcaggccgtgaagcaccccccagctgagcccagccgcttcatcagcgcccccaccaagaccccagacaagatgggctttgatgaggtgttcatgatcaacctgcggcggcggcaggaccggcgggagaggatgctgcgggccctgcaggcccaggagattgagtgccgcctggtggaggccgtggatggcaaggccatgaacaccagccaggtggaggccctgggcatccagatgctgcccggctacagagacccctaccacggccggcccctgaccaagggggagctgggctgcttcctgagccactacaacatctggaaggaggtggtggaccggggcctgcagaagagcctggtgtttgaagatgacctgcgctttgagatcttcttcaagaggcggctgatgaacctgatgagagatgtggagcgggagggcctggactgggacctgatctacgtgggcaggaagaggatgcaggtggagcaccctgagaaggctgtgccccgggtgaggaacctggtggaggccgactacagctactggacagtgctgcccggcatgaacagcgagggctag

SEQ ID NO: 34613 - DNA, 1881 bp, Artificial Sequence
  Description of Artificial Sequence: Synthetic coding sequence
atggccgcccggcctgctgccaccctggcctggagcctgctgctgctgagcagcgccctgctgcgggagggctgccgggccaggtttgtggccgagcgggacagtgaagatgatggagaggagcctgtggtgtttcctgagagccccctgcagagccccaccgtgctggtggccgtgctggccagaaatgctgcccacaccctgccccacttcctgggctgcctggagcggctggactaccccaagagcaggatggccatctgggccgccacagaccacaacgtggacaacaccacagagatcttccgggagtggctgaagaatgtgcagaggctgtaccactacgtggagtggaggcccatggatgagcctgagagctacccagatgaaattggccccaagcactggcccaccagcagatttgcccacgtgatgaagctgcggcaggccgccctgaggacagcccgggagaagtggagcgactacatcctcttcattgatgtggacaacttcctgaccaacccccagaccctgaacctgctgattgctgagaacaagaccatcgtggcccccatgctggagagccggggcctgtacagcaacttctggtgtggcatcacccccaagggcttctacaagaggaccccagactatgtgcagatccgggagtggaagaggacaggctgcttccctgtgcccatggtgcacagcaccttcctgattgacctgaggaaggaggccagtgacaagctgaccttctacccaccccaccaggactacacctggacctttgatgacatcatcgtgtttgccttcagcagccggcaggccggcatccagatgtacctgtgcaaccgggagcactacggctacctgcccatccccctgaagccccaccagaccctgcaggaggacattgaaaatctcatccacgtgcagatcgaggccatgattgacaggcctcccatggagcccagccagtatgtgtctgtggtgcccaagtacccagacaagatgggctttgatgagatcttcatgatcaacctgaagaggaggaaggacagaagagacaggatgctgcggaccctgtatgagcaggagattgaggtgaagatcgtggaggccgtggatggcaaggccctgaacaccagccagctgaaggccctgaacatcgagatgctgcccggctacagagacccctacagcagccggcccctgaccagaggagaaattggctgcttcctgagccactacagcgtgtggaaggaggtgattgaccgggagctggagaagaccctggtgattgaagatgatgtgcgctttgagcaccagttcaagaagaagctgatgaagctgatggacaacatcgaccaggcccagctggactgggagctgatctacatcggcaggaagaggatgcaggtgaaggagcctgagaaggctgtgcccaacgtggccaacctggtggaggccgactacagctactggaccctgggctacgtgatcagcctggagggcgcccagaagctggtgggcgccaacccctttgggaagatgctgcctgtggatgagttcctgcctgtgatgtacaacaagcaccctgtggccgagtacaaggagtactatgagagccgggacctgaaggccttctctgctgagcccctgctgatctaccccacccactacacaggccagcccggctacctgagtgacacagagaccagcaccatctgggacaatgagaccgtggccacagactgggacaggacccacgcctggaagagcaggaagcagagccgcatctacagcaatgccaagaacacagaggccctgcccccacccaccagcctggacacagtgcccagcagagatgagctgtag

SEQ ID NO: 34614 - DNA, 1092 bp, Artificial Sequence
  Description of Artificial Sequence: Synthetic coding sequence
atgttcagtgactgctggctgtgccccagcctgggcagcagcggcatccagatgtacctgtgcaaccgggagcactacggctacctgcccatccccctgaagccccaccagaccctgcaggaggacatcgagaacctgatccacgtgcagatcgaggccatgattgaccggccccccatggagcccagccagtatgtgtctgtggtgcccaagtacccagacaagatgggctttgatgagatcttcatgatcaacctgaagaggaggaaggaccggcgggacaggatgctgcggaccctgtatgagcaggagattgaggtgaagatcgtggaggccgtggatggcaaggccctgaacaccagccagctgaaggccctgaacatcgagatgctgcccggctacagagacccctacagcagccggcccctgaccagaggagagatcggctgcttcctgagccactacagcgtgtggaaggaggtgattgaccgggagctggagaagaccctggtgattgaagatgatgtgcgctttgagcaccagttcaagaagaagctgatgaagctgatggacaacatcgaccaggcccagctggactgggagctgatctacatcggcaggaagaggatgcaggtgaaggagcctgagaaggctgtgcccaacgtggccaacctggtggaggccgactacagctactggaccctgggctacgtgatcagcctggagggcgcccagaagctggtgggcgccaacccctttgggaagatgctgcctgtggatgagttcctgcctgtgatgtacaacaagcaccctgtggccgagtacaaggagtactatgagagccgggacctgaaggccttctctgctgagcccctgctgatctaccccacccactacacaggccagcccggctacctgagtgacacagagaccagcaccatctgggacaatgaaacagtggccacagactgggacaggacccacgcctggaagagcaggaagcagagccgcatctacagcaatgccaagaacacagaggccctgcccccacccaccagcctggacacagtgcccagcagagatgagctgtag

SEQ ID NO: 34615 - DNA, 705 bp, Artificial Sequence
  Description of Artificial Sequence: Synthetic coding sequence
atgctgcccggctacagagacccctacagcagccggcccctgaccagaggagaaattggctgcttcctgagccactacagcgtgtggaaggaggtgattgaccgggagctggagaagaccctggtgattgaagatgatgtgcgctttgagcaccagttcaagaagaagctgatgaagctgatggacaacatcgaccaggcccagctggactgggagctgatctacatcggcaggaagaggatgcaggtgaaggagcctgagaaggctgtgcccaacgtggccaacctggtggaggccgactacagctactggaccctgggctacgtgatcagcctggagggcgcccagaagctggtgggcgccaacccctttgggaagatgctgcctgtggatgagttcctgcctgtgatgtacaacaagcaccctgtggccgagtacaaggagtactatgagagccgggacctgaaggccttctctgctgagcccctgctgatctaccccacccactacacaggccagcccggctacctgagtgacacagagaccagcaccatctgggacaatgagaccgtggccacagactgggacaggacccacgcctggaagagcaggaagcagagccgcatctacagcaatgccaagaacacagaggccctgcccccacccaccagcctggacacagtgcccagcagagatgagctgtag

SEQ ID NO: 34616 - DNA, 1665 bp, Artificial Sequence
  Description of Artificial Sequence: Synthetic coding sequence
atggccgcccggcctgctgccaccctggcctggagcctgctgctgctgagcagcgccctgctgcgggagggctgccgggccaggtttgtggccgagcgggacagtgaagatgatggagaggagcctgtggtgtttcctgagagccccctgcagagccccaccgtgctggtggccgtgctggccagaaatgctgcccacaccctgccccacttcctgggctgcctggagcggctggactaccccaagagcaggatggccatctgggccgccacagaccacaacgtggacaacaccacagagatcttccgggagtggctgaagaatgtgcagaggctgtaccactacgtggagtggaggcccatggatgagcctgagagctacccagatgaaattggccccaagcactggcccaccagcagatttgcccacgtgatgaagctgcggcaggccgccctgaggacagcccgggagaagtggagcgactacatcctcttcattgatgtggacaacttcctgaccaacccccagaccctgaacctgctgattgctgagaacaagaccatcgtggcccccatgctggagagccggggcctgtacagcaacttctggtgtggcatcacccccaagggcttctacaagaggaccccagactatgtgcagatccgggagtggaagaggacaggctgcttccctgtgcccatggtgcacagcaccttcctgattgacctgaggaaggaggccagtgacaagctgaccttctacccaccccaccaggactacacctggacctttgatgacatcatcgtgtttgccttcagcagccggcaggccggcatccagatgtacctgtgcaaccgggagcactacggctacctgcccatccccctgaagccccaccagaccctgcaggaggacattgaaaatctcatccacgtgcagatcgaggccatgattgacaggcctcccatggagcccagccagtatgtgtctgtggtgcccaagtacccagacaagatgggctttgatgagatcttcatgatcaacctgaagaggaggaaggacagaagagacaggatgctgcggaccctgtatgagcaggagattgaggtgaagatcgtggaggccgtggatggcaaggccctgaacaccagccagctgaaggccctgaacatcgagatgctgcccggctacagagacccctacagcagccggcccctgaccagaggagaaattggctgcttcctgagccactacagcgtgtggaaggaggtgattgaccgggagctggagaagaccctggtgattgaagatgatgtgcgctttgagcaccagttcaagaagaagctgatgaagctgatggacaacatcgaccaggcccagctggactgggagctgatctacatcggcaggaagaggatgcaggtgaaggagcctgagaaggctgtgcccaacgtggccaacctggtggaggccgactacagctactggaccctgggctacgtgatcagcctggagggcgcccagaagctggtgggcgccaacccctttgggaagatgctgcctgtggatgagttcctgcctgtgatgtacaacaagcaccctgtgctgctgagcagcccccactgccacctgttccagaccctgagtgatgactgccagaggtag

SEQ ID NO: 34617 - DNA, 1050 bp, Artificial Sequence
  Description of Artificial Sequence: Synthetic coding sequence
atggccctgctgaggaagatcaaccaggtgctgctcttcctgctgattgtgaccctgtgtgtgatcctgtacaagaaggtgcacaagggcaccgtgcccaagaatgatgctgatgatgaaagtgagaccccagaggagctggaggaggagatccctgtggtgatctgtgccgctgctggccgcatgggcgccaccatggccgccatcaacagcatctacagcaacacagatgccaacatcctcttctacgtggtgggcctgaggaacaccctgacccgcatcaggaagtggattgagcacagcaagctgcgggagatcaacttcaagatcgtggagttcaaccccatggtgctgaagggcaagatccggccagacagcagcaggcctgagctgctgcagcccctgaactttgtgcgcttctacctgcccctgctgatccaccagcacgagaaggtgatctacctggatgatgatgtgattgtgcagggcgacatccaggagctgtatgacaccaccctggccctgggccacgccgccgccttcagtgatgactgtgacctgcccagcgcccaggacatcaaccggctggtgggcctgcagaacacctacatgggctacctggactacaggaagaaggccatcaaggacctgggcatcagccccagcacctgcagcttcaaccctggggtgattgtggccaacatgacagagtggaagcaccagaggatcaccaagcagctggagaagtggatgcagaagaatgtggaggagaacctgtacagcagcagcctgggcggcggcgtggccaccagccccatgctgattgtgttccacggcaagtacagcaccatcaaccccctgtggcacatccgccacctgggctggaacccagatgcccgctacagcgagcacttcctgcaggaggccaagctgctgcactggaatggccgccacaagccctgggacttccccagcgtgcacaatgacctgtgggagagctggtttgtgcctgaccctgctggcatcttcaagctgaaccaccacagctag

SEQ ID NO: 34618 - DNA, 1050 bp, Artificial Sequence; identical to SEQ ID NO: 34617
  Description of Artificial Sequence: Synthetic coding sequence

SEQ ID NO: 34619 - DNA, 1050 bp, Artificial Sequence; identical to SEQ ID NO: 34617
  Description of Artificial Sequence: Synthetic coding sequence

SEQ ID NO: 34620 - DNA, 942 bp, Artificial Sequence
  Description of Artificial Sequence: Synthetic coding sequence
atggccgcccggcgggccctgcactttgtgttcaaggtgggcaaccgcttccagacagcccgcttctacagagatgtgctgggcatgaaggtggagagctgcagcgtggcccggctggagtgcagcggggccatcagcgcccactgcagcgactacacccgcatcacagaagattccttcagcaagccctatgatggcaagtggagcaagaccatggtgggctttggaccagaagatgaccactttgtggccgagctgacctacaactacggcgtgggggactacaagctgggcaatgacttcatgggcatcaccctggccagcagccaggccgtgtccaatgccaggaagctggagtggcccctgacagaggtggccgagggcgtgtttgaaacagaggcccctgggggctacaagttctacctgcagaacagaagcctgccccagagcgaccctgtgctgaaggtgaccctggccgtgtctgacctgcagaagagcctgaactactggtgcaacctgctgggcatgaagatctatgagaaggatgaggagaagcagagggccctgctgggctatgctgacaaccagtgcaagctggagctgcagggcgtgaagggcggcgtggaccatgctgctgccttcggcagaattgccttcagctgcccccagaaggagctgcctgacctggaggacctgatgaagcgggagaaccagaagatcctgacccccctggtgtccctggacacccctgggaaggccaccgtgcaggtggtgatcctggccgaccctgatggccacgagatctgctttgtgggagatgaggccttccgggagctgagcaagatggaccctgagggcagcaagctgctggatgatgccatggctgctgacaagagtgatgagtggtttgccaagcacaacaagcccaaggccagcggctag

SEQ ID NO: 34621 - DNA, 897 bp, Artificial Sequence
  Description of Artificial Sequence: Synthetic coding sequence
atggccgcccggcgggccctgcactttgtgttcaaggtgggcaaccgcttccagacagcccgcttctacagagatgtgctgggcatgaaggtgctgcggcatgaggagtttgaggagggctgcaaggccgcctgcaatggcccctatgatggcaagtggagcaagaccatggtgggcttcggcccagaagatgaccactttgtggccgagctgacctacaactatggagtgggggactacaagctgggcaatgacttcatgggcatcaccctggccagcagccaggccgtgtccaatgccaggaagctggagtggcccctgacagaggtggccgagggcgtgtttgaaacagaggcccctgggggctacaagttctacctgcagaacagaagcctgccccagagcgaccctgtgctgaaggtgaccctggccgtgtctgacctgcagaagagcctgaactactggtgcaacctgctgggcatgaagatctatgagaaggatgaggagaagcagagggccctgctgggctacgccgacaaccagtgcaagctggagctgcagggcgtgaagggcggcgtggaccacgccgccgccttcggccgcatcgccttcagctgcccccagaaggagctgcctgacctggaggacctgatgaagcgggagaaccagaagatcctgacccccctggtgtccctggacaccccaggcaaggccaccgtgcaggtggtgatcctggccgaccctgatggccacgagatctgctttgtgggagatgaggccttccgggagctgagcaagatggaccctgagggcagcaagctgctggatgatgccatggctgctgacaagagtgatgagtggtttgccaagcacaacaagcccaaggccagcggctag

SEQ ID NO: 34622 - DNA, 1506 bp, Artificial Sequence
  Description of Artificial Sequence: Synthetic coding sequence
atgaggctgacccccttcagcctgagcacaggcaacagcttccgctacagccggcggctgaagaagaacatctttggaacagccccagccctgcgggccagcgagatgagcctgcggcccagcagccgcatcttcccctgcttcagcagaaatggcctggacttcaccatcgtcatcaccctgctgcagccccctgtgcccggcatctccttcatcgtggccaagcccaggctcttccctggggccggcagcgctggctgcggcctgctggagcggctcttcctgagcctgctgctgggcaccggcctgcgctggtgccggggctgcttccctggggcccgcttctgcagcaccaccagccctgagggcaacaccaccttcaccggcctgcggcgcagcgcccggacccagaggctgcagggccccaagccaggccccccagctgccaccgtggcccggcagaccagccgggtgtccccagccccaccctgcagcctgcggcccggcctgcggcatgagagcgcccccagcgctgccagtgatgtgacagcccggggggccctgcggggcctgggctgcaccgtgcgggtgacagctgcctgtggcggcaaccacggctgcagccagctgcactttgtgttcaaggtgggcaaccgcttccagacagcccgcttctacagagatgtgctgggcatgaaggtgctgcggcatgaggagtttgaggagggctgcaaggccgcctgcaatggcccctatgatggcaagtggagcaagaccatggtgggctttggaccagaagatgaccactttgtggccgagctgacctacaactacggcgtgggggactacaagctgggcaatgacttcatgggcatcaccctggccagcagccaggccgtgtccaatgccaggaagctggagtggcccctgacagaggtggccgagggcgtgtttgaaacagaggcccctgggggctacaagttctacctgcagaacagaagcctgccccagagcgaccctgtgctgaaggtgaccctggccgtgtctgacctgcagaagagcctgaactactggtgcaacctgctgggcatgaagatctatgagaaggatgaggagaagcagagggccctgctgggctatgctgacaaccagtgcaagctggagctgcagggcgtgaagggcggcgtggaccatgctgctgccttcggcagaattgccttcagctgcccccagaaggagctgcctgacctggaggacctgatgaagcgggagaaccagaagatcctgacccccctggtgtccctggacacccctgggaaggccaccgtgcaggtggtgatcctggccgaccctgatggccacgagatctgctttgtgggagatgaggccttccgggagctgagcaagatggaccctgagggcagcaagctgctggatgatgccatggctgctgacaagagtgatgagtggtttgccaagcacaacaagcccaaggccagcggctag

SEQ ID NO: 34623 - DNA, 870 bp, Artificial Sequence
  Description of Artificial Sequence: Synthetic coding sequence
atgaggaacctgaagaaggccgccaagctgcctgtgatgggcatgatcccctgcttcctgaagagccccctgggcagtgactacacccgcatcacagaagattccttcagcaagccctatgatggcaagtggagcaagaccatggtgggctttggaccagaagatgaccactttgtggccgagctgacctacaactacggcgtgggggactacaagctgggcaatgacttcatgggcatcaccctggccagcagccaggccgtgtccaatgccaggaagctggagtggcccctgacagaggtggccgagggcgtgtttgaaacagaggcccctgggggctacaagttctacctgcagaacagaagcctgccccagagcgaccctgtgctgaaggtgaccctggccgtgtctgacctgcagaagagcctgaactactggtgcaacctgctgggcatgaagatctatgagaaggatgaggagaagcagagggccctgctgggctatgctgacaaccagtgcaagctggagctgcagggcgtgaagggcggcgtggaccatgctgctgccttcggcagaattgccttcagctgcccccagaaggagctgcctgacctggaggacctgatgaagcgggagaaccagaagatcctgacccccctggtgtccctggacacccctgggaaggccaccgtgcaggtggtgatcctggccgaccctgatggccacgagatctgctttgtgggagatgaggccttccgggagctgagcaagatggaccctgagggcagcaagctgctggatgatgccatggctgctgacaagagtgatgagtggtttgccaagcacaacaagcccaaggccagcggctag

SEQ ID NO: 34624 - DNA, 5850 bp, Artificial Sequence
  Description of Artificial Sequence: Synthetic coding sequence
atgggcaacagctatgccggccagctgaagaccaccaggtttgaggaggtgctgcacaacagcattgaggccagcctgcggagcaacaacctggtgccccggcccatcttcagccagctgtacctggaggccgagcagcagctggccgccctggagggcggcagccgggtggacaatgaggaggaggaggaggagggggagggcggcctggagaccaatggaccacccaaccccttccagctgcaccccctgcctgagggctgctgcaccacagatggcttctgccaggccggcaaggacctgcggctggtgtccatcagcaatgagcccatggatgtgcctgctggcttcctgctggtgggcgtgaagagccccagcctgcctgaccacctgctggtgtgtgctgtggacaagcgcttcctgcctgatgacaatggccacaatgccctgctgggcttcagcggcaactgtgtgggctgtgggaagaagggcttctgctacttcacagagttcagcaaccacatcaacctgaagctgaccacccagcccaagaagcagaagcacctgaagtactacctggtgagaaatgcccagggcaccctgaccaagggccccctcatctgctggaagggcagcgagttccgcagccggcagatcccagccagcacctgcagcagcagcctcttccctgccctggagagcacagctgccttccccagcgagcctgtgcccggcaccaaccccagcatcctgatgggcgcccagcaggccggccctgccagtgaccaccccagcctgaatgctgccatgggccctgctgtgttcaacgggaaggacagccccaagtgccagcagctggccaagaacaacctgctggccctgccccggcccagcgccctgggcatcctgagcaacagcggcccccccaagaagaggcacaagggctggagccctgagagccccagcgccccagatggcggctgcccccagggcggcggcaacagagccaagtatgagagcgctggcatgagctgtgtgccccaggtgggcctggtgggccctgcctctgtgaccttccctgtggtggccagcggggagcctgtgtctgtgcctgacaacctgctgaagatctgcaaggccaagcctgtgatcttcaagggccacggcaacttcccctacctgtgtggcaacctgaatgatgtggtggtgagccccctgctgtacacctgctaccagaacagccagagcgtgtcccgggcctatgagcagtacggggccagcgccatccagcccatcagcgaggagatgcagctgctgctgactgtgtactacctggtgcagctggccgctgaccaggtgcccctgatggaggacctggagcagatcttcctgcgctcctggagggagagccacctgacagagatccggcagtaccagcaggccccaccccagcccttccccccagcccccagcgctgctgcccctgtgaccagcgcccagctgccctggctggccagcctggccgccagcagctgcaatgattctgtgcacgtgattgaatgtgcctacagcctggccgagggcctgtctgagatgttccggctgctggtggagggcaagctggccaagaccaactacgtggtgatcatctgtgcctgccgctctgctgccatcgacagctgcatcgctgtgacaggcaagtaccaggcccgcatcctgtctgagagcctgctgaccccagctgagtaccagaaggaggtgaactatgagctggtgacaggcaaggtggacagcctgggcgccttcttcagcaccctgtgcccagagggggacatcgacatcctgctggacaagttccaccaggagaaccagggccacatcagcagcagcctggccgccagctctgtgaccaaggccgccagcctggatgtgtctggcacccctgtgtgcaccagctacaacctggagccccacagcatccggcccttccagctggccgtggcccagaagctgctgagccacgtgtgcagcattgctgacagcagcacccagaacctggacctgggcagctttgagaaggtggacttcctgatctgcatccccccatctgaggtgacctaccagcagaccctgctgcacgtgtggcacagcggcgtgctgctggagctgggcctgaagaaggagcacatgaccaagcagagggtggagcagtatgtgctgaagctggacacagaggcccagaccaagttcaaggccttcctgcagaacagcttccagaacccccacaccctgtttgtgctgattcatgaccacgcccactgggacctggtgagcagcacagtgcacaacctgtacagccagagcgaccccagcgtgggcctggtggaccggctgctgaactgccgggaggtgaaggaggcccccaacatcgtgaccctgcacgtgaccagcttcccctatgccctgcagacccagcacaccctcatcagcccctacaatgagatccactggccagccagctgcagcaatggagtggacctgtaccacgagaacaagaagtacttcggcctgtctgagttcatcgagagcaccctgagcggccacagcctgcccctgctgcgctatgacagcagctttgaggccatggtgacagccctgggcaagcgcttcccccggctgcacagcgctgtgatccgcacctttgtgctggtgcagcactacgccgccgccctgatggctgtgtctggcctgccccagatgaagaactacacctctgtggagaccctggagatcacccagaacctgctgaacagccccaagcagtgcccctgtggccacggcctgatggtgctgctgcgggtgccctgcagccccctggccgtggtggcctatgaaaggctggcccacgtgcgggcccggctggccctggaggagcactttgagatcatcctgggcagccccagcagtggagtgacagtgggcaagcactttgtgaagcagctgaggatgtggcagaagattgaagatgtggagtggaggccccagacctacctggagctggagggcctgccctgcatcctgatcttcagcggcatggacccccatggagagagcctgcccaggagcctgcgctactgtgacctgcggctcatcaacagcagctgcctggtgaggacagccctggagcaggagctgggcctggccgcctactttgtgtccaatgaggtgcccctggagaagggggccagaaatgaggccctggagagtgatgctgagaagctgagcagcacagacaatgaagatgaggagctgggcacagagggcagcaccagcgagaagaggagccccatgaagcgggagaggagccgcagccatgattctgccagcagcagcctgagcagcaaggccagcggcagcgccctgggcggggagagcagcgcccagcccacagccctgccccagggcgagcacgcccggagcccccagccccggggccctgctgaggagggccgggcccctggagagaagcagaggccccgggccagccagggccccccatctgccatcagccgccacagccctggccccaccccccagcctgactgcagcctgaggacaggccagaggtctgtgcaggtgtctgtgaccagcagctgcagccagctgagcagcagcagcggcagcagcagcagctctgtggccccagctgctggcacctgggtgctgcaggccagccagtgcagcctgaccaaggcctgccggcagccccccatcgtgttcctgcccaagctggtgtatgacatggtggtgtccacagacagcagcggcctgcccaaggccgccagcctgctgcccagccccagcgtgatgtgggccagcagcttccggcccctgctgagcaagaccatgaccagcacagagcagagcctgtactaccggcagtggacagtgccccggcccagccacatggactatggcaacagagctgagggccgggtggatggcttccacccccggcggctgctgctgagcggccccccccagatcggcaagacaggagcctacctgcagttcctgtctgtgctgagcaggatgctggtgcggctgacagaggtggatgtgtatgatgaggaggagatcaacatcaacctgcgggaggagagtgactggcactacctgcagctgagtgacccctggccagacctggagctgttcaagaagctgccctttgactacatcatccatgaccccaagtatgaagatgccagcctcatctgcagccactaccagggcatcaagtcagaagatcggggcatgagcaggaagccagaggacctgtatgtgcggcggcagacagccaggatgaggctgagcaaatatgctgcctacaacacctaccaccactgtgagcagtgccaccagtacatgggcttccacccccgctaccagctgtatgagagcaccctgcacgcctttgccttctcctacagcatgctgggggaggagatccagctgcacttcatcatccccaagagcaaggagcaccactttgtgttcagccagcccggcggccagctggagagcatgaggctgcccctggtgacagacaagagccatgagtacatcaagagccccaccttcacccccaccaccggcagacatgagcacggcctcttcaacctgtaccacgccatggatggagccagccacctgcacgtgctggtggtgaaggagtatgagatggccatctacaagaagtactggcccaaccacatcatgctggtgctgcccagcatcttcaacagcgctggggtgggcgccgcccacttcctgatcaaggagctgagctaccacaacctggagctggagaggaaccggcaggaggagctgggcatcaagccccaggacatctggcccttcatcgtcatcagtgatgacagctgtgtgatgtggaatgtggtggatgtgaacagcgctggggagaggagccgggagttctcctggagcgagagaaatgtgtccctgaagcacatcatgcagcacatcgaggccgccccagacatcatgcactacgccctgctgggcctgaggaagtggagcagcaagacccgggccagcgaggtgcaggagcccttcagccgctgccacgtgcacaacttcatcatcctgaatgtggacctgacccagaatgtgcagtacaaccagaaccgcttcctgtgtgatgatgtggacttcaacctgcgggtgcacagcgctggcctgctgctgtgccgcttcaaccgcttctctgtgatgaagaagcagatcgtggtgggcggccacaggagcttccacatcaccagcaaggtgtctgacaacagcgctgctgtggtgcctgcccagtacatctgtgccccagacagcaagcacaccttcctggccgccccagcccagctgctgctggagaagttcctgcagcaccacagccacctgttcttccccctgagcctgaagaaccacgaccaccctgtgctgtctgtggactgctacctgaacctgggcagccagatctctgtgtgctacgtgagcagccggccccacagcctgaacatcagctgcagcgacctgctcttcagcggcctgctgctgtacctgtgtgacagctttgtgggcgccagcttcctgaagaagttccacttcctgaagggggccaccctgtgtgtgatctgccaggacaggagcagcctgcggcagacagtggtgcggctggagctggaggatgagtggcagttccggctgagagatgagttccagacagccaatgccagagaagatcggcccctcttcttcctgaccggccgccacatctag

SEQ ID NO: 34625 - DNA, 1395 bp, Artificial Sequence
  Description of Artificial Sequence: Synthetic coding sequence
atgagggagggcagcagcaccctgtctgagatcaggaagctgaagccaggcatcatggtgtgcacctgcaaccccagctacagcaaccaggagacagaggtgcaggagaacagccctggccacagagctggcctggagcccttctttgacttcatcgtgtccatcaatggcagccggctgaacaaggacaatgacaccctgaaggacctgctgaaggccaacgtggagaagcctgtgaagatgctgatctacagcagcaagaccctggagctgcgggagacctctgtgacccccagcaacctgtggggcggccagggcctgctgggcgtgtccatccgcttctgcagctttgatggagccaatgaaaatgtgtggcacgtgctggaggtggagagcaacagccctgctgccctggccggcctgcggccccacagcgactacatcattggagctgacacagtgatgaatgaaagtgaagatctcttcagcctgattgagacccatgaggccaagcccctgaagctgtatgtgtacaacacagacacagacaactgccgggaggtgatcatcacccccaacagcgcctggggcggggagggcagcctgggctgcggcatcggctacggctacctgcaccgcatccccacccggccctttgaggagggcaagaagatcagcctgcccggccagatggccggcacccccatcacccccctgaaggatggcttcacagaggtgcagctgagctctgtgaacccccccagcctgagccccccaggcaccaccggcatcgagcagagcctgaccggcctgagcatcagcagcaccccacctgctgtgtcctctgtgctgagcactggagtgcccaccgtgcccctgctgcccccccaggtgaaccagagcctgacctctgtgccccccatgaacccagccaccaccctgcccggcctgatgcccctgcctgctggcctgcccaacctgcccaacctgaacctgaacctgcctgccccccacatcatgcctggggtgggcctgcctgagctggtgaaccctggcctgccccccctgcccagcatgccacccaggaacctgcccggcatcgcccccctgcccctgcccagcgagttcctgcccagcttccccctggtgcctgagagcagcagcgctgccagcagcggggagctgctgagcagcctgccccccaccagcaatgcccccagcgaccctgccaccaccacagccaaggcagatgctgccagcagcctgactgtggatgtgaccccacccacagccaaggcccccaccaccgtggaggacagagtgggggacagcacccctgtgtctgagaagcctgtgtctgctgctgtggatgccaatgccagcgagagcccctag

SEQ ID NO: 34626 - DNA, 399 bp, Artificial Sequence
  Description of Artificial Sequence: Synthetic coding sequence
atgatcagcatcacagagtggcagaagattggagtgggcatcactggatttggcatcttcttcatcctgtttggcaccctgctgtactttgacagcgtgctgctggcctttggaaacctgctcttcctgaccggcctgagcctcatcatcggcctgaggaagaccttctggttcttcttccagaggcacaagctgaagggcaccagcttcctgctgggcggcgtggtgattgtgctgctgcgctggcccctgctgggcatgttcctggagacctacggcttcttcagcctcttcaagggcttcttccctgtggccttcggcttcctgggcaatgtgtgcaacatccccttcctgggcgccctcttccggcggctgcagggcaccagctccatggtgtag

SEQ ID NO: 34627 - DNA, 918 bp, Artificial Sequence
  Description of Artificial Sequence: Synthetic coding sequence
atgtctgtggaccctgcctgcccccagagcctgccctgctttgaggccagtgactgcaaggagagcagccccatgcctgtgatctgtggccctgaggagaactaccccagcctgcagatgagcagcgctgagatgccccacacagagaccgtgagccccctgcccagctccatggacctgctgatccaggacagcccagacagcagcaccagccccaagggcaagcagcccaccagcgctgagaagtctgtggccaagaaggaggacaaggtgcctgtgaagaagcagaagaccaggacagtgttcagcagcacccagctgtgtgtgctgaatgaccgcttccagaggcagaagtacctgagcctgcagcagatgcaggagctgagcaacatcctgaacctgagctacaagcaggtgaagacctggttccagaaccagaggatgaagagcaagcgctggcagaagaacaactggcccaagaacagcaatggagtgacccagaaggccagcgcccccacctaccccagcctgtacagcagctaccaccagggctgcctggtgaaccccaccggcaacctgcccatgtggagcaaccagacctggaacaacagcacctggagcaaccagacccagaacatccagagctggagcaaccacagctggaacacccagacctggtgcacccagagctggaacaaccaggcctggaacagccccttctacaactgtggggaggagagcctgcagagctgcatgcagttccagcccaacagccctgccagtgacctggaggccgccctggaggccgccggggagggcctgaatgtcatccagcagaccacccgctacttcagcaccccccagaccatggacctcttcctgaactacagcatgaacatgcagccagaagatgtgtag

SEQ ID NO: 34628 - DNA, 1842 bp, Artificial Sequence
  Description of Artificial Sequence: Synthetic coding sequence
atggccgccacagctgtggccgctgctgtggccggcacagaaagtgcccagggccccccaggccctgctgccagcctggagctgtggctgaacaaggccacagaccccagcatgtctgagcaggactggagcgccatccagaacttctgtgagcaggtgaacacagaccccaacggccccacccacgccccctggctgctggcccacaagatccagagcccccaggagaaggaggccctgtatgccctgactgtgctggagatgtgcatgaaccactgtggggagaagttccacagcgaggtggccaagttccgcttcctgaatgagctgatcaaggtgctgagccccaagtacctgggctcctgggccaccgggaaggtgaagggccgggtcatcgagatcctcttctcctggacagtgtggttccctgaggacatcaagatcagagatgcctaccagatgctgaagaagcagggcatcatcaagcaggaccccaagctgcctgtggacaagatcctgcccccacccagcccctggcccaagagcagcatctttgatgctgatgaggagaagagcaagctgctgacccggctgctgaagagcaaccaccctgaggacctgcaggccgccaacagactcatcaagaacctggtgaaggaggagcaggagaagtctgagaaggtgtccaagagggtgtctgctgtggaggaggtgcgcagccacgtgaaggtgctgcaggagatgctgtccatgtacagaagacctggccaggcccccccagaccaggaggccctgcaggtggtgtatgagcgctgtgagaagctgcggcccaccctcttccggctggccagtgacaccacagatgatgatgatgccctggccgagatcctgcaggccaatgacctgctgacccagggcgtgctgctgtacaagcaggtgatggagggccgggtgaccttcggcaacagagtgaccagcagcctgggggacatccctgtgtccagggtcttccagaacccagctggctgcatgaagacctgccccctgattgacctggaggtggacaatggacctgcccagatgggcaccgtggtgcccagcctgctgcaccaggacctggccgccctgggcatcagtgatgcccctgtgacaggcatggtgtctggccagaactgctgtgaggagaagaggaaccccagcagcagcaccctgcccggcggcggcgtgcagaaccccagcgctgacaggaacctgctggacctgctgagcgcccagcctgccccctgccccctgaactacgtgtcccagaagtctgtgcccaaggaggtgcccccaggcaccaagagcagccctggctggagctgggaggccggccccctggcccccagccccagcagccagaacacccccctggcccaggtgtttgtgcccctggagagcgtgaagcccagcagcctgcccccactcatcgtgtatgacagaaatggcttccgcatcctgctgcacttcagccagacaggagcccctggccaccctgaggtgcaggtgctgctgctgaccatgatgagcacagccccccagcctgtgtgggacatcatgttccaggtggccgtgcccaagtccatgagggtgaagctgcagcctgccagcagcagcaagctgcctgccttcagccccctgatgcccccagctgtgatcagccagatgctgctgctggacaacccccacaaggagcccatccggctgcgctacaagctgaccttcaaccagggcggccagcccttcagcgaggtgggggaggtgaaggacttcccagacctggccgtgctgggcgccgcctag

SEQ ID NO: 34629 - DNA, 522 bp, Artificial Sequence
  Description of Artificial Sequence: Synthetic coding sequence
atgaccttcagcaagctgctgatctgcctggacttcctggatgtgctggagaggatgggcgtggccctgctcttcatctggaagcaggtggagctgctgctgggcatcagcctgtacagcttcctgaccggcatcagtgatgcccctgtgacaggcatggtgaggatgcccttccctggccctggagagaggatgggcggcagccagacctgcccctgtgaggccgccctgcccggggagcagagaggagccccagccctgagccgctgggaccacggcctgggcggccccaagcccctgccccacccctactgcctggccgacacctggggccggcaggtggcccctggcagctgcttcctggaggtgtgccctggagctgcctgtgacctggccctgtccttccccagctgccccaagcgctgccaccagagcggcccccagcagctgggctgggcccaggagagctgtgccctggtgctgctgtggctgatggtgatccacaccctggtgctcttctag

SEQ ID NO: 34630 - DNA, 861 bp, Artificial Sequence
  Description of Artificial Sequence: Synthetic coding sequence
atggctgtgccccagcccatgcccagcatccctgaggacctggagagccgggaggccatggtggccttcttcaacagcgctgtggccagcgctgaggaggagcaggcccggctgcggggccagctgaaggagcagagggtgcgctgccggcggctggcccacctgctggccagcgcccagaaggagcctgaggccgccgccccagcccctggcaccggcggggacagcgtgtgtggggagacccaccgggccctgcagggcgccatggagaagctgcagagccgcttcatggagctgatgcaggagaaggctgacctgaaggagcgggtggaggagctggagcaccgctgcatccagctgtctggagaaacagacaccatcggggagtacatcgccctgtaccagagccagagagctgtgctgaaggagcggcaccgggagaaggaggagtacatcagccggctggcccaggacaaggaggagatgaaggtgaagctgctggagctgcaggagctggtgctgcggctggtgggggacagaaatgagtggcacggccgcttcctggccgccgcccagaacccagcagatgagcccaccagcggggccccagccccccaggagctgggcgccgccaaccagcagggcgacctgtgtgaggtgtccctggccggctctgtggagcccgcccagggcgaggcccgggagggcagcccccgggacaaccccacagcccagcagatcatgcagctgctgcgggagatgcagaacccccgggagaggcctggcctgggcagcaacccctgcatccccttcttctacagagcagatgaaaatgatgaggtgaagatcaccgtcatctag

SEQ ID NO: 34631 - DNA, 3009 bp, Artificial Sequence
  Description of Artificial Sequence: Synthetic coding sequence
atgtggccccagccccggctgccccccaggcctgccatgtctgaggagacccggcagagcaagctggccgccgccaagaagaagctgcgggagtaccagcagaggaacagccctggggtgcccaccggggccaagaagaagaagaagatcaagaatggcagcaaccctgagaccaccaccagcggcggctgccacagccctgaggacacccccaaggacaatgctgccaccctgcagcccagtgatgacacagtgctgcctggaggagtgcccagccctggggccagcctgacctccatggccgccagccagaaccatgatgctgacaacgtgcccaacctgatggatgagaccaagaccttcagcagcacagagagcctgcggcagctgagccagcagctgaatggcctggtgtgtgagagcgccacctgtgtgaatggagagggccctgccagcagcgccaacctgaaggacctggagagccgctaccagcagctggccgtggccctggacagcagctatgtgaccaacaagcagctgaacatcaccatcgagaagctgaagcagcagaaccaggagatcacagaccagctggaggaggagaagaaggagtgccaccagaagcagggcgccctgcgggagcagctgcaggtgcacatccagaccatcggcatcctggtgtctgagaaggccgagctgcagacagccctggcccacacccagcacgccgcccggcagaaggagggggagagcgaggacctggccagccggctgcagtacagcagaagaagagtgggggagctggagcgggccctgtctgctgtgtccacccagcagaagaaggctgaccgctacaacaaggagctgaccaaggagagagatgccctgcggctggagctgtacaagaacacccagagcaatgaagacctgaagcaggagaagtctgagctggaggagaagctgcgggtgctggtgacagagaaggccggcatgcagctgaacctggaggagctgcagaagaagctggagatgacagagctgctgctgcagcagttcagcagccgctgtgaggccccagatgccaaccagcagctgcagcaggccatggaggagcgggcccagctggaggcccacctgggccaggtgatggagagcgtgcggcagctgcagatggagcgggacaagtatgcagagaacctgaagggggagagcgccatgtggaggcagaggatgcagcagatgtctgagcaggtgcacaccctgcgggaggagaaggagtgcagcatgagccgggtgcaggagctggagaccagcctggccgagctgaggaaccagatggccgagcccccacctcctgagcccccagctggccccagcgaggtggagcagcagctgcaggccgaggccgagcacctgaggaaggagctggagggcctggccggccagctgcaggcccaggtgcaggacaatgaaggcctgagccggctgaaccgggagcaggaggagcggctgctggagctggagagagctgctgagctgtggggcgagcaggccgaggcccggcggcagatcctggagaccatgcagaatgacaggaccaccatcagccgggccctgagccagaaccgggagctgaaggagcagctggccgagctgcagagcggctttgtgaagctgaccaatgaaaacatggagatcaccagcgccctgcagagcgagcagcacgtgaagcgggagctgggcaagaagctgggggagctgcaggagaagctgtctgagctgaaggagaccgtggagctgaagagccaggaggcccagagcctgcagcagcagagggaccagtacctgggccacctgcagcagtatgtggccgcctaccagcagctgaccagcgagaaggaggtgctgcacaaccagctgctgctgcagacccagctggtggaccagctgcagcagcaggaggcccagggcaaggctgtggccgagatggcccggcaggagctgcaggagacccaggagcggctggaggccgccacccagcagaaccagcagctgcgggcccagctgagcctgatggcccaccctggagaaggagatggcctggaccgggaggaggaggaggatgaggaggaggaggaggaggaggccgtggccgtgccccagcccatgcccagcatccctgaggacctggagagccgggaggccatggtggccttcttcaacagcgctgtggccagcgctgaggaggagcaggcccggctgcggggccagctgaaggagcagagggtgcgctgccggcggctggcccacctgctggccagcgcccagaaggagcctgaggccgccgccccagcccctggcaccggcggggacagcgtgtgtggggagacccaccgggccctgcagggcgccatggagaagctgcagagccgcttcatggagctgatgcaggagaaggctgacctgaaggagcgggtggaggagctggagcaccgctgcatccagctgtctggagaaacagacaccatcggggagtacatcgccctgtaccagagccagagagctgtgctgaaggagcggcaccgggagaaggaggagtacatcagccggctggcccaggacaaggaggagatgaaggtgaagctgctggagctgcaggagctggtgctgcggctggtgggggacagaaatgagtggcacggccgcttcctggccgccgcccagaacccagcagatgagcccaccagcggggccccagccccccaggagctgggcgccgccaaccagcagggcgacctgtgtgaggtgtccctggccggctctgtggagcccgcccagggcgaggcccgggagggcagcccccgggacaaccccacagcccagcagatcatgcagctgctgcgggagatgcagaacccccgggagaggcctggcctgggcagcaacccctgcatccccttcttctacagagcagatgaaaatgatgaggtgaagatcaccgtcatctag

SEQ ID NO: 34632 - DNA, 1422 bp, Artificial Sequence
  Description of Artificial Sequence: Synthetic coding sequence
atgtggccccagccccggctgccccccaggcctgccatgtctgaggagacccggcagagcaagctggccgccgccaagaagaagctgcgggagtaccagcagaggaacagccctggggtgcccaccggggccaagaagaagaagaagatcaagaatggcagcaaccctgagaccaccaccagcggcggctgccacagccctgaggacatccaggacatcctgaaggtgctggtgtctgacctgaacagaagcaatggagtggccctgccccccctggacaagtggaagacccccaaggacaatgctgccaccctgcagcccagtgatgacacagtgctgcccggcggcgtgcccagccctggggccagcctgacctccatggccgccagccagaaccatgatgctgacaacgtgcccaacctgatggatgagaccaagaccttcagcagcacagagagcctgcggcagctgagccagcagctgaatggcctggtgtgtgagagcgccacctgtgtgaatggagagggccctgccagcagcgccaacctgaaggacctggagagccgctaccagcagctggccgtggccctggacagcagctatgtgaccaacaagcagctgaacatcaccatcgagaagctgaagcagcagaaccaggagatcacagaccagctggaggaggagaagaaggagtgccaccagaagcagggcgccctgcgggagcagctgcaggtgcacatccagaccatcggcatcctggtgtctgagaaggccgagctgcagacagccctggcccacacccagcacgccgcccggcagaaggagggggagagcgaggacctggccagccggctgcagtacagcagaagaagagtgggggagctggagcgggccctgtctgctgtgtccacccagcagaagaaggctgaccgctacaacaaggagctgaccaaggagagagatgccctgcggctggagctgtacaagaacacccagagcaatgaagacctgaagcaggagaagtctgagctggaggagaagctgcgggtgctggtgacagagaaggccggcatgcagctgaacctggaggagctgcagaagaagctggagatgacagagctgctgctgcagcagttcagcagccgctgtgaggccccagatgccaaccagcagctgcagcaggccatggaggagcgggcccagctggaggcccacctgggccaggtgatggagagcgtgcggcagctgcagatggagcgggacaagtatgcagagaacctgaagggggagagcgccatgtggaggcagaggatgcagcagatgtctgagcaggtgcacaccctgcgggaggagaaggaatgttccatgagccgggtgcaggagctggagaccagcctggccgagctgaggaaccagatgtag

SEQ ID NO: 34633 - DNA, 414 bp, Artificial Sequence
  Description of Artificial Sequence: Synthetic coding sequence
atgaggccccagcaggcccctgtgtctgggaaggtgttcatccagagggactacagcagcggcacccgctgccagttccagaccaagtttcctgctgagctggagaacagaattgaccggcagcagtttgaggagaccgtgaggaccctgaacaacctgtatgcagaggccgagaagctgggcggccagagctacctggagggctgcctggcctgcctgacagcctacaccatcttcctgtgcatggagacccactatgagaaggtgctgaagaaggtgtccaagtacatccaggagcagaatgagaagatctatgccccccagggcctgctgctgacagaccccatcgagcggggcctgcgggtgattgagatcaccatctatgaagatcggggcatgagcagtggaagatag

SEQ ID NO: 34634 - DNA, 405 bp, Artificial Sequence
  Description of Artificial Sequence: Synthetic coding sequence
atgaggccccagcaggcccctgtgtctgggaaggtgttcatccagagggactacagcagcggcacccgctgccagttccagaccaagtttcctgctgagctggagaacagaattgaccggcagcagtttgaggagaccgtgaggaccctgaacaacctgtatgcagaggccgagaagctgggcggccagagctacctggagggctgcctggcctgcctgacagcctacaccatcttcctgtgcatggagacccactatgagaaggtgctgaagaaggtgtccaagtacatccaggagcagaatgagaagatctatgccccccagggcctgctgctgacagaccccatcgagcggggcctgcgggtcttccggctgaagctgcccttcatgaagacagaggcctag

SEQ ID NO: 34635 - DNA, 414 bp, Artificial Sequence; identical to SEQ ID NO: 34633
  Description of Artificial Sequence: Synthetic coding sequence

SEQ ID NO: 34636 - DNA, 414 bp, Artificial Sequence; identical to SEQ ID NO: 34633
  Description of Artificial Sequence: Synthetic coding sequence

SEQ ID NO: 34637 - DNA, 501 bp, Artificial Sequence
  Description of Artificial Sequence: Synthetic coding sequence
atggatgaccagcgctgccccctggatgatggccaggccggggctgctgaggccacagctgcccccaccctggaggaccgcatcgcccagcccagcatgacagccagcccccagacagaggagttctttgacctgattgccagcagccagagccggcggctggatgaccagagggcctctgtgggcagcctgcccggcctgcgcatcacccacagcaatgccggccacctgcggggccacggggagccccaggagcctggagatgacttcttcaacatgctgatcaagtaccagagcagcagaattgatgaccagcgctgccccccaccagatgtgctgccccggggccccaccatgccagatgaggacttcttcagcctcatccagagggtgcaggccaagaggatggatgagcagagggtggacctggccggcggccctgagcagggcgccggcggccccccagagccccagcagcagtgccagcccggggccagctag

SEQ ID NO: 34638 - DNA, 1959 bp, Artificial Sequence
  Description of Artificial Sequence: Synthetic coding sequence
atggaggccagctgcctggagctggccctggagggggagcggctgtgcaaggccggggacttcaagacaggagtggccttctttgaggccgctgtgcaggtgggcacagaggacctgaagaccctgagcgccatctacagccagctgggcaatgcctacttctacctgaaggagcacggccgggccctggagtaccacaagcatgacctgctgctggcccggaccatcggggacaggatgggagaggccaaggccagcggcaacctgggcaacaccctgaaggtgctgggccgctttgatgaggccgctgtgtgctgccagaggcacctgagcatcgcccaggagcagggcgacaaggtgggggaggcccgggccctgtacaacattggaaatgtgtaccacgccaagggcaagcagctgtcctggaatgctgccaatgccacccaggaccccggccacctgcccccagatgtgcgggagaccctgtgcaaggccagcgagttctatgaaagaaacctgagcctggtgaaggagctgggggacagagctgcccagggccgggcctacggcaacctgggcaacacccactacctgctgggcaacttcacagaggccaccaccttccacaaggagcggctggccatcgccaaggagtttggagacaaggctgctgagcggcgggcctacagcaacctgggcaatgcccacgtgttcctgggccgctttgatgtggccgctgagtactacaagaagaccctgcagctgagccggcagctgcgggaccaggccgtggaggcccaggcctgctacagcctgggcaacacctacaccctgctgcaggactatgaaagagctgctgagtaccacctgcggcacctgctgattgcccaggagctggccgacagagtgggggagggccgggcctgctggagcctgggcaatgcctacgtgtccatgggccggcctgcccaggccctgacctttgccaagaagcacctgcagatcagccaggagattggagacagacatggagagctgacagccaggatgaatgtggcccagctgcagctggtgctgggccgcctgaccagccctgctgccagcgagaagccagacctggccggctatgaggcccagggcgcccggcccaagaggacccagaggctgtctgctgagacctgggacctgctgcggctgcccctggagcgggagcagaatggagacagccaccacagcggggactggaggggccccagccgggacagcctgcccctgcctgtgcgcagcaggaagtaccaggagggcccagatgctgagcggcggccccgggagggcagccacagccccctggacagcgcagatgtgcgggtgcacgtgcccaggaccagcatcccccgggcccccagcagtgatgaggagtgcttctttgacctgctgaccaagttccagagcagcaggatggatgaccagcgctgccccctggatgatggccaggccggggctgctgaggccacagctgcccccaccctggaggaccgcatcgcccagcccagcatgacagccagcccccagacagaggagttctttgacctgattgccagcagccagagccggcggctggatgaccagagggcctctgtgggcagcctgcccggcctgcgcatcacccacagcaatgccggccacctgcggggccacggggagccccaggagcctggagatgacttcttcaacatgctgatcaagtaccagagcagcagaattgatgaccagcgctgccccccaccagatgtgctgccccggggccccaccatgccagatgaggacttcttcagcctcatccagagggtgcaggccaagaggatggatgagcagagggtggacctggccggcggccctgagcagggcgccggcggccccccagagccccagcagcagtgccagcccggggccagctag

SEQ ID NO: 34639 - DNA, 501 bp, Artificial Sequence; identical to SEQ ID NO: 34637
  Description of Artificial Sequence: Synthetic coding sequence

SEQ ID NO: 34640 - DNA, 1374 bp, Artificial Sequence
  Description of Artificial Sequence: Synthetic coding sequence
atggccggccctgcccctcctgtggctgatgagctgcccggccctgctgcccggcggctgtacagcaggatggaggccagctgcctggagctggccctggagggggagcggctgtgcaaggccggggacttcaagacaggagtggccttctttgaagctgctgtgcaggtgggcacagaggacctgaagaccctgagcgccatctacagccagctgggcaatgcctacttctacctgaaggagcacggccgggccctggagtaccacaagcatgacctgctgctggcccggaccatcggggacaggatgggagaggccaaggccagcggcaacctgggcaacaccctgaaggtgctgggccgctttgatgaagctgctgtgtgctgccagaggcacctgagcatcgcccaggagcagggcgacaaggtgggggaggcccgggccctgtacaacattggaaatgtgtaccacgccaagggcaagcagctgtcctggaatgctgccaatgccacccaggaccccggccacctgcccccagatgtgcgggagaccctgtgcaaggccagcgagttctatgaaagaaacctgagcctggtgaaggagctgggggaccgggccgcccagggccgggcctacggcaacctgggcaacacccactacctgctgggcaacttcacagaggccaccaccttccacaaggagcggctggccatcgccaaggagtttggagacaaggctgctgagcggcgggcctacagcaacctgggcaatgcccacgtgttcctgggccgctttgatgtggccgctgagtactacaagaagaccctgcagctgagccggcagctgcgggaccaggccgtggaggcccaggcctgctacagcctgggcaacacctacaccctgctgcaggactatgaaagagctgctgagtaccacctgcggcacctgctgattgcccaggagctggccgacagagtgggggagggccgggcctgctggagcctgggcaatgcctacgtgtccatgggccgcccagcccaggccctgacctttgccaagaagcacctgcagatcagccaggagatcggggacagacatggagagctgacagccaggatgaatgtggcccagctgcagctggtgctgggccgcctgaccagccctgctgccagcgagaagccagacctggccggctatgaggcccagggcgagttccagggctgcggcggcgtgctgctgcccactggaacagaccgcatccgcagctgtggcggcgtgggcagccggcccggccagcacggcggcggcggcagccggcagaagatggcccccaccagccagttcttcctggccagcggcacagcccaggcctag

SEQ ID NO: 34641 - DNA, 501 bp, Artificial Sequence; identical to SEQ ID NO: 34637
  Description of Artificial Sequence: Synthetic coding sequence

SEQ ID NO: 34642 - DNA, 2028 bp, Artificial Sequence
  Description of Artificial Sequence: Synthetic coding sequence
atggccggccctgcccctcctgtggctgatgagctgcccggccctgctgcccggcggctgtacagcaggatggaggccagctgcctggagctggccctggagggggagcggctgtgcaaggccggggacttcaagacaggagtggccttctttgaagctgctgtgcaggtgggcacagaggacctgaagaccctgagcgccatctacagccagctgggcaatgcctacttctacctgaaggagcacggccgggccctggagtaccacaagcatgacctgctgctggcccggaccatcggggacaggatgggagaggccaaggccagcggcaacctgggcaacaccctgaaggtgctgggccgctttgatgaagctgctgtgtgctgccagaggcacctgagcatcgcccaggagcagggcgacaaggtgggggaggcccgggccctgtacaacattggaaatgtgtaccacgccaagggcaagcagctgtcctggaatgctgccaatgccacccaggaccccggccacctgcccccagatgtgcgggagaccctgtgcaaggccagcgagttctatgaaagaaacctgagcctggtgaaggagctgggggaccgggccgcccagggccgggcctacggcaacctgggcaacacccactacctgctgggcaacttcacagaggccaccaccttccacaaggagcggctggccatcgccaaggagtttggagacaaggctgctgagcggcgggcctacagcaacctgggcaatgcccacgtgttcctgggccgctttgatgtggccgctgagtactacaagaagaccctgcagctgagccggcagctgcgggaccaggccgtggaggcccaggcctgctacagcctgggcaacacctacaccctgctgcaggactatgaaagagctgctgagtaccacctgcggcacctgctgattgcccaggagctggccgacagagtgggggagggccgggcctgctggagcctgggcaatgcctacgtgtccatgggccgcccagcccaggccctgacctttgccaagaagcacctgcagatcagccaggagatcggggacagacatggagagctgacagccaggatgaatgtggcccagctgcagctggtgctgggccgcctgaccagccctgctgccagcgagaagccagacctggccggctatgaggcccagggcgcccggcccaagaggacccagaggctgtctgctgagacctgggacctgctgcggctgcccctggagcgggagcagaatggagacagccaccacagcggggactggaggggccccagccgggacagcctgcccctgcctgtgcgcagcaggaagtaccaggagggcccagatgctgagcggcggccccgggagggcagccacagccccctggacagcgcagatgtgcgggtgcacgtgcccaggaccagcatcccccgggcccccagcagtgatgaggagtgcttctttgacctgctgaccaagttccagagcagcaggatggatgaccagcgctgccccctggatgatggccaggccggggctgctgaggccacagctgcccccaccctggaggacagaattgcccagcccagcatgacagccagcccccagacagaggagttctttgacctgattgccagcagccagagccggcggctggatgaccagagggcctctgtgggcagcctgcccggcctgcgcatcacccacagcaatgccggccacctgcggggccatggagagccccaggagcctggagatgacttcttcaacatgctgatcaagtaccagagcagcagaattgatgaccagcgctgccccccaccagatgtgctgccccggggccccaccatgccagatgaggacttcttcagcctcatccagagggtgcaggccaagaggatggatgagcagagggtggacctggccggcggccctgagcagggcgctgggggccccccagagccccagcagcagtgccagcccggggccagctag

SEQ ID NO: 34643 - DNA, 2175 bp, Artificial Sequence
  Description of Artificial Sequence: Synthetic coding sequence
atgtttgacaccaccccccacagcggccgcagcacccccagcagcagccccagcctgaggaagaggctgcagctgctgccccccagcaggcctcctcctgagcctgagcccggcaccatggtggagaagggcagtgacagcagcagcgagaagggcggcgtgcccggcacccccagcacccagagcctgggcagcaggaacttcatccggaacagcaagaagatgcagagctggtacagcatgctgagccccacctacaagcagagaaatgaagacttcaggaagctgttcagcaagctgcctgaggccgagcggctgattgtggactacagctgtgccctgcagcgggagatcctgctgcagggccgcctgtacctgtctgagaactggatctgcttctacagcaacatcttccgctgggagaccaccatcagcatccagctgaaggaggtgacctgcctgaagaaggagaagacagccaagctgatccccaatgccatccagatctgcacagaaagtgagaagcacttcttcaccagctttggagcccgggaccgctgcttcctgctgatcttccggctgtggcagaatgccctgctggagaagaccctgagcccccgggagctgtggcacctggtgcaccagtgctacggcagcgagctgggcctgaccagtgaagatgaggactatgtgagccccctgcagctgaatggcctgggcacccccaaggaggtgggagatgtgattgccctgagtgacatcaccagcagtggagctgctgacaggagccaggagcccagccctgtgggcagccggcggggccacgtgacccccaacctgagccgggccagcagtgatgctgaccatggagctgaggaggacaaggaggagcaggtggacagccagccagatgccagcagcagccagacagtgacccctgtggccgagccccccagcacagagcccacccagccagatggccccaccaccctgggccccctggacctgctgcccagcgaggagctgctgacagacaccagcaacagcagcagcagcactggagaggaggccgacctggccgccctgctgcctgacctgagcggccgcctgctgatcaacagcgtcttccacgtgggcgctgagcggctgcagcagatgctgttcagtgacagccccttcctgcagggcttcctgcagcagtgcaagttcacagatgtgaccctgagcccctggagcggggacagcaagtgccaccagaggagagtgctgacctacaccatccccatcagcaaccccctgggccccaagagcgcctctgtggtggagacccagaccctcttccggcggggcccccaggccggcggctgtgtggtggacagcgaggtgctgacccagggcatcccctaccaggactacttctacacagcccaccgctactgcatcctgggcctggccaggaacaaggcccggctgcgggtgtcctctgagatccgctacaggaagcagccctggagcctggtgaagagcctgattgagaagaacagctggagcggcatcgaggactacttccaccacctggagcgggagctggccaaggccgagaagctgagcctggaggagggcggcaaggatgcccggggcctgctgagcggcctgcggcggaggaagaggcccctgtcctggagggcccatggagatggcccccagcacccagaccctgacccctgtgcccgggccggcatccacaccagcggcagcctgagcagccgcttcagcgagcccagcgtggaccagggccctggggccggcatccccagcgccctggtgctgatcagcatcgtcatctgtgtgtccctcatcatcctgattgccctgaatgtgctgctcttctaccgcctgtggagcctggagaggacagcccacacctttgagagctggcacagcctggccctggccaagggcaagttcccccagacagccacagagtgggccgagatcctggccctgcagaagcagttccacagcgtggaggtgcacaagtggaggcagatcctgcgggcctctgtggagctgctggatgagatgaagttcagcctggagaagctgcaccagggcatcaccgtgtctgaccccccatttgacacccagcccaggccagatgacagcttctcctag

SEQ ID NO: 34644 - DNA, 2142 bp, Artificial Sequence
  Description of Artificial Sequence: Synthetic coding sequence
atgtttgacaccaccccccacagcggccgcagcacccccagcagcagccccagcctgaggaagaggctgcagctgctgccccccagcaggcctcctcctgagcctgagcccggcaccatggtggagaagggcagtgacagcagcagcgagaagggcggcgtgcccggcacccccagcacccagagcctgggcagcaggaacttcatccggaacagcaagatgctgagccccacctacaagcagagaaatgaagacttcaggaagctgttcagcaagctgcctgaggccgagcggctcatcgtggactacagctgtgccctgcagcgggagatcctgctgcagggccgcctgtacctgtctgagaactggatctgcttctacagcaacatcttccgctgggagaccaccatcagcatccagctgaaggaggtgacctgcctgaagaaggagaagacagccaagctgatccccaatgccatccagatctgcacagagagcgagaagcacttcttcaccagctttggagcccgggaccgctgcttcctgctgatcttccggctgtggcagaatgccctgctggagaagaccctgagcccccgggagctgtggcacctggtgcaccagtgctacggcagcgagctgggcctgaccagtgaagatgaagattatgtgagccccctgcagctgaatggcctgggcacccccaaggaggtgggagatgtgattgccctgagtgacatcaccagcagcggggctgctgacaggagccaggagcccagccctgtgggcagcagaagaggccacgtgacccccaacctgagccgggccagcagtgatgctgaccacggggctgaggaggacaaggaggagcaggtggacagccagccagatgccagcagcagccagacagtgacccctgtggccgagccccccagcacagagcccacccagccagatggccccaccaccctgggccccctggacctgctgcccagcgaggagctgctgacagacaccagcaacagcagcagcagcactggagaggaggccgacctggccgccctgctgcctgacctgagcggccgcctgctgatcaacagcgtcttccacgtgggcgctgagcggctgcagcagatgctgttcagtgacagccccttcctgcagggcttcctgcagcagtgcaagttcacagatgtgaccctgagcccctggagcggggacagcaagtgccaccagaggagagtgctgacctacaccatccccatcagcaaccccctgggccccaagagcgcctctgtggtggagacccagaccctcttcagaagaggcccccaggccggcggctgtgtggtggacagcgaggtgctgacccagggcatcccctaccaggactacttctacacagcccaccgctactgcatcctgggcctggccaggaacaaggcccggctgcgggtgagcagcgagatccgctacaggaagcagccctggagcctggtgaagagcctcatcgagaagaacagctggagcggcatcgaggactacttccaccacctggagcgggagctggccaaggccgagaagctgagcctggaggagggcggcaaggatgcccggggcctgctgagcggcctgcggcggaggaagaggcccctgtcctggagggcccatggagatggcccccagcacccagaccctgacccctgtgcccgggccggcatccacaccagcggcagcctgagcagccgcttcagcgagcccagcgtggaccagggccctggagctggcatccccagcgccctggtgctgatcagcatcgtgctgatcatcctgattgccctgaatgtgctgctcttctaccgcctgtggagcctggagaggacagcccacacctttgagagctggcacagcctggccctggccaagggcaagttcccccagacagccacagagtgggccgagatcctggccctgcagaagcagttccacagcgtggaggtgcacaagtggaggcagatcctgcgggcctctgtggagctgctggatgagatgaagttcagcctggagaagctgcaccagggcatcaccgtgtctgaccccccatttgacacccagcccaggccagatgacagcttctcctag

SEQ ID NO: 34645 - DNA, 2421 bp, Artificial Sequence
  Description of Artificial Sequence: Synthetic coding sequence
atggatgatgtgctgcccctgatgccctgggagaccctgctggcccagggcagcccccagggcagcccagacctgcctgctggccagaggaagcagcagccccagggcgaccgggcccagggcctggccagcgagagctggaagctgctggaggtgcccatcatccacatcacccccagcagtgatggagagagccctgcctgcacccccaccccaagaagacggcagcagcagaggatgccagacccccagagcctgagccaggacagcaccaccccccacagcggccgcagcacccccagcagcagccccagcctgaggaagaggctgcagctgctgccccccagccggcccccacctgagcctgagcccggcaccatggtggagaagggcagtgacagcagcagcgagaagggcggcgtgcccggcacccccagcacccagagcctgggcagcaggaacttcatccggaacagcaagaagatgcagagctggtacagcatgctgagccccacctacaagcagagaaatgaagacttcaggaagctgttcagcaagctgcctgaggccgagcggctcatcgtggactacagctgtgccctgcagcgggagatcctgctgcagggccgcctgtacctgtctgagaactggatctgcttctacagcaacatcttccgctgggagaccaccatcagcatccagctgaaggaggtgacctgcctgaagaaggagaagacagccaagctgatccccaatgccatccagatctgcacagagagcgagaagcacttcttcaccagctttggagcccgggaccgctgcttcctgctgatcttccggctgtggcagaatgccctgctggagaagaccctgagcccccgggagctgtggcacctggtgcaccagtgctacggcagcgagctgggcctgaccagtgaagatgaagattatgtgagccccctgcagctgaatggcctgggcacccccaaggaggtgggagatgtgattgccctgagtgacatcaccagcagcggggctgctgacaggagccaggagcccagccctgtgggcagcagaagaggccacgtgacccccaacctgagccgggccagcagtgatgctgaccacggggctgaggaggacaaggaggagcaggtggacagccagccagatgccagcagcagccagacagtgacccctgtggccgagccccccagcacagagcccacccagccagatggccccaccaccctgggccccctggacctgctgcccagcgaggagctgctgacagacaccagcaacagcagcagcagcactggagaggaggacctggccgccctgctgcctgacctgagcggccgcctgctgatcaacagcgtcttccacgtgggcgctgagcggctgcagcagatgctgttcagtgacagccccttcctgcagggcttcctgcagcagtgcaagttcacagatgtgaccctgagcccctggagcggggacagcaagtgccaccagaggagagtgctgacctacaccatccccatcagcaaccccctgggccccaagagcgcctctgtggtggagacccagaccctcttccggcggggcccccaggccggcggctgtgtggtggacagcgaggtgctgacccagggcatcccctaccaggactacttctacacagcccaccgctactgcatcctgggcctggccaggaacaaggcccggctgcgggtgtcctctgagatccgctacaggaagcagccctggagcctggtgaagagcctgattgagaagaacagctggagcggcatcgaggactacttccaccacctggagcgggagctggccaaggccgagaagctgagcctggaggagggcggcaaggatgcccggggcctgctgagcggcctgcggcggaggaagaggcccctgtcctggagggcccatggagatggcccccagcacccagaccctgacccctgtgcccgggccggcatccacaccagcggcagcctgagcagccgcttcagcgagcccagcgtggaccagggccctggggccggcatccccagcgccctggtgctgatcagcatcgtgctgatcatcctgattgccctgaatgtgctgctcttctaccgcctgtggagcctggagaggacagcccacacctttgagagctggcacagcctggccctggccaagggcaagttcccccagacagccacagagtgggccgagatcctggccctgcagaagcagttccacagcgtggaggtgcacaagtggaggcagatcctgcgggcctctgtggagctgctggatgagatgaagttcagcctggagaagctgcaccagggcatcaccgtgtctgaccccccatttgacacccagcccaggccagatgacagcttctcctag

SEQ ID NO: 34646 - DNA, 1461 bp, Artificial Sequence
  Description of Artificial Sequence: Synthetic coding sequence
atgcactgcctgaagaggacccccaaggaggtgggagatgtgattgccctgagtgacatcaccagcagtggagctgctgacaggagccaggagcccagccctgtgggcagccggcggggccacgtgacccccaacctgagccgggccagcagtgatgctgaccatggagctgaggaggacaaggaggagcaggtggacagccagccagatgccagcagcagccagacagtgacccctgtggccgagccccccagcacagagcccacccagccagatggccccaccaccctgggccccctggacctgctgcccagcgaggagctgctgacagacaccagcaacagcagcagcagcactggagaggaggccgacctggccgccctgctgcctgacctgagcggccgcctgctgatcaacagcgtcttccacgtgggcgctgagcggctgcagcagatgctgttcagtgacagccccttcctgcagggcttcctgcagcagtgcaagttcacagatgtgaccctgagcccctggagcggggacagcaagtgccaccagaggagagtgctgacctacaccatccccatcagcaaccccctgggccccaagagcgcctctgtggtggagacccagaccctcttccggcggggcccccaggccggcggctgtgtggtggacagcgaggtgctgacccagggcatcccctaccaggactacttctacacagcccaccgctactgcatcctgggcctggccaggaacaaggcccggctgcgggtgtcctctgagatccgctacaggaagcagccctggagcctggtgaagagcctgattgagaagaacagctggagcggcatcgaggactacttccaccacctggagcgggagctggccaaggccgagaagctgagcctggaggagggcggcaaggatgcccggggcctgctgagcggcctgcggcggaggaagaggcccctgtcctggagggcccatggagatggcccccagcacccagaccctgacccctgtgcccgggccggcatccacaccagcggcagcctgagcagccgcttcagcgagcccagcgtggaccagggccctggggccggcatccccagcgccctggtgctgatcagcatcgtgctgatcatcctgattgccctgaatgtgctgctcttctaccgcctgtggagcctggagaggacagcccacacctttgagagctggcacagcctggccctggccaagggcaagttcccccagacagccacagagtgggccgagatcctggccctgcagaagcagttccacagcgtggaggtgcacaagtggaggcagatcctgcgggcctctgtggagctgctggatgagatgaagttcagcctggagaagctgcaccagggcatcaccgtgtctgaccccccatttgacacccagcccaggccagatgacagcttctcctag

SEQ ID NO: 34647 - DNA, 2217 bp, Artificial Sequence
  Description of Artificial Sequence: Synthetic coding sequence
atgaagggcttcaagctgagctgcacagccagcaacagcaacagaagcaccccagcctgcagccccatcctgaggaagaggagccgcagccccaccccccagaaccaggatggagacaccatggtggagaagggcagtgaccacagcagtgacaagagccccagcaccccagagcagggcgtgcagaggagctgcagcagccagagcggccgcagcggcggcaagaacagcaagaagagccagagctggtacaacgtgctgagccccacctacaagcagagaaatgaagacttcaggaagctgttcaagcagctgcctgacacagagcggctcatcgtggactacagctgtgccctgcagagggacatcctgctgcagggccgcctgtacctgtctgagaactggatctgcttctacagcaacatcttccgctgggagaccctgctgactgtgcggctgaaggacatctgcagcatgaccaaggagaagacagcccggctcatccccaatgccatccaggtgtgcacagacagcgagaagcacttcttcaccagctttggagcccgggacaggacctacatgatgatgttccggctgtggcagaatgccctgctggagaagcccctgtgccccaaggagctgtggcactttgtgcaccagtgctatggaaatgagctgggcctgaccagtgatgatgaagattatgtgcccccagatgatgacttcaacaccatgggctactgtgaggagatccctgtggaggagaatgaggtgaatgacagcagcagcaagagcagcattgagaccaagccagatgccagcccccagctgcccaagaagagcatcaccaacagcaccctgaccagcacaggcagcagcgaggcccctgtgtcctttgatggcctgcccctggaggaggaggccctggagggagatggcagcctggagaaggagctggccatcgacaacatcatgggagagaagattgagatgattgcccctgtgaacagccccagcctggacttcaatgacaatgaagacatccccacagagctgagtgacagcagtgacacccatgatgaaggagaggtgcaggccttctatgaggacctgagcggccggcagtatgtgaatgaggtgttcaacttctctgtggacaagctgtatgacctgctcttcaccaacagccccttccagagggacttcatggagcagaggcgcttcagtgacatcatcttccacccctggaagaaggaggagaatggaaaccagagcagggtcatcctgtacaccatcaccctgaccaaccccctggcccccaagacagccaccgtgcgggagacccagaccatgtacaaggccagccaggagagtgaatgttatgtgattgatgctgaggtgctgacccatgatgtgccctaccatgactacttctacaccatcaaccgctacaccctgaccagggtggccaggaacaagagccggctgcgggtgtccacagagctgcgctacaggaagcagccctggggcctggtgaagaccttcatcgagaagaacttctggagcggcctggaggactacttccgccacctggagagcgagctggccaagacagagagcacctacctggccgagatgcaccggcagagccccaaggagaaggccagcaagaccaccaccgtgagaagaaggaagaggccccacgcccacctgcgggtgccccacctggaggaggtgatgagccctgtgaccacccccacagatgaagatgtgggccaccgcatcaagcacgtggccggcagcacccagaccaggcacatccctgaggacaccccaaatggcttccacctgcagagcgtgtccaagctgctgctggtgatcagctgtgtggtgtccttcagcctggtgctgctggtgatcctgaacatgatgctgttctacaagctgtggatgctggagtacaccacccagaccctgacagcctggcagggcctgcggctgcaggagcggctgccccagagccagacagagtgggcccagctgctggagagccagcagaagtaccatgacacagagctgcagaagtggagggagatcatcaagagctctgtgatgctgctggaccagatgaaggacagcctcatcaacctgcagaatggcatccgcagccgggactacaccagcgagagcgaggagaagaggaaccgctaccactag

SEQ ID NO: 34648 - DNA, 2217 bp, Artificial Sequence
  Description of Artificial Sequence: Synthetic coding sequence
atgaagggcttcaagctgagctgcacagccagcaacagcaacagaagcaccccagcctgcagccccatcctgaggaagaggagccgcagccccaccccccagaaccaggatggagacaccatggtggagaagggcagtgaccacagcagtgacaagagccccagcaccccagagcagggcgtgcagaggagctgcagcagccagagcggccgcagcggcggcaagaacagcaagaagagccagagctggtacaacgtgctgagccccacctacaagcagagaaatgaagacttcaggaagctgttcaagcagctgcctgacacagagcggctcatcgtggactacagctgtgccctgcagagggacatcctgctgcagggccgcctgtacctgtctgagaactggatctgcttctacagcaacatcttccgctgggagaccctgctgactgtgcggctgaaggacatctgcagcatgaccaaggagaagacagcccggctcatccccaatgccatccaggtgtgcacagacagcgagaagcacttcttcaccagctttggagcccgggacaggacctacatgatgatgttccggctgtggcagaatgccctgctggagaagcccctgtgccccaaggagctgtggcactttgtgcaccagtgctatggaaatgagctgggcctgaccagtgatgatgaagattatgtgcccccagatgatgacttcaacaccatgggctactgtgaggagatccctgtggaggagaatgaggtgaatgacagcagcagcaagagcagcattgagaccaagccagatgccagcccccagctgcccaagaagagcatcaccaacagcaccctgaccagcacaggcagcagcgaggcccctgtgtcctttgatggcctgcccctggaggaggaggccctggagggagatggcagcctggagaaggagctggccatcgacaacatcatgggagagaagattgagatgattgcccctgtgaacagccccagcctggacttcaatgacaatgaagacatccccacagagctgagtgacagcagtgacacccatgatgaaggagaggtgcaggccttctatgaggacctgagcggccggcagtatgtgaatgaggtgttcaacttctctgtggacaagctgtatgacctgctcttcaccaacagccccttccagagggacttcatggagcagaggcgcttcagtgacatcatcttccacccctggaagaaggaggagaatggaaaccagagcagggtcatcctgtacaccatcaccctgaccaaccccctggcccccaagacagccaccgtgcgggagacccagaccatgtacaaggccagccaggagagtgaatgttatgtgattgatgctgaggtgctgacccatgatgtgccctaccatgactacttctacaccatcaaccgctacaccctgaccagggtggccaggaacaagagccggctgcgggtgtccacagagctgcgctacaggaagcagccctggggcctggtgaagaccttcatcgagaagaacttctggagcggcctggaggactacttccgccacctggagagcgagctggccaagacagagagcacctacctggccgagatgcaccggcagagccccaaggagaaggccagcaagaccaccaccgtgagaagaaggaagaggccccacgcccacctgcgggtgccccacctggaggaggtgatgagccctgtgaccacccccacagatgaagatgtgggccaccgcatcaagcacgtggccggcagcacccagaccaggcacatccctgaggacaccccaaatggcttccacctgcagagcgtgtccaagctgctgctggtgatcagctgtgtgatctgcttcagcctggtgctgctggtgatcctgaacatgatgctgttctacaagctgtggatgctggagtacaccacccagaccctgacagcctggcagggcctgcggctgcaggagcggctgccccagagccagacagagtgggcccagctgctggagagccagcagaagtaccatgacacagagctgcagaagtggagggagatcatcaagagctctgtgatgctgctggaccagatgaaggacagcctcatcaacctgcagaatggcatccgcagccgggactacaccagcgagagcgaggagaagaggaaccgctaccactag

SEQ ID NO: 34649 - DNA, 2238 bp, Artificial Sequence
  Description of Artificial Sequence: Synthetic coding sequence
atgaagggcttcaagctgagctgcacagccagcaacagcaacagaagcaccccagcctgcagccccatcctgaggaagaggagccgcagccccaccccccagaaccaggatggagacaccatggtggagaagggcagtgaccacagcagtgacaagagccccagcaccccagagcagggcgtgcagaggagctgcagcagccagagcggccgcagcggcggcaagaacagcaagagccacaagaggctgagcaagaagagccagagctggtacaacgtgctgagccccacctacaagcagagaaatgaagacttcaggaagctgttcaagcagctgcctgacacagagcggctgattgtggactacagctgtgccctgcagagggacatcctgctgcagggccgcctgtacctgtctgagaactggatctgcttctacagcaacatcttccgctgggagaccctgctgactgtgcggctgaaggacatctgcagcatgaccaaggagaagacagcccggctcatccccaatgccatccaggtgtgcacagattctgagaagcacttcttcaccagctttggagcccgggacaggacctacatgatgatgttccggctgtggcagaatgccctgctggagaagcccctgtgccccaaggagctgtggcactttgtgcaccagtgctatggaaatgagctgggcctgaccagtgatgatgaggactatgtgcccccagatgatgacttcaacaccatgggctactgtgaggagatccctgtggaggagaatgaggtgaatgacagcagcagcaagagcagcattgagaccaagccagatgccagcccccagctgcccaagaagagcatcaccaacagcaccctgaccagcacaggcagcagcgaggcccctgtgtcctttgatggcctgcccctggaggaggaggccctggagggagatggcagcctggagaaggagctggccatcgacaacatcatgggagagaagattgagatgattgcccctgtgaacagccccagcctggacttcaatgacaatgaagacatccccacagagctgagtgacagcagtgacacccatgatgaaggagaggtgcaggccttctatgaggacctgagcggccggcagtatgtgaatgaggtgttcaacttctctgtggacaagctgtatgacctgctcttcaccaacagccccttccagagggacttcatggagcagaggcgcttcagtgacatcatcttccacccctggaagaaggaggagaatggaaaccagagcagggtcatcctgtacaccatcaccctgaccaaccccctggcccccaagacagccaccgtgcgggagacccagaccatgtacaaggccagccaggagagcgagtgctacgtgattgatgctgaggtgctgacccatgatgtgccctaccatgactacttctacaccatcaaccgctacaccctgaccagggtggccaggaacaagagccggctgcgggtgtccacagagctgcgctacaggaagcagccctggggcctggtgaagaccttcatcgagaagaacttctggagcggcctggaggactacttccgccacctggagagcgagctggccaagacagagagcacctacctggccgagatgcaccggcagagccccaaggagaaggccagcaagaccaccaccgtgagaagaaggaagaggcctcatgcccacctgcgggtgccccacctggaggaggtgatgagccctgtgaccacccccacagatgaagatgtgggccaccgcatcaagcacgtggccggcagcacccagaccaggcacatccctgaggacacccccaacggcttccacctgcagagcgtgtccaagctgctgctggtgatcagctgtgtggtgtccttcagcctggtgctgctggtgatcctgaacatgatgctgttctacaagctgtggatgctggagtacaccacccagaccctgacagcctggcagggcctgcggctgcaggagcggctgccccagagccagacagagtgggcccagctgctggagagccagcagaagtaccatgacacagagctgcagaagtggagggagatcatcaagagctctgtgatgctgctggaccagatgaaggacagcctcatcaacctgcagaatggcatccgcagccgggactacaccagcgagagcgaggagaagaggaaccgctaccactag

SEQ ID NO: 34650 - DNA, 1989 bp, Artificial Sequence
  Description of Artificial Sequence: Synthetic coding sequence
atggagggcgcccccaccgtgcggcaggtgatgaatgaaggagacagcagcctggccacagacctgcaggaggatgtggaggagaaccccagccccaccgtggaggagaacaacgtggtggtgaagaagcagggccccaacctgcacaactggagcggggactggagcttctggatcagcagcagcacctacaaggacagaaatgaggagtaccgccggcagttcacccacctgcctgacacagagcggctgattgctgactatgcctgtgccctgcagagggacatcctgctgcagggccgcctgtacctgtctgagaactggctgtgcttctacagcaacatcttccgctgggagaccaccatcagcatcgccctgaagaacatcaccttcatgaccaaggagaagacagcccggctcatccccaatgccatccagatcgtgacagaaagtgagaagttcttcttcaccagctttggagcccgggacaggagctacctgagcatcttccggctgtggcagaatgtgctgctggacaagagcctgacccggcaggagttctggcagctgctgcagcagaactatggaacagagctgggcctgaatgctgaggagatggagaacctgagcctgagcattgaagatgtgcagcccaggagccctggccgcagcagcctggatgattctggagagagagatgagaagctgagcaagagcatctccttcaccagcgagagcatcagccgggtgtctgaaacagagagctttgatggcaacagcagcaagggcggcctgggcaaggaggagagccagaatgagaagcagaccaagaagagcctgctgcccaccctggagaagaagctgaccagggtgcccagcaagagcctggacctgaacaagaatgagtacctgagcctggacaagagcagcaccagtgacagcgtggatgaggagaatgtgcctgagaaggacctgcacggccgcctcttcatcaaccgcatcttccacatctctgctgacaggatgtttgagctgctcttcaccagcagccgcttcatgcagaagtttgccagcagcaggaacatcattgatgtggtgtccaccccctggacagctgagctgggcggggaccagctgcggaccatgacctacaccatcgtgctgaacagccccctgactggaaaatgtacagctgccacagagaagcagaccctgtacaaggagagccgggaggcccgcttctacctggtggacagcgaggtgctgacccatgatgtgccctaccatgactacttctacacagtgaaccgctactgcatcatccgcagcagcaagcagaagtgccgcctgcgggtgtccacagacctgaagtacaggaagcagccctggggcctggtgaagagcctcatcgagaagaacagctggagcagcctggaggactacttcaagcagctggagagtgacctgctgattgaggagagcgtgctgaaccaggccattgaagatcctgggaagctgaccggcctgcggaggagaagaaggaccttcaacagaacagctgagaccgtgcccaagctgagcagccagcacagcagtggagatgtgggcctgggcgccaagggggacatcaccgggaagaagaaggagatggagaactacaacgtgaccctcatcgtggtgatgagcatctttgtgctgctgctggtgctgctgaatgtgaccctcttcctgaagctgagcaagattgagcacgccgcccagagcttctaccgcctgcggctgcaggaggagaagagcctgaacctggccagtgacatggtgtccagagctgagaccatccagaagaacaaggaccaggcccaccggctgaagggcgtgctgcgggacagcatcgtgatgctggagcagctgaagagcagcctcatcatgctgcagaagacctttgacctgctgaacaagaacaagacaggcatggctgtggagagctag

SEQ ID NO: 34651 - DNA, 1374 bp, Artificial Sequence
  Description of Artificial Sequence: Synthetic coding sequence
atggagaacctgagcctgagcattgaagatgtgcagcccaggagccctggccgcagcagcctggatgacagcggggagagagatgagaagctgagcaagagcatctccttcaccagcgagagcatcagccgggtgtctgaaacagagagctttgatggcaacagcagcaaaggaggcctgggcaaggaggagagccagaatgagaagcagaccaagaagagcctgctgcccaccctggagaagaagctgaccagggtgcccagcaagagcctggacctgaacaagaatgagtacctgagcctggacaagagcagcaccagtgacagcgtggatgaagaaaatgtgcctgagaaggacctgcacggccgcctcttcatcaaccgcatcttccacatctctgctgacaggatgtttgagctgctcttcaccagcagccgcttcatgcagaagtttgccagcagcaggaacatcattgatgtggtgtccaccccctggacagctgagctgggcggggaccagctgcggaccatgacctacaccatcgtgctgaacagccccctgaccgggaagtgcacagctgccacagagaagcagaccctgtacaaggagagccgggaggcccgcttctacctggtggacagcgaggtgctgacccatgatgtgccctaccatgactacttctacacagtgaaccgctactgcatcatccgcagcagcaagcagaagtgccgcctgcgggtgtccacagacctgaagtacaggaagcagccctggggcctggtgaagagcctgattgagaagaacagctggagcagcctggaggactacttcaagcagctggagagtgacctgctgattgaggagagcgtgctgaaccaggccatcgaggaccccgggaagctgaccggcctgcggaggagaagaaggaccttcaacagaacagctgagaccgtgcccaagctgagcagccagcacagcagtggagatgtgggcctgggcgccaagggggacatcaccgggaagaagaaggagatggagaactacaacgtgaccctgattgtggtgatgagcatctttgtgctgctgctggtgctgctgaatgtgaccctcttcctgaagctgagcaagattgaacatgctgcccagagcttctaccgcctgcggctgcaggaggagaagagcctgaacctggccagtgacatggtgtccagagctgagaccatccagaagaacaaggaccaggcccaccggctgaagggcgtgctgcgggacagcatcgtgatgctggagcagctgaagagcagcctcatcatgctgcagaagacctttgacctgctgaacaagaacaagacaggcatggctgtggagagctag

SEQ ID NO: 34652 - DNA, 1176 bp, Artificial Sequence
  Description of Artificial Sequence: Synthetic coding sequence
atgaacatcttcctgtggaccaaggccgccctgcagatcctgctgatgaagtatgctgctggccacggcctggtgatccgctgcctgcctgagttccgcaccctgggccgcagcaccctggcccccagcggccagattgaaaatgtgcctgagaaggacctgcacggccgcctcttcatcaaccgcatcttccacatctctgctgacaggatgtttgagctgctcttcaccagcagccgcttcatgcagaagtttgccagcagcaggaacatcattgatgtggtgtccaccccctggacagctgagctgggcggggaccagctgcggaccatgacctacaccatcgtgctgaacagccccctgaccgggaagtgcacagctgccacagagaagcagaccctgtacaaggagagccgggaggcccgcttctacctggtggacagcgaggtgctgacccatgatgtgccctaccatgactacttctacacagtgaaccgctactgcatcatccgcagcagcaagcagaagtgccgcctgcgggtgtccacagacctgaagtacaggaagcagccctggggcctggtgaagagcctgattgagaagaacagctggagcagcctggaggactacttcaagcagctggagagtgacctgctgattgaggagagcgtgctgaaccaggccatcgaggaccccgggaagctgaccggcctgcggaggagaagaaggaccttcaacagaacagctgagaccgtgcccaagctgagcagccagcacagcagtggagatgtgggcctgggcgccaagggggacatcaccgggaagaagaaggagatggagaactacaacgtgaccctgattgtggtgatgagcatctttgtgctgctgctggtgctgctgaatgtgaccctcttcctgaagctgagcaagattgaacatgctgcccagagcttctaccgcctgcggctgcaggaggagaagagcctgaacctggccagtgacatggtgtccagagctgagaccatccagaagaacaaggaccaggcccaccggctgaagggcgtgctgcgggacagcatcgtgatgctggagcagctgaagagcagcctcatcatgctgcagaagacctttgacctgctgaacaagaacaagacaggcatggctgtggagagctag

SEQ ID NO: 34653 - DNA, 1143 bp, Artificial Sequence
  Description of Artificial Sequence: Synthetic coding sequence
atggagaacctgagcctgagcattgaagatgtgcagcccaggagccctggccgcagcagcctggatgacagcggggagagagatgagaagctgagcaagagcatctccttcaccagcgagagcatcagccgggtgtctgaaacagagagctttgatggcaacagcagcaaaggaggcctgggcaaggaggagagccagaatgagaagcagaccaagaagagcctgctgcccaccctggagaagaagctgaccagggtgcccagcaagagcctggacctgaacaagaatgagtacctgagcctggacaagagcagcaccagtgacagcgtggatgaagaaaatgtgcctgagaaggacctgcacggccgcctcttcatcaaccgcatcttccacatctctgctgacaggatgtttgagctgctcttcaccagcagccgcttcatgcagaagtttgccagcagcaggaacatcattgatgtggtgtccaccccctggacagctgagctgggcggggaccagctgcggaccatgacctacaccatcgtgctgaacagccccctgaccgggaagtgcacagctgccacagagaagcagaccctgtacaaggagagccgggaggcccgcttctacctggtggacagcgaggtgctgacccatgatgtgccctaccatgactacttctacacagtgaaccgctactgcatcatccgcagcagcaagcagaagtgccgcctgcgggtgtccacagacctgaagtacaggaagcagccctggggcctggtgaagagcctgattgagaagaacagctggagcagcctggaggactacttcaagcagctggagagtgacctgctgattgaggagagcgtgctgaaccaggccatcgaggaccccgggaagctgaccggcctgcggaggagaagaaggaccttcaacagaacagctgagaccgtgcccaagctgagcagccagcacagcagtggagatgtgggcctgggcgccaagggggacatcaccgggaagaagaaggagatggagaactacaacgtgaccctgattgtggtgatgagcatctttgtgctgctgctggtgctgctgaatgtgaccctcttcctgaagctgagcaagattgaacatgcctag

SEQ ID NO: 34654 - DNA, 1065 bp, Artificial Sequence
  Description of Artificial Sequence: Synthetic coding sequence
atgacagccctgagccgctctgaggccacagaggagggcggcaaccagcagatgcacaggaagacagccagcctgaacagccctgtgtcctgcaaggagaagccagacagagtggaggagcccccagactacagcctgcactggccagagggcctgaagggggaggagatcaagaagtgtggccgggagggcatcaccctgaacaagtacaaccagcagtaccacaagctgttcaaggatgtgcccctggaggaggtggtgctgaaggtgtgcagctgtgccctgcagagggacttcctgctgcagggccgcctgtacatcagccccaactggctgtgcttccacgccagcctgtttgggaaggacatcaaggtggtgattcctgtggtgtctgtgcagatgatcaagaagcacaagatggcccggctgctgcccaacggcctggccatcaccaccaacaccagccagaagtacatctttgtgtccctgctgagccgggacagcgtgtatgacctgctgcggcgggtgtgcacccacctgcagcccagcagcaagaagagcctgtctgtgcgggagttcagcggggagcctgagagcctggaggtgctgatccctgagatgaagtggaggaaggtgtgccccagcagccgcagcctgagcctgcctgacaacatcccctgcatcccccccagctctgtggacagcacagacagcttcttccccagcaggaagccacccatgtctgagaagagccgggcccaggtggcctctgaaaatggaggccgctgggcctggcccatgcctggctggggccctgcctgccccaagaagatgcccaactgcagccccacagccaagaatgctgtgtatgaggaggatgagctggaggaggagcccaggagcactggagagctgcggctgtgggactaccgcctgctgaaggtgttctttgtgctgatctgcttcctggtgatgagcagcagctacctggccttccgcatcagccggctggagcagcagctgtgcagcctgtcctgggatgatcctgtgcccggccacaggtag

SEQ ID NO: 34655 - DNA, 474 bp, Artificial Sequence
  Description of Artificial Sequence: Synthetic coding sequence
atgagcaagagctgtggcaacaacctggccgccatctctgtgggcatcagcctgctgctgctgctggtggtgtgtggcatcggctgtgtgtggcactggaagcaccgggtggccacccgcttcaccctgccccgcttcctgcagaggaggagcagcaggaggaaggtgtgcaccaagaccttcctgggcccccgcatcatcggcctgcggcatgagatctctgtggagacccaggaccacaagtctgctgtgcggggcaacaacacccatgacaactatgaaaatgtggaggccggcccccccaaggccaagggcaagacagacaaggagctgtatgaaaatacaggccagagcaactttgaggagcacatctatggaaatgagaccagcagtgactactacaacttccagaagccccggcccagcgaggtgccccaggatgaggacatctacatcctgcctgacagctactag

SEQ ID NO: 34656 - DNA, 474 bp, Artificial Sequence; identical to SEQ ID NO: 34655
  Description of Artificial Sequence: Synthetic coding sequence

SEQ ID NO: 34657 - DNA, 207 bp, Artificial Sequence
  Description of Artificial Sequence: Synthetic coding sequence
atgagcaagagctgtggcaacaacctggccgccatctctgtgggcatcagcctgctgctgctgctggtggtgtgtggcatcggctgtgtgtggcactggaagcaccgggtggccacccgcttcaccctgccccgcttcctgcagaggaggagcagcaggaggaaggtgtgcaccaagaccttcctgggcccccgcatcattggatag

SEQ ID NO: 34658 - DNA, 210 bp, Artificial Sequence
  Description of Artificial Sequence: Synthetic coding sequence
atgagcaagagctgtggcaacaacctggccgccatctctgtgggcatcagcctgctgctgctgctggtggtgtgtggcatcggctgtgtgtggcactggaagcaccgggtggccacccgcttcaccctgccccgcttcctgcagaggaggagcagcaggaggaaggtgtgcaccaagaccttcctgggcccccgcatcatcggcctgtag

SEQ ID NO: 34659 - DNA, 753 bp, Artificial Sequence
  Description of Artificial Sequence: Synthetic coding sequence
atgatccagagcagccagcccatgagcctgaagctgacctgcagcgccttccggctgcagagggccctgcgcttcctgctgggccgcctgccctggagggtggccagcggggcccggcgcttccgccgctggctgaaccgctacagctacacagtgctgagctcctggccagagcgggccctgatcagcctgaagaacagaagccgcttcctggtgcggcccaacaccaggaacagagccttctcctggacctgcagagctgcccggagcaagccccggcccaggaggagcacagccctgcccaggagccaggccagcagcagccgccacagctgggccgagttcctgaagttcaggaagagcttccagatgagcaacaccagccagcctgaccccagcaggcctggaacagagaggaccagcagcaaggaggccggctgccggcccctgggccagctggacagcttctcctgggccgcccggcccccacctggagctgctggcctggccgtgtctgagggcttcttcaggaagatccgcagcagcgcccccagcagccccagcttcagccgggccctgatgagcaacacctacctgtgcttcctgaccaccggccccaggagcagccgggagaacacccagaagagcttccctgccaccagcccccgggagcctgtgaccagccggctgcggggcaaggccccagccctgagccccagccgggagctgtccttcaccagcgcccccttctag

SEQ ID NO: 34660 - DNA, 978 bp, Artificial Sequence
  Description of Artificial Sequence: Synthetic coding sequence
atgctggccgcccggctggtgtgcctgcggaccctgcccagcagggtcttccacccagccttcaccaaggccagccctgtggtgaagaacagcatcaccaagaaccagtggctgctgacccccagccgggagtatgccaccaagaccagaattggcatccggcggggccgcacaggccaggagctgaaggaggccgccctggagcccagcatggagaagatcttcaagattgaccagatgggccgctggtttgtggccggcggggccatcgagaaggctgtgatctggccccagtatgtgaaggaccgcatccacagcacctacatgtacctggccggcagcatcggcctgacagccctgagcgccatcgccatcagcaggacccctgtgctgatgaacttcatgatgaggggctcctgggtgaccatcggcgtgacctttgctgccatggtgggcgccggcatgctggtgcgcagcatcccctatgaccagagccctggccccaagcacctggcctggctgctgcacagcggcgtgatgggcgctgtggtggcccccctgaccatcctgggcggccccctgctgatccgggccgcctggtacacagctggcatcgtgggcggcctgagcacagtggccatgtgtgcccccagcgagaagttcctgaacatgggcgcccccctgggcgtgggcctgggcctggtgtttgtgagcagcctgggctccatgttcctgccccccaccaccgtggccggggccaccctgtacagcgtggccatgtatggaggcctggtgctcttctccatgttcctgctgtatgacacccagaaggtgatcaagagagctgaggtgagccccatgtatggagtgcagaagtatgaccccatcaacagcatgctgagcatctacatggacaccctgaacatcttcatgagggtggccaccatgctggccactggaggcaacaggaagaagtag

SEQ ID NO: 34661 - DNA, 1038 bp, Artificial Sequence
  Description of Artificial Sequence: Synthetic coding sequence
atgctggccgcccggctggtgtgcctgcggaccctgcccagcagggtcttccacccagccttcaccaaggccagccctgtggtgaagaacagcatcaccaagaaccagtggctgctgacccccagccgggagtatgccaccaagaccagaattggcatccggcggggccgcacaggccaggagctgaaggaggccgccctggagcccagcatggagaagatcttcaagattgaccagatgggccgctggtttgtggccggcggcgctgctgtgggcctgggcgccctgtgctactacggcctgggcctgagcaatgaaattggagccatcgagaaggctgtgatctggccccagtatgtgaaggaccgcatccacagcacctacatgtacctggccggcagcatcggcctgacagccctgagcgccatcgccatcagcaggacccctgtgctgatgaacttcatgatgaggggctcctgggtgaccatcggcgtgacctttgctgccatggtgggcgccggcatgctggtgcgcagcatcccctatgaccagagccctggccccaagcacctggcctggctgctgcacagcggcgtgatgggcgctgtggtggcccccctgaccatcctgggcggccccctgctgatccgggccgcctggtacacagctggcatcgtgggcggcctgagcacagtggccatgtgtgcccccagcgagaagttcctgaacatgggcgcccccctgggcgtgggcctgggcctggtgtttgtgagcagcctgggctccatgttcctgccccccaccaccgtggccggggccaccctgtacagcgtggccatgtatggaggcctggtgctcttctccatgttcctgctgtatgacacccagaaggtgatcaagagagctgaggtgagccccatgtatggagtgcagaagtatgaccccatcaacagcatgctgagcatctacatggacaccctgaacatcttcatgagggtggccaccatgctggccactggaggcaacaggaagaagtag

SEQ ID NO: 34662 - DNA, 960 bp, Artificial Sequence
  Description of Artificial Sequence: Synthetic coding sequence
atgctggccgcccggctggtgtgcctgcggaccctgcccagcagggtcttccacccagccttcaccaaggccagccctgtggtgaagaacagcatcaccaagaaccagtggctgctgacccccagccgggagtatgccaccaagaccagaattggcatccggcggggccgcacaggccaggagctgaaggaggccgccctggagcccagcatggagaagatcttcaagattgaccagatgggccgctggtttgtggccggcggcgctgctgtgggcctgggcgccctgtgctactacggcctgggcctgagcaatgaaattggagccatcgagaaggctgtgatctggccccagtatgtgaaggaccgcatccacagcacctacatgtacctggccggcagcatcggcctgacagccctgagcgccatcgccatcagcaggacccctgtgctgatgaacttcatgatgaggggctcctgggtgaccatcggcgtgacctttgctgccatggtgggcgccggcatgctggtgcgcagcatcccctatgaccagagccctggccccaagcacctggcctggctgctgcacagcggcgtgatgggcgctgtggtggcccccctgaccatcctgggcggccccctgctgatccgggccgcctggtacacagctggcatcgtgggcggcctgagcacagtggccatgtgtgcccccagcgagaagttcctgaacatgggcgcccccctgggcgtgggcctgggcctggtgtttgtgagcagcctgggctccatgttcctgccccccaccaccgtggccggggccaccctgtacagcgtggccatgtatggaggcctggtgctcttctccatgttcctgctgtatgacacccagaaggtgtcctctgtgcagaagtaccaccagtgcatggagttcaagaacatgatccccctgacccgctgctag

SEQ ID NO: 34663 - DNA, 999 bp, Artificial Sequence
  Description of Artificial Sequence: Synthetic coding sequence
atgctggccgcccggctggtgtgcctgcggaccctgccctttgtgaagaacagcatcaccaagaaccagtggctgctgacccccagccgggagtatgccaccaagacccgcatcggcatcagaagaggccgcacaggccaggagctgaaggaggccgccctggagcccagcatggagaagatcttcaagattgaccagatgggccgctggtttgtggccggcggcgctgctgtgggcctgggcgccctgtgctactacggcctgggcctgagcaatgagatcggggccatcgagaaggccgtcatctggccccagtatgtgaaggaccgcatccacagcacctacatgtacctggccggcagcatcggcctgacagccctgagcgccatcgccatcagcaggacccctgtgctgatgaacttcatgatgaggggctcctgggtgaccatcggcgtgacctttgctgccatggtgggcgccggcatgctggtgcgcagcatcccctatgaccagagccctggccccaagcacctggcctggctgctgcacagcggcgtgatgggcgctgtggtggcccccctgaccatcctgggcggccccctgctgatccgggccgcctggtacacagctggcatcgtgggcggcctgagcacagtggccatgtgtgcccccagcgagaagttcctgaacatgggcgcccccctgggcgtgggcctgggcctggtgtttgtgagcagcctgggctccatgttcctgccccccaccaccgtggccggggccaccctgtacagcgtggccatgtatggaggcctggtgctcttctccatgttcctgctgtatgacacccagaaggtgatcaagagagctgaggtgagccccatgtatggagtgcagaagtatgaccccatcaacagcatgctgagcatctacatggacaccctgaacatcttcatgagggtggccaccatgctggccaccggcggcaacaggaagaagtag

SEQ ID NO: 34664 - DNA, 5445 bp, Artificial Sequence
  Description of Artificial Sequence: Synthetic coding sequence
atgggcaacagctatgccggccagctgaagagcgccaggtttgaggaggccctgcacaacagcattgaggccagcctgcgctgcagctctgtggtgccccggcccatcttcagccagctgtacctggaccctgaccagcaccccttcagcagcgcagatgtgaagcccaaggtggaggacctggacaaggacctggtgaaccgctacacccagaatggcagcctggacttcagcaacaacctgactgtgaatgagatggaggatgatgaagatgatgaggagatgtctgacagcaacagcccccccatcccctacagccagaagccagcccctgagggcagctgcaccacagatggcttctgccaggccggcaaggacctgcggctggtgtccctgtgcatggagcagattgacatcccagctggcttcctgctggtgggcgccaagagccccaacctgcctgagcacatcctggtgtgtgctgtggacaagcgcttcctgcctgatgaccacggcaagaatgccctgctgggcttcagcggcaactgcatcggctgtggggagcggggcttccgctacttcacagagttcagcaaccacatcaacctgaagctgaccacccagcccaagaagcagaagcacctgaagtactacctggtgcgcagcagccagggcgtgctgagcaagggccccctcatctgctggaaggaatgtcgcagccggcagagcagcgccagctgccacagcatcaagcccagcagctctgtgagcagcacagtgaccccagaaaatggcaccaccaacggctacaagagcggcttcacccagacagatgctgccaatggaaacagcagccacggcggcaaaggaagtgccagcagcagcaccccagcccacacaggcaactacagcctgagcccccggcccagctatgccagcggggaccaggccaccatgttcatcagcggcccccccaagaagaggcaccggggctggtacccaggcagccccctgccccagcccggcctggtggtgcctgtgcccaccgtgcggcccctgagcaggacagagcccctgctgagcgcccctgtgccccagacccccctgaccggcatcctgcagccccggcccatcccagctggggagaccgtgattgtgcctgagaacctgctgagcaacagcggcgtgcggcctgtgatcctgattggctacggcaccctgccctacttctatggaaatgtgggggacatcgtggtgagccccctgctggtgaactgctacaagatcccccagctggagaacaaggacctggagaagctgggcctgaccggcagccagttcctgtctgtggagaacatgatcctgctgaccatccagtacctggtgcggctgggccagcaccagagccgggccctggccgagagcatgctgaccaccagcgagttcctgaaggagatctcctatgagctgatcaccgggaaggtgtccttcctggccagccacttcaagaccaccagcctgggagatgacctggacaagctgctggagaagatgcagcagaggagaggagacagcgtggtgaccccatttgatggagacctgaatgaatgtgtgagcccccaggaggccgccgccatgatccccacccagaacctggacctggacaatgagaccttccacatctaccagccccagctgactgtggccaggaagctgctgagccaggtgtgtgccatcgctgacagcggcagccagagcctggacctgggccacttcagcaaggtggacttcatcatcatcgtgcccaggtctgaggtgctggtgcagcagaccctgcagaggatccggcagagcggcgtgctggtggacctgggcctggaggagaatggaacagcccaccagagagctgagaagtatgtggtgcggctggacaatgagatccagaccaagtttgaggtgttcatgagaagagtgaagcagaacccctacaccctgtttgtgctggtgcatgacaacagccacgtggagctgaccagcgtcatcagcggcagcctgagccacagcgagcccagccacggcctggccgacagagtcatcaactgccgggaggtgctggaggccttcaacctgctggtgctgcaggtgtcctccttcccctacaccctgcagacccagcagagccgcatcagcagcagcaatgaggtgcactggatccagctggacaccggggaggatgtgggctgtgaggagaagctgtacttcggcctgtctgagtacagcaagagcctgcagtggggcatcaccagccccctgctgcgctgtgatgagacctttgagaagatggtgaacaccctgctggagcgctacccccggctgcacagcatggtggtgcgctgctacctgctgatccagcagtacagcgaggccctgatggccctgaccaccatggccagcctgcgggaccacagcaccccagagaccctgagcatcatggatgacctgatcagcagccctgggaagaacaagagcggccggggccacatgctgatcatccgggtgcccagcgtgcagctggccatgctggccaaggagcggctgcaggaggtgcgggacaagctgggcctgcagtacagatttgagatcatcctgggcaacccagccacagagctgtctgtggccacccactttgtggcccggctgaagtcctggagaggaaatgaacctgaggagtggatccccaggacctaccaggacctggatggcctgccctgcatcgtcatcctgaccgggaaggaccccctgggggagaccttccccaggagcctgaagtactgtgacctgcggctgattgacagcagctacctgaccaggacagccctggagcaggaggtgggcctggcctgctgctacgtgtccaaggaggtgatccggggccccaccgtggccctggacctgagcggcaaggagcaggagagagctgctgtgtctgaaaatgacagtgatgagctgctgattgacctggagcggccccagagcaacagcagcgctgtgacaggcaccagcggcagcatcatggagaatggagtgagcagcagcagcacagctgacaagagccagaagcagagcctgacccccagcttccagagccctgccaccagcctgggcctggatgaaggagtgtctgccagcagcgctggagctggagctggggagaccctgaagcaggagtgtgacagcctgggcccccagatggccagcagcaccaccagcaagcccagcagcagcagcagcggccccaggaccctgccctggccaggccagcccatccggggctgccggggcccccaggccgccctgccccctgtggtgatcctgagcaaggccgcctacagcctgctgggcagccagaagagcggcaagctgcccagcagcagcagcctgctgccccatgctgatgtggcctgggtgagcagcctgcggcccctgctgaacaaggacatgagcagcgaggagcagagcctgtactaccggcagtggaccctggcccggcagcaccacgccgactacagcaaccagctggaccctgccagcggcaccaggaacttccacccccggcggctgctgctgaccggccccccccaggtgggcaagacaggcagctacctgcagttcctgcgcatcctcttcaggatgctgatccggctgctggaggtggatgtgtatgatgaggaggagatcaacacagaccacaatgaaagcagcgaggtgtcccagagcgagggggagccctggccagacatcgagagcttcagcaagatgccctttgatgtgtctgtgcatgaccccaagtacagcctgatgagcctggtgtacacagagaagctggccggcgtgaagcaggaggtgatcaaggagagcaaggtggaggagcccaggaagcgggagaccgtgtccatcatgctgaccaagtatgctgcctacaacaccttccaccactgtgagcagtgccggcagtacatggacttcaccagcgccagccagatgtctgacagcaccctgcacgccttcaccttcagcagctccatgctgggggaggaggtgcagctgtacttcatcatccccaagagcaaggagagccactttgtgttcagcaagcagggcaagcacctggagagcatgaggctgcccctggtgtctgacaagaacctgaatgctgtgaagagccccatcttcacccccagcagcggcagacatgagcacggcctgctgaacctcttccacgccatggagggcatcagccacctgcacctgctggtggtgaaggagtatgagatgcccctgtacaggaagtactggcccaaccacatcatgctggtgctgcccggcatgttcaacaatgccggcgtgggcgccgcccgcttcctgatcaaggagctgagctaccacaacctggagctggagaggaaccggctggaggagctgggcatcaagaggcagtgtgtgtggcccttcatcgtgatgatggatgacagctgtgtgctgtggaacatccacagcgtgcaggagcccagcagccagcccatggaggtgggcgtgagcagcaagaatgtgtccctgaagacagtgctgcagcacatcgaggccacccccaagatcgtgcactacgccatcctgggcatccagaagtggagcagcaagctgaccagccagagcctgaaggcccccttcagccgctgccacgtgcatgacttcatcctgctgaacacagacctgacccagaatgtgcagtatgacttcaaccgctacttctgtgaagatgctgacttcaacctgcggaccaacagcagcggcctgctgatctgccgcttcaacaacttcagcctgatgaagaagcacgtgcaggtgggcggccagagggacttcatcatcaagcccaagatcatggtgtctgagagcctggcccccatcctgcccctgcagtacatctgtgccccagattctgagcacaccctgctggccgccccagcccagttcctgctggagaagttcctgcagcacgccagctacaagctgttccccaaggccatccacaacttccgcagccctgtgctggccatcgactgctacctgaacatcggccctgaggtggccatctgctacatcagcagccggccccacagcagcaatgtgaactgtgagggcgtcttcttcagcggcctgctgctgtacctgtgtgacagctttgtgggcgctgacctgaagaagttcaagttcctgaagggggccaccctgtgtgtgatctgccaggacaggagcagcctgcggcagaccatcgtgcggctggagctggaggatgagtggcagttccggctgagagatgagttccagacagccaacagcagtgatgacaagcccctgtacttcctgaccggcagacatgtgtag

SEQ ID NO: 34665 - DNA, 2229 bp, Artificial Sequence
  Description of Artificial Sequence: Synthetic coding sequence
atgggcaacagctatgccggccagctgaagagcgccaggtttgaggaggccctgcacaacagcattgaggccagcctgcgctgcagctctgtggtgccccggcccatcttcagccagctgtacctggaccctgaccagcaccccttcagcagcgcagatgtgaagcccaaggtggaggacctggacaaggacctggtgaaccgctacacccagaatggcagcctggacttcagcaacaacctgactgtgaatgagatggaggatgatgaagatgatgaggagatgtctgacagcaacagcccccccatcccctacagccagaagccagcccctgagggcagctgcaccacagatggcttctgccaggccggcaaggacctgcggctggtgtccctgtgcatggagcagattgacatcccagctggcttcctgctggtgggcgccaagagccccaacctgcctgagcacatcctggtgtgtgctgtggacaagcgcttcctgcctgatgaccacggcaagaatgccctgctgggcttcagcggcaactgcatcggctgtggggagcggggcttccgctacttcacagagttcagcaaccacatcaacctgaagctgaccacccagcccaagaagcagaagcacctgaagtactacctggtgcgcagcagccagggcgtgctgagcaagggccccctcatctgctggaaggaatgtcgcagccggcagagcagcgccagctgccacagcatcaagcccagcagctctgtgagcagcacagtgaccccagaaaatggcaccaccaacggctacaagagcggcttcacccagacagatgctgccaatggaaacagcagccacggcggcaaaggaagtgccagcagcagcaccccagcccacacaggcaactacagcctgagcccccggcccagctatgccagcggggaccaggccaccatgttcatcagcggcccccccaagaagaggcaccggggctggtacccaggcagccccctgccccagcccggcctggtggtgcctgtgcccaccgtgcggcccctgagcaggacagagcccctgctgagcgcccctgtgccccagacccccctgaccggcatcctgcagccccggcccatcccagctggggagaccgtgattgtgcctgagaacctgctgagcaacagcggcgtgcggcctgtgatcctgattggctacggcaccctgccctacttctatggaaatgtgggggacatcgtggtgagccccctgctggtgaactgctacaagatcccccagctggagaacaaggacctggagaagctgggcctgaccggcagccagttcctgtctgtggagaacatgatcctgctgaccatccagtacctggtgcggctgggccctgaccaggtgcccctgcgggaggagtttgagcagatcatgctgaaggccatgcaggagttcaccctgcgggagcgggccctgcagattggagcccagtgtgtgcctgtgtccccaggccagctgccctggctggcccggctcatcgcctctgtgtcccaggacctggtgcacgtggtggtgacccagaacagcctggccgagggcatcagcgagaccctgcggaccctgtctgagatgaggcactaccagaggctgcctgactatgtggtggtgatctgtgccagcaagatcagaggaaatgagttctgtgtggtggtgctgggccagcaccagagccgggccctggccgagagcatgctgaccaccagcgagttcctgaaggagatctcctatgagctgatcaccgggaaggtgtccttcctggccagccacttcaagaccaccagcctgggagatgacctggacaagctgctggagaagatgcagcagaggagaggagacagcgtggtgaccccatttgatggagacctgaatgaatgtgtgagcccccaggaggccgccgccatgatccccacccagaacctggacctggacaatgagaccttccacatctaccagccccagctgactgtggccaggaagctgctgagccaggtgtgtgccatcgctgacagcggcagccagagcctggacctgggccacttcagcaaggtggacttcatcatcatcgtgcccaggtctgaggtgctggtgcagcagaccctgcagaggatccggcagagcgtgtccttccaggccctgtgccacatcgccaaccctgtgatgggctag

SEQ ID NO: 34666 - DNA, 5772 bp, Artificial Sequence
  Description of Artificial Sequence: Synthetic coding sequence
atgggcaacagctatgccggccagctgaagagcgccaggtttgaggaggccctgcacaacagcattgaggccagcctgcgctgcagctctgtggtgccccggcccatcttcagccagctgtacctggaccctgaccagcaccccttcagcagcgcagatgtgaagcccaaggtggaggacctggacaaggacctggtgaaccgctacacccagaatggcagcctggacttcagcaacaacctgactgtgaatgagatggaggatgatgaagatgatgaggagatgtctgacagcaacagcccccccatcccctacagccagaagccagcccctgagggcagctgcaccacagatggcttctgccaggccggcaaggacctgcggctggtgtccctgtgcatggagcagattgacatcccagctggcttcctgctggtgggcgccaagagccccaacctgcctgagcacatcctggtgtgtgctgtggacaagcgcttcctgcctgatgaccacggcaagaatgccctgctgggcttcagcggcaactgcatcggctgtggggagcggggcttccgctacttcacagagttcagcaaccacatcaacctgaagctgaccacccagcccaagaagcagaagcacctgaagtactacctggtgcgcagcagccagggcgtgctgagcaagggccccctcatctgctggaaggaatgtcgcagccggcagagcagcgccagctgccacagcatcaagcccagcagctctgtgagcagcacagtgaccccagaaaatggcaccaccaacggctacaagagcggcttcacccagacagatgctgccaatggaaacagcagccacggcggcaaaggaagtgccagcagcagcaccccagcccacacaggcaactacagcctgagcccccggcccagctatgccagcggggaccaggccaccatgttcatcagcggcccccccaagaagaggcaccggggctggtacccaggcagccccctgccccagcccggcctggtggtgcctgtgcccaccgtgcggcccctgagcaggacagagcccctgctgagcgcccctgtgccccagacccccctgaccggcatcctgcagccccggcccatcccagctggggagaccgtgattgtgcctgagaacctgctgagcaacagcggcgtgcggcctgtgatcctgattggctacggcaccctgccctacttctatggaaatgtgggggacatcgtggtgagccccctgctggtgaactgctacaagatcccccagctggagaacaaggacctggagaagctgggcctgaccggcagccagttcctgtctgtggagaacatgatcctgctgaccatccagtacctggtgcggctgggccctgaccaggtgcccctgcgggaggagtttgagcagatcatgctgaaggccatgcaggagttcaccctgcgggagcgggccctgcagattggagcccagtgtgtgcctgtgtccccaggccagctgccctggctggcccggctcatcgcctctgtgtcccaggacctggtgcacgtggtggtgacccagaacagcctggccgagggcatcagcgagaccctgcggaccctgtctgagatgaggcactaccagaggctgcctgactatgtggtggtgatctgtgccagcaagatcagaggaaatgagttctgtgtggtggtgctgggccagcaccagagccgggccctggccgagagcatgctgaccaccagcgagttcctgaaggagatctcctatgagctgatcaccgggaaggtgtccttcctggccagccacttcaagaccaccagcctgggagatgacctggacaagctgctggagaagatgcagcagaggagaggagacagcgtggtgaccccatttgatggagacctgaatgaatgtgtgagcccccaggaggccgccgccatgatccccacccagaacctggacctggacaatgagaccttccacatctaccagccccagctgactgtggccaggaagctgctgagccaggtgtgtgccatcgctgacagcggcagccagagcctggacctgggccacttcagcaaggtggacttcatcatcatcgtgcccaggtctgaggtgctggtgcagcagaccctgcagaggatccggcagagcggcgtgctggtggacctgggcctggaggagaatggaacagcccaccagagagctgagaagtatgtggtgcggctggacaatgagatccagaccaagtttgaggtgttcatgagaagagtgaagcagaacccctacaccctgtttgtgctggtgcatgacaacagccacgtggagctgaccagcgtcatcagcggcagcctgagccacagcgagcccagccacggcctggccgacagagtcatcaactgccgggaggtgctggaggccttcaacctgctggtgctgcaggtgagcagcttcccctacaccctgcagacccagcagagccgcatcagcagcagcaatgaggtgcactggatccagctggacacaggagaagatgtgggctgtgaggagaagctgtacttcggcctgtctgagtacagcaagagcctgcagtggggcatcaccagccccctgctgcgctgtgatgagacctttgagaagatggtgaacaccctgctggagcgctacccccggctgcacagcatggtggtgcgctgctacctgctgatccagcagtacagcgaggccctgatggccctgaccaccatggccagcctgcgggaccacagcaccccagagaccctgagcatcatggatgacctgatcagcagccctgggaagaacaagagcggccggggccacatgctgatcatccgggtgcccagcgtgcagctggccatgctggccaaggagcggctgcaggaggtgcgggacaagctgggcctgcagtacagatttgagatcatcctgggcaacccagccacagagctgtctgtggccacccactttgtggcccggctgaagtcctggagaggaaatgaacctgaggagtggatccccaggacctaccaggacctggatggcctgccctgcatcgtcatcctgaccgggaaggaccccctgggggagaccttccccaggagcctgaagtactgtgacctgcggctgattgacagcagctacctgaccaggacagccctggagcaggaggtgggcctggcctgctgctacgtgtccaaggaggtgatccggggccccaccgtggccctggacctgagcggcaaggagcaggagagagctgctgtgtctgaaaatgacagtgatgagctgctgattgacctggagcggccccagagcaacagcagcgctgtgacaggcaccagcggcagcatcatggagaatggagtgagcagcagcagcacagctgacaagagccagaagcagagcctgacccccagcttccagagccctgccaccagcctgggcctggatgagggcgtgtctgccagcagcgctggggccggggccggggagaccctgaagcaggagtgtgacagcctgggcccccagatggccagcagcaccaccagcaagcccagcagcagcagcagcggccccaggaccctgccctggccaggccagcccatccggggctgccggggcccccaggccgccctgccccctgtggtgatcctgagcaaggccgcctacagcctgctgggcagccagaagagcggcaagctgcccagcagcagcagcctgctgccccatgctgatgtggcctgggtgagcagcctgcggcccctgctgaacaaggacatgagcagcgaggagcagagcctgtactaccggcagtggaccctggcccggcagcaccacgccgactacagcaaccagctggaccctgccagcggcaccaggaacttccacccccggcggctgctgctgactggaccaccccaggtgggcaagacaggcagctacctgcagttcctgcgcatcctcttcaggatgctgatccggctgctggaggtggatgtgtatgatgaggaggagatcaacacagaccacaatgaatcttctgaggtgtcccagagcgagggggagccctggccagacatcgagagcttcagcaagatgccctttgatgtgtctgtgcatgaccccaagtacagcctgatgagcctggtgtacacagagaagctggccggcgtgaagcaggaggtgatcaaggagagcaaggtggaggagcccaggaagcgggagaccgtgtccatcatgctgaccaagtatgctgcctacaacaccttccaccactgtgagcagtgccggcagtacatggacttcaccagcgccagccagatgtctgacagcaccctgcacgccttcaccttcagcagctccatgctgggggaggaggtgcagctgtacttcatcatccccaagagcaaggagagccactttgtgttcagcaagcagggcaagcacctggagagcatgaggctgcccctggtgtctgacaagaacctgaatgctgtgaagagccccatcttcacccccagcagcggcagacatgaacatggcctgctgaacctcttccacgccatggagggcatcagccacctgcacctgctggtggtgaaggagtatgagatgcccctgtacaggaagtactggcccaaccacatcatgctggtgctgcccggcatgttcaacaatgctggggtgggcgccgcccgcttcctgatcaaggagctgagctaccacaacctggagctggagaggaaccggctggaggagctgggcatcaagaggcagtgtgtgtggcccttcatcgtgatgatggatgacagctgtgtgctgtggaacatccacagcgtgcaggagcccagcagccagcccatggaggtgggcgtgagcagcaagaatgtgtccctgaagacagtgctgcagcacatcgaggccacccccaagatcgtgcactacgccatcctgggcatccagaagtggagcagcaagctgaccagccagagcctgaaggcccccttcagccgctgccacgtgcatgacttcatcctgctgaacacagacctgacccagaatgtgcagtatgacttcaaccgctacttctgtgaagatgctgacttcaacctgcggaccaacagcagcggcctgctgatctgccgcttcaacaacttcagcctgatgaagaagcacgtgcaggtgggcggccagagggacttcatcatcaagcccaagatcatggtgtctgagagcctggcccccatcctgcccctgcagtacatctgtgccccagacagcgagcacaccctgctggccgccccagcccagttcctgctggagaagttcctgcagcacgccagctacaagctgttccccaaggccatccacaacttccgcagccctgtgctggccatcgactgctacctgaacatcggccctgaggtggccatctgctacatcagcagccggccccacagcagcaatgtgaactgtgaaggagtcttcttcagcggcctgctgctgtacctgtgtgacagctttgtgggcgctgacctgaagaagttcaagttcctgaagggggccaccctgtgtgtgatctgccaggacaggagcagcctgcggcagaccatcgtgcggctggagctggaggatgagtggcagttccggctgagagatgagttccagacagccaacagcagtgatgacaagcccctgtacttcctgaccggccgccacgtgtag

SEQ ID NO: 34667 - DNA, 2244 bp, Artificial Sequence
  Description of Artificial Sequence: Synthetic coding sequence
atgggcaacagctatgccggccagctgaagagcgccaggtttgaggaggccctgcacaacagcattgaggccagcctgcgctgcagctctgtggtgccccggcccatcttcagccagctgtacctggaccctgaccagcaccccttcagcagcgcagatgtgaagcccaaggtggaggacctggacaaggacctggtgaaccgctacacccagaatggcagcctggacttcagcaacaacctgactgtgaatgagatggaggatgatgaagatgatgaggagatgtctgacagcaacagcccccccatcccctacagccagaagccagcccctgagggcagctgcaccacagatggcttctgccaggccggcaaggacctgcggctggtgtccctgtgcatggagcagattgacatcccagctggcttcctgctggtgggcgccaagagccccaacctgcctgagcacatcctggtgtgtgctgtggacaagcgcttcctgcctgatgaccacggcaagaatgccctgctgggcttcagcggcaactgcatcggctgtggggagcggggcttccgctacttcacagagttcagcaaccacatcaacctgaagctgaccacccagcccaagaagcagaagcacctgaagtactacctggtgcgcagcagccagggcgtgctgagcaagggccccctcatctgctggaaggaatgtcgcagccggcagagcagcgccagctgccacagcatcaagcccagcagctctgtgagcagcacagtgaccccagaaaatggcaccaccaacggctacaagagcggcttcacccagacagatgctgccaatggaaacagcagccacggcggcaaaggaagtgccagcagcagcaccccagcccacacaggcaactacagcctgagcccccggcccagctatgccagcggggaccaggccaccatgttcatcagcggcccccccaagaagaggcaccggggctggtacccaggcagccccctgccccagcccggcctggtggtgcctgtgcccaccgtgcggcccctgagcaggacagagcccctgctgagcgcccctgtgccccagacccccctgaccggcatcctgcagccccggcccatcccagctggggagaccgtgattgtgcctgagaacctgctgagcaacagcggcgtgcggcctgtgatcctgattggctacggcaccctgccctacttctatggaaatgtgggggacatcgtggtgagccccctgctggtgaactgctacaagatcccccagctggagaacaaggacctggagaagctgggcctgaccggcagccagttcctgtctgtggagaacatgatcctgctgaccatccagtacctggtgcggctgggccctgaccaggtgcccctgcgggaggagtttgagcagatcatgctgaaggccatgcaggagttcaccctgcgggagcgggccctgcagattggagcccagtgtgtgcctgtgtccccaggccagctgccctggctggcccggctcatcgcctctgtgtcccaggacctggtgcacgtggtggtgacccagaacagcctggccgagggcatcagcgagaccctgcggaccctgtctgagatgaggcactaccagaggctgcctgactatgtggtggtgatctgtgccagcaagatcagaggaaatgagttctgtgtggtggtgctgggccagcaccagagccgggccctggccgagagcatgctgaccaccagcgagttcctgaaggagatctcctatgagctgatcaccgggaaggtgtccttcctggccagccacttcaagaccaccagcctgggagatgacctggacaagctgctggagaagatgcagcagaggagaggagacagcgtggtgaccccatttgatggagacctgaatgaatgtgtgagcccccaggaggccgccgccatgatccccacccagaacctggacctggacaatgagaccttccacatctaccagccccagctgactgtggccaggaagctgctgagccaggtgtgtgccatcgctgacagcggcagccagagcctggacctgggccacttcagcaaggtggacttcatcatcatcgtgcccaggtctgaggtgctggtgcagcagaccctgcagaggatccggcagagcggcagcagccctggcagccacatcgccttctcctatgtgctcttcatcagctgcaacctgtag

SEQ ID NO: 34668 - DNA, 531 bp, Artificial Sequence
  Description of Artificial Sequence: Synthetic coding sequence
atgtgcctggagctgttccacagcagcaatgtgattgatggcctgaagctgaatgcctttgctgctgtgttcaccgtgctgagcggcctgctgggcatggtggcccacatgatgtacacccaggtgttccaggtgacagtgtccctgggccctgaggactggaggccccacagctgggactatggctggagcttctgcctggcctggggcagcttcacctgctgcatggccgcctctgtgaccaccctgaacagctacaccaagacagtgattgagttccgccacaagaggaaggtgtttgagcagggctaccgggaggagcccaccttcattgatcctgaggccatcaagtacttccgggagaggatggagaagagagatggcagcgaggaggacttccacctggactgcagacatgagcgctacccagcccggcaccagccccacatggctgacagctggcccaggagcagcgcccaggaggcccctgagctgaaccggcagtgctgggtgctgggccactgggtgtag

SEQ ID NO: 34669 - DNA, 585 bp, Artificial Sequence
  Description of Artificial Sequence: Synthetic coding sequence
atgtgcctggagctgttccacagcagcaatgtgattgatggcctgaagctgaatgcctttgctgctgtgttcaccgtgctgagcggcctgctgggcatggtggcccacatgatgtacacccaggtgttccaggtgacagtgtccctgggccctgaggactggaggccccacagctgggactatggctggagcttctgcctggcctggggcagcttcacctgctgcatggccgcctctgtgaccaccctgaacagctacaccaagacagtgattgagttccgccacaagaggaaggtgtttgagcagggctaccgggaggagcccaccttcattgatcctgaggccatcaagtacttccgggagcgctggcagatcgaggcccagaggggccgggccacctgccccaggagccacagctggatggagaagagagatggcagcgaggaggacttccacctggactgcagacatgagcgctacccagcccggcaccagccccacatggctgacagctggcccaggagcagcgcccaggaggcccctgagctgaaccggcagtgctgggtgctgggccactgggtgtag

SEQ ID NO: 34670 - DNA, 843 bp, Artificial Sequence
  Description of Artificial Sequence: Synthetic coding sequence
atgaagaccagcagaagaggccgggccctgctggccgtggccctgaacctgctggccctgctgtttgccaccacagccttcctgaccacccactggtgccagggcacccagagggtgcccaagccaggctgcggccagggcggccgggccaactgccccaacagcggggccaatgccacagccaacggcacagctgccccagctgctgctgctgctgctgccacagccagcggaaatggacctcctgggggcgccctgtacagctgggagactggagatgaccgcttcctgttcaggaacttccacacaggcatctggtacagctgtgaggaggagctgagcggcctgggggagaagtgccgctccttcatcgacctggccccagccagcgagaagggcctgctgggcatggtggcccacatgatgtacacccaggtgttccaggtgacagtgtccctgggccctgaggactggaggccccacagctgggactatggctggagcttctgcctggcctggggcagcttcacctgctgcatggccgcctctgtgaccaccctgaacagctacaccaagacagtgattgagttccgccacaagaggaaggtgtttgagcagggctaccgggaggagcccaccttcattgatcctgaggccatcaagtacttccgggagaggatggagaagagagatggcagcgaggaggacttccacctggactgcagacatgagcgctacccagcccggcaccagccccacatggctgacagctggcccaggagcagcgcccaggaggcccctgagctgaaccggcagtgctgggtgctgggccactgggtgtag

SEQ ID NO: 34671 - DNA, 996 bp, Artificial Sequence
  Description of Artificial Sequence: Synthetic coding sequence
atgaagaccagcagaagaggccgggccctgctggccgtggccctgaacctgctggccctgctgtttgccaccacagccttcctgaccacccactggtgccagggcacccagagggtgcccaagccaggctgcggccagggcggccgggccaactgccccaacagcggggccaatgccacagccaacggcacagctgccccagctgctgctgctgctgctgccacagccagcggaaatggacctcctgggggcgccctgtacagctgggagactggagatgaccgcttcctgttcaggaacttccacacaggcatctggtacagctgtgaggaggagctgagcggcctgggggagaagtgccgctccttcatcgacctggccccagccagcgagaagggcgtgctgtggctgtctgtggtgtctgaggtgctgtacatcctgctgctggtggtgggcttcagcctgatgtgcctggagctgttccacagcagcaatgtgattgatggcctgaagctgaatgcctttgctgctgtgttcaccgtgctgagcggcctgctgggcatggtggcccacatgatgtacacccaggtgttccaggtgacagtgtccctgggccctgaggactggaggccccacagctgggactatggctggagcttctgcctggcctggggcagcttcacctgctgcatggccgcctctgtgaccaccctgaacagctacaccaagacagtcatcgagttccgccacaagaggaaggtgtttgagcagggctaccgggaggagcccaccttcatcgaccctgaggccatcaagtacttccgggagaggatggagaagagagatggcagcgaggaggacttccacctggactgcagacatgagcgctacccagcccggcaccagccccacatggctgacagctggcccaggagcagcgcccaggaggcccctgagctgaaccggcagtgctgggtgctgggccactgggtgtag

SEQ ID NO: 34672 - DNA, 1479 bp, Artificial Sequence
  Description of Artificial Sequence: Synthetic coding sequence
atgtggaggggcctgtggaccctggccgcccaggccgcccggggcccccggcggctgtgcacccggcgcagcagcggggccccagcccctggcagcggggccaccatctttgccctgagcagcggccagggccgctgtggcattgctgtgatccgcaccagcggccctgccagcggccacgccctgcgcatcctgacagccccccgggacctgcccctggcccggcatgccagcctgcggctgctgagtgaccccaggtctggagagcccctggaccgggccctggtgctgtggttccctggcccccagagcttcaccggggaggactgtgtggagttccacgtgcacggcggccctgctgtggtgtctggagtgctgcaggccctgggctctgtgcccggcctgcggcctgctgaggccggggagttcacccggcgggcctttgccaacgggaagctgaacctgacagaggtggagggcctggccgacctgattcatgctgagacagaggcccagaggcggcaggccctgcggcagctggatggagagctgggccacctgtgccggggctgggccgagaccctgaccaaggccctggcccacgtggaggcctacatcgactttggagaagatgacaacctggaggagggcgtgctggagcaggccgacatcgaggtgcgggccctgcaggtggccctgggcgcccacctgagagatgcccggcggggccagaggctgcggtctggagtgcacgtggtggtgactggacctccaaatgctgggaagagcagcctggtgaacctgctgagcaggaagcctgtgtccatcgtgtccccagagcccggcaccaccagagatgtgctggagacccctgtggacctggccggcttccctgtgctgctgagtgacacagctggcctgcgggagggcgtgggccctgtggagcaggagggcgtgcggcgggcccgggagcggctggagcaggccgacctgatcctggccatgctggatgccagtgacctggccagccccagcagctgcaacttcctggccaccgtggtggcctctgtgggcgcccagagccccagcgacagcagccagaggctgctgctggtgctgaacaagagtgacctgctgagccctgagggccctggccctggccctgacctgcccccccacctgctgctgagctgcctgaccggggagggcctggatggcctgctggaggccctgaggaaggagctggccgctgtgtgtggggaccccagcacagacccccccctgctgacccgggcccggcaccagcaccacctgcagggctgcctggatgccctgggccactacaagcagagcaaggacctggccctggccgctgaggccctgcgggtggcccggggccacctgacccggctgaccggcggcggcggcacagaggagatcctggacatcatcttccaggacttctgtgtgggcaagtag

SEQ ID NO: 34673 - DNA, 1575 bp, Artificial Sequence
  Description of Artificial Sequence: Synthetic coding sequence
atgtggaggggcctgtggaccctggccgcccaggccgcccggggcccccggcggctgtgcacccggcgcagcagcggggccccagcccctggcagcggggccaccatctttgccctgagcagcggccagggccgctgtggcattgctgtgatccgcaccagcggccctgccagcggccacgccctgcgcatcctgacagccccccgggacctgcccctggcccggcatgccagcctgcggctgctgagtgaccccaggtctggagagcccctggaccgggccctggtgctgtggttccctggcccccagagcttcaccggggaggactgtgtggagttccacgtgcacggcggccctgctgtggtgtctggagtgctgcaggccctgggctctgtgcccggcctgcggcctgctgaggccggggagttcacccggcgggcctttgccaacgggaagctgaacctgacagaggtggagggcctggccgacctgattcatgctgagacagaggcccagaggcggcaggccctgcggcagctggatggagagctgggccacctgtgccggggctgggccgagaccctgaccaaggccctggcccacgtggaggcctacatcgactttggagaagatgacaacctggaggagggcgtgctggagcagggcggcagcacctggtggtggggcaggaagaccccccacatcagcccccagaggctgcccagcctgagcctgagcgcctgcctgctgagccccacagctgacatcgaggtgcgggccctgcaggtggccctgggcgcccacctgagagatgcccggcggggccagaggctgcggtctggagtgcacgtggtggtgactggacctccaaatgctgggaagagcagcctggtgaacctgctgagcaggaagcctgtgtccatcgtgtccccagagcccggcaccaccagagatgtgctggagacccctgtggacctggccggcttccctgtgctgctgagtgacacagctggcctgcgggagggcgtgggccctgtggagcaggagggcgtgcggcgggcccgggagcggctggagcaggccgacctgatcctggccatgctggatgccagtgacctggccagccccagcagctgcaacttcctggccaccgtggtggcctctgtgggcgcccagagccccagcgacagcagccagaggctgctgctggtgctgaacaagagtgacctgctgagccctgagggccctggccctggccctgacctgcccccccacctgctgctgagctgcctgaccggggagggcctggatggcctgctggaggccctgaggaaggagctggccgctgtgtgtggggaccccagcacagacccccccctgctgacccgggcccggcaccagcaccacctgcagggctgcctggatgccctgggccactacaagcagagcaaggacctggccctggccgctgaggccctgcgggtggcccggggccacctgacccggctgaccggcggcggcggcacagaggagatcctggacatcatcttccaggacttctgtgtgggcaagtag

SEQ ID NO: 34674 - DNA, 1545 bp, Artificial Sequence
  Description of Artificial Sequence: Synthetic coding sequence
atggtgcacagccccacctgcccccacccctgcttcctgctggtgcctgccagcgagccccagttcccccacctgcagaccccagaccctggagatgctgtgtggaatgtgcgctgggccctgtgcacccggcgcagcagcggggccccagcccctggcagcggggccaccatctttgccctgagcagcggccagggccgctgtggcattgctgtgatccgcaccagcggccctgccagcggccacgccctgcgcatcctgacagccccccgggacctgcccctggcccggcatgccagcctgcggctgctgagtgaccccaggtctggagagcccctggaccgggccctggtgctgtggttccctggcccccagagcttcaccggggaggactgtgtggagttccacgtgcacggcggccctgctgtggtgtctggagtgctgcaggccctgggctctgtgcccggcctgcggcctgctgaggccggggagttcacccggcgggcctttgccaacgggaagctgaacctgacagaggtggagggcctggccgacctgattcatgctgagacagaggcccagaggcggcaggccctgcggcagctggatggagagctgggccacctgtgccggggctgggccgagaccctgaccaaggccctggcccacgtggaggcctacatcgactttggagaagatgacaacctggaggagggcgtgctggagcaggccgacatcgaggtgcgggccctgcaggtggccctgggcgcccacctgagagatgcccggcggggccagaggctgcggtctggagtgcacgtggtggtgactggacctccaaatgctgggaagagcagcctggtgaacctgctgagcaggaagcctgtgtccatcgtgtccccagagcccggcaccaccagagatgtgctggagacccctgtggacctggccggcttccctgtgctgctgagtgacacagctggcctgcgggagggcgtgggccctgtggagcaggagggcgtgcggcgggcccgggagcggctggagcaggccgacctgatcctggccatgctggatgccagtgacctggccagccccagcagctgcaacttcctggccaccgtggtggcctctgtgggcgcccagagccccagcgacagcagccagaggctgctgctggtgctgaacaagagtgacctgctgagccctgagggccctggccctggccctgacctgcccccccacctgctgctgagctgcctgaccggggagggcctggatggcctgctggaggccctgaggaaggagctggccgctgtgtgtggggaccccagcacagacccccccctgctgacccgggcccggcaccagcaccacctgcagggctgcctggatgccctgggccactacaagcagagcaaggacctggccctggccgctgaggccctgcgggtggcccggggccacctgacccggctgaccggcggcggcggcacagaggagatcctggacatcatcttccaggacttctgtgtgggcaagtag

SEQ ID NO: 34675 - DNA, 456 bp, Artificial Sequence
  Description of Artificial Sequence: Synthetic coding sequence
atgtggaggggcctgtggaccctggccgcccaggccgcccggggcccccggcggctgtgcacccggcgcagcagcggggccccagcccctggcagcggggccaccatctttgccctgagcagcggccagggccgctgtggcattgctgtgatccgcaccagcggccctgccagcggccacgccctgcgcatcctgacagccccccgggacctgcccctggcccggcatgccagcctgcggctgctgagtgaccccaggtctggagagcccctggaccgggccctggtgctgtggttccctggcccccagagcttcaccggggaggactgtgtggagttccacgtgcacggcggccctgctgtggtgtctggagtgctgcaggccctgggctctgtgcccggcctgcggcctgctgagcccggggccggccggggcagcgcccagggctgcacctag

SEQ ID NO: 34676 - DNA, 1416 bp, Artificial Sequence
  Description of Artificial Sequence: Synthetic coding sequence
atgtggaggggcctgtggaccctggccgcccaggccgcccggggcccccggcggctgtgcacccggcgcagcagcggggccccagcccctggcagcggggccaccatctttgccctgagcagcggccagggccgctgtggcattgctgtgatccgcaccagcggccctgccagcggccacgccctgcgcatcctgacagccccccgggacctgcccctggcccggcatgccagcctgcggctgctgagtgaccccaggtctggagagcccctggaccgggccctggtgctgtggttccctggcccccagagcttcaccggggaggactgtgtggagttccacgtgcacggcggccctgctgtggtgtctggagtgctgcaggccctgggctctgtgcccggcctgcggcctgctgaggccggggagttcacccggcgggcctttgccaacgggaagctgaacctgacagaggtggagggcctggccgacctgattcatgctgagacagaggcccagaggcggcaggccctgcggcagctggatggagagctgggccacctgtgccggggctgggccgagaccctgaccaaggccctggcccacgtggaggcctacatcgactttggagaagatgacaacctggaggagggcgtgctggagcaggccgacatcgaggtgcgggccctgcaggtggccctgggcgcccacctgagagatgcccggcggggccagaggctgcggtctggagtgcacgtggtggtgactggacctccaaatgctgggaagagcagcctggtgaacctgctgagcaggaagcctgtgtccatcgtgtccccagagcccggcaccaccagagatgtgctggagacccctgtggacctggccggcttccctgtgctgctgagtgacacagctggcctgcgggagggcgtgggccctgtggagcaggagggcgtgcggcgggcccgggagagctgcaacttcctggccaccgtggtggcctctgtgggcgcccagagccccagcgacagcagccagaggctgctgctggtgctgaacaagagtgacctgctgagccctgagggccctggccctggccctgacctgcccccccacctgctgctgagctgcctgactggagagggcctggatggcctgctggaggccctgaggaaggagctggccgctgtgtgtggggaccccagcacagatcctcccctgctgacccgggcccggcaccagcaccacctgcagggctgcctggatgccctgggccactacaagcagagcaaggacctggccctggccgctgaggccctgcgggtggcccggggccacctgacccggctgactggaggcggcggcacagaggagatcctggacatcatcttccaggacttctgtgtgggcaagtag

SEQ ID NO: 34677 - DNA, 423 bp, Artificial Sequence
  Description of Artificial Sequence: Synthetic coding sequence
atgaggaaggtgaagttcacccagcagaactaccatgaccggctgagccagatcctgacagacttccccaagctggatgacatccaccccttctatgctgacctgatgaacatcctgtatgacaaggaccactacaagctggccctgggccagatcaacatcgccaagaacctggtggacaacgtggccaaggactatgtgcggctgatgaagtacggggacagcctgtaccgctgcaagcagctgaagagagctgccctgggccgcatgtgcaccgtcatcaagaggcagaagcagagcctggagtacctggagcaggtgcggcagcacctgagccggctgcccaccatcgaccccaacaccaggaccctgctgctgtgtggctacccaaatgtgggcaagagcagcttcatcaacaagtag

SEQ ID NO: 34678 - DNA, 1905 bp, Artificial Sequence
  Description of Artificial Sequence: Synthetic coding sequence
atggcccactacaacttcaagaagatcaccgtggtgcccagcgccaaggacttcatcgacctgaccctgagcaagacccagaggaagacccccaccgtcatccacaagcactaccagatccaccgcatccgccacttctacatgaggaaggtgaagttcacccagcagaactaccatgaccggctgagccagatcctgacagacttccccaagctggatgacatccaccccttctacgccgacctgatgaacatcctgtatgacaaggaccactacaagctggccctgggccagatcaacatcgccaagaacctggtggacaacgtggccaaggactatgtgcggctgatgaagtatggagacagcctgtaccgctgcaagcagctgaagagagctgccctgggccgcatgtgcaccgtcatcaagaggcagaagcagagcctggagtacctggagcaggtgcggcagcacctgagccggctgcccaccatcgaccccaacaccaggaccctgctgctgtgtggctaccccaacgtgggcaagagcagcttcatcaacaaggtgaccagggcagatgtggatgtgcagccctatgccttcaccaccaagagcctgtttgtgggccacatggactacaagtacctgcgctggcaggtggtggacaccccaggcatcctggaccaccccctggaggacaggaacaccatcgagatgcaggccatcacagccctggcccacctgcgggctgctgtgctgtatgtgatggacctgtctgagcagtgtggccacggcctgcgggagcagctggagctgttccagaacatccggcccctcttcatcaacaagcccctgattgtggtggccaacaagtgtgatgtgaagagaattgctgagctgtctgaagatgaccagaagatcttcacagacctgcagagcgagggcttccctgtgattgagaccagcaccctgacagaggagggcgtcatcaaggtgaagacagaggcctgtgaccggctgctggcccaccgggtggagaccaagatgaagggcaacaaggtgaatgaggtgctgaaccggctgcacctggccatccccaccaggagagatgacaaggagcggccccccttcatccctgagggcgtggtggcccggaggaagaggatggagacagaggagagcaggaagaagcgggagcgggacctggagctggagatgggagatgactacatcctggacctgcagaagtactgggacctgatgaacctgtctgagaagcatgacaagatccctgagatctgggagggccacaacattgctgactacatcgaccctgccatcatgaagaagctggaggagctggagaaggaggaggagctgaggacagctgctggggagtatgacagcgtgtctgagagtgaagatgaggagatgctggagatccggcagctggccaagcagatccgggagaagaagaagctgaagatcctggagagcaaggagaagaacacccagggccccaggatgcccaggacagccaagaaggtgcagaggacagtgctggagaaggagatgaggagcctgggcgtggacatggatgacaaggatgatgcccactatgctgtgcaggcccggcgcagccgcagcatcaccaggaagaggaagcgggaggacagcgccccacccagctctgtggcccggagcggcagctgcagcaggaccccaagagatgtgtctggcctgagagatgtgaagatggtgaagaaggccaagaccatgatgaagaatgcccagaagaagatgaaccggctgggcaagaagggggaggccgacagacatgtgtttgacatgaagcccaagcacctgctgagcggcaagaggaaggccggcaagaaggacagaagatag

SEQ ID NO: 34679 - DNA, 1557 bp, Artificial Sequence
  Description of Artificial Sequence: Synthetic coding sequence
atgaagtatggagacagcctgtaccgctgcaagcagctgaagagagctgccctgggccgcatgtgcaccgtcatcaagaggcagaagcagagcctggagtacctggagcaggtgcggcagcacctgagccggctgcccaccatcgaccccaacaccaggaccctgctgctgtgtggctaccccaacgtgggcaagagcagcttcatcaacaaggtgaccagggcagatgtggatgtgcagccctatgccttcaccaccaagagcctgtttgtgggccacatggactacaagtacctgcgctggcaggtggtggacaccccaggcatcctggaccaccccctggaggacaggaacaccatcgagatgcaggccatcacagccctggcccacctgcgggctgctgtgctgtatgtgatggacctgtctgagcagtgtggccacggcctgcgggagcagctggagctgttccagaacatccggcccctcttcatcaacaagcccctgattgtggtggccaacaagtgtgatgtgaagagaattgctgagctgtctgaagatgaccagaagatcttcacagacctgcagagcgagggcttccctgtgattgagaccagcaccctgacagaggagggcgtcatcaaggtgaagacagaggcctgtgaccggctgctggcccaccgggtggagaccaagatgaagggcaacaaggtgaatgaggtgctgaaccggctgcacctggccatccccaccaggagagatgacaaggagcggccccccttcatccctgagggcgtggtggcccggaggaagaggatggagacagaggagagcaggaagaagcgggagcgggacctggagctggagatgggagatgactacatcctggacctgcagaagtactgggacctgatgaacctgtctgagaagcatgacaagatccctgagatctgggagggccacaacattgctgactacatcgaccctgccatcatgaagaagctggaggagctggagaaggaggaggagctgaggacagctgctggggagtatgacagcgtgtctgagagtgaagatgaggagatgctggagatccggcagctggccaagcagatccgggagaagaagaagctgaagatcctggagagcaaggagaagaacacccagggccccaggatgcccaggacagccaagaaggtgcagaggacagtgctggagaaggagatgaggagcctgggcgtggacatggatgacaaggatgatgcccactatgctgtgcaggcccggcgcagccgcagcatcaccaggaagaggaagcgggaggacagcgccccacccagctctgtggcccggagcggcagctgcagcaggaccccaagagatgtgtctggcctgagagatgtgaagatggtgaagaaggccaagaccatgatgaagaatgcccagaagaagatgaaccggctgggcaagaagggggaggccgacagacatgtgtttgacatgaagcccaagcacctgctgagcggcaagaggaaggccggcaagaaggacagaagatag

SEQ ID NO: 34680 - DNA, 1764 bp, Artificial Sequence
  Description of Artificial Sequence: Synthetic coding sequence
atgaggaaggtgaagttcacccagcagaactaccatgaccggctgagccagatcctgacagacttccccaagctggatgacatccaccccttctatgctgacctgatgaacatcctgtatgacaaggaccactacaagctggccctgggccagatcaacatcgccaagaacctggtggacaacgtggccaaggactatgtgcggctgatgaagtacggggacagcctgtaccgctgcaagcagctgaagagagctgccctgggccgcatgtgcaccgtcatcaagaggcagaagcagagcctggagtacctggagcaggtgcggcagcacctgagccggctgcccaccatcgaccccaacaccaggaccctgctgctgtgtggctacccaaatgtgggcaagagcagcttcatcaacaaggtgaccagggcagatgtggatgtgcagccctatgccttcaccaccaagagcctgtttgtgggccacatggactacaagtacctgcgctggcaggtggtggacaccccaggcatcctggaccaccccctggaggacaggaacaccatcgagatgcaggccatcacagccctggcccacctgcgggctgctgtgctgtatgtgatggacctgtctgagcagtgtggccacggcctgcgggagcagctggagctgttccagaacatccggcccctcttcatcaacaagcccctcatcgtggtggccaacaagtgtgatgtgaagagaattgctgagctgtctgaagatgaccagaagatcttcacagacctgcagagcgagggcttccctgtgattgagaccagcaccctgacagaggagggcgtcatcaaggtgaagacagaggcctgtgaccggctgctggcccaccgggtggagaccaagatgaagggcaacaaggtgaatgaggtgctgaaccggctgcacctggccatccccaccaggagagatgacaaggagaggcctcccttcatccctgagggcgtggtggcccggaggaagaggatggagacagaggagagcaggaagaagcgggagcgggacctggagctggagatgggagatgactacatcctggacctgcagaagtactgggacctgatgaacctgtctgagaagcatgacaagatccctgagatctgggagggccacaacattgctgactacattgatcctgccatcatgaagaagctggaggagctggagaaggaggaggagctgaggacagctgctggggagtatgattctgtgtctgagagtgaagatgaggagatgctggagatccggcagctggccaagcagatccgggagaagaagaagctgaagatcctggagagcaaggagaagaacacccagggccccaggatgcccaggacagccaagaaggtgcagaggacagtgctggagaaggagatgaggagcctgggcgtggacatggatgacaaggatgatgcccactatgctgtgcaggcccggcgcagccgcagcatcaccaggaagaggaagagagaagattctgccccacccagctctgtggcccggagcggcagctgcagcaggaccccaagagatgtgtctggcctgagagatgtgaagatggtgaagaaggccaagaccatgatgaagaatgcccagaagaagatgaaccggctgggcaagaagggggaggccgacagacatgtgtttgacatgaagcccaagcacctgctgagcggcaagaggaaggccggcaagaaggacagaagatag

SEQ ID NO: 34681 - DNA, 1998 bp, Artificial Sequence
  Description of Artificial Sequence: Synthetic coding sequence
atgtctgagcagagctgccagatgtctgagctgcggctgctgctgctgggcaagtgccgcagcggcaagagcgccactggaaatgccatcctgggcaagcacgtgttcaagagcaagttcagtgaccagaccgtcatcaagatgtgccagcgggagagctgggtgctgcgggagaggaaggtggtggtgattgacaccccagacctcttcagcagcatcgcctgtgccgaggacaagcagaggaacatccagcactgcctggagctgagcgcccccagcctgcacgccctgctgctggtgattgccatcggccacttcaccagagaagatgaggagacagccaagggcatccagcaggtgtttggagctgaggcccggcggcacatcatcatcgtgttcaccaggaaggatgacctgggagatgacctgctgcaggacttcatcgagaagaacaagcccctgaagcagctggtgcaggactatgagggccgctactgcatcttcaacaacaagaccaacagcaaggatgagcagatcacccaggtgctggagctgctgaggaaggtggagagcctggtgaacaccaacggcggcccctaccacgtgaacttcaagacagagggcagccgcttccaggactgtgtgaatgaggccgccagccaggagggggacaagccccagggcccccgggagcggcagctgcagagcactggacctgagcagaaccctggcaccagcgagctgactgtgctgctggtgggcaagagaggagctgggaagtctgctgctggcaacagcatcctgggccggcaggccttccagacaggcttcagcgagcagagcgtgacccagagcttcctgtctgagagccgctcctggaggaagaagaaggtgtccatcattgatgccccagacatcagcagcctgaagaacatcgacagcgaggtgaggaagcacatctgcaccggcccccacgccttcctgctggtgacccccctgggcttctacaccaagaatgatgaggccgtgctgagcaccatccagaacaactttggagagaagttctttgagtacatgatcatcctgctgaccaggaaagaagacctgggggaccaggacctggacaccttcctgaggaacagcaacaaggccctgtatggcctcatccagaagtgcaagaaccgctacagcgccttcaactaccgggccaccggggaggaggagcagaggcaggctgatgagctgctggagaagattgaatccatggtgcaccagaatggaaacaagcactgtgtgttccgggagaaggagaccctgaacatcgtgctggtgggccgctctggaacaggcaagagcgccaccggcaacagcatcctgggcagcctggtgttcaccagccggctgcgggcccagcctgtgaccaagaccagccagagcggccgccgcacctgggatggccaggaggtggtggtggtggacacccccagcttcaaccagatgctggatgtggagaaggaccccagccggctggaggaggaggtgaagcgctgcctgagctgctgtgagaagggggacaccttctttgtgctggtgttccagctgggccgcttcacagaggaggacaagacagctgtggccaagctggaggccatctttggagctgacttcaccaagtatgccatcatgctgttcaccaggaaggaggacctgggcgccggcaacctggaggacttcatgaagaacagcgacaacaaggccctgcggcgcatcttcaagaagtgtggccggcgggtgtgtgccttcaacaacaaggagaccggccaggcccaggagacccaggtgaaggccctgctgaccaaggtgaatgacctgaggaaggagagcggctggagcggctacccccacacccaggagaatgtgtccaagctgatcaagaatgtgcaggagatgagccaggccgagaagctgctgaagaacctgattggcatcctgcagtag

SEQ ID NO: 34682 - DNA, 924 bp, Artificial Sequence
  Description of Artificial Sequence: Synthetic coding sequence
atggccgcccctggcctgcggctgggcgccggccgcctgtttgagatgcctgctgtgctggagcggctgagccgctacaacagcaccagccaggcctttgctgaggtgctgcggctgcccaagcagcagctgaggaagctgctgtaccccctgcaggaggtggagcgcttcctggccccctacggccggcaggacctgcacctgcgcatctttgaccccagccctgaggacatcgcccgggctgacaacatcttcaccgccacagagaggaacagaattgattatgtgagcagcgctgtgagaattgaccacgccccagacctgcccaggcctgaggtgcggggggacagcacagtgcacctgcgggccggcgtgacagccctgcccctgcccggccggcctgcccggggcgtcttctaccggcagagcaatgtgggcaagagcagcctcatcaagctgtacttccactggcccctgcggctgaagtctgagagccccaagaaccaggacacccaggagaatgagttcttcaaggtgggcaagcacttcaccgtggtggacatgcctggctacggcttccgggccccagaagattttgtggacatggtggagacctacctgaaggagaggaggaacctgaagaggaccttcctgctggtggacagcgtggtgggcatccagaagacagacaacatcgccatcgagatgtgtgaggagtttgccctgccctacgtgattgtgctgaccaagattgacaagagcagcaagggccacctgctgaagcaggtgctgcagatccagaagtttgtgaacatgaagacccagggctgcttcccccagctgtttcctgtgtctgctgtgaccttcagcggcatccacctgctgcgctgcttcatcgcctctgtgacaggcagcctggactag

SEQ ID NO: 34683 - DNA, 756 bp, Artificial Sequence
  Description of Artificial Sequence: Synthetic coding sequence
atggccgcccctggcctgcggctgggcgccggccgcctgtttgagatgcctgctgtgctggagcggctgagccgctacaacagcaccagccaggcctttgctgaggtgctgcggctgcccaagcagcagctgaggaagctgctgtaccccctgcaggaggtggagcgcttcctggccccctacggccggcaggacctgcacctgcgcatctttgaccccagccctgaggacatcgcccgggctgacaacatcttcaccgccacagagaggaacagaattgattatgtgagcagcgctgtgagaattgaccacgccccagacctgcccaggcctgagggccacaccaagaagatgaacttcttcaaggtgggcaagcacttcaccgtggtggacatgcctggctacggcttccgggccccagaagattttgtggacatggtggagacctacctgaaggagaggaggaacctgaagaggaccttcctgctggtggacagcgtggtgggcatccagaagacagacaacatcgccatcgagatgtgtgaggagtttgccctgccctacgtgattgtgctgaccaagattgacaagagcagcaagggccacctgctgaagcaggtgctgcagatccagaagtttgtgaacatgaagacccagggctgcttcccccagctgtttcctgtgtctgctgtgaccttcagcggcatccacctgctgcgctgcttcatcgcctctgtgacaggcagcctggactag

SEQ ID NO: 34684 - DNA, 855 bp, Artificial Sequence
  Description of Artificial Sequence: Synthetic coding sequence
atggccgcccctggcctgcggctgggcgccggccgcctgtttgagatgcctgctgtgctggagcggctgagccgctacaacagcaccagccaggcctttgctgaggtgctgcggctgcccaagcagcagctgaggaagctgctgtaccccctgcaggaggtggagcgcttcctggccccctacggccggcaggacctgcacctgcgcatctttgaccccagccctgaggacatcgcccgggctgacaacatcttcaccgccacagagaggaacagaattgattatgtgagcagcgctgtgagaattgaccacgccccagacctgcccaggcctgaggtgtgcttcatcggccgcagcaatgtgggcaagagcagcctcatcaaggccctcttcagcctggcccctgaggtggaggtgcgggtgtccaagaagccaggccacaccaagaagatgaacttcttcaaggtgggcaagcacttcaccgtggtggacatgcctggctacggcttccgggcccctgaggactttgtggacatggtggagacctacctgaaggagaggaggaacctgaagaggaccttcctgctggtggacagcgtggtgggcatccagaagacagacaacatcgccatcgagatgtgtgaggagtttgccctgccctacgtgattgtgctgaccaagattgacaagagcagcaagggccacctgctgaagcaggtgctgcagatccagaagtttgtgaacatgaagacccagggctgcttcccccagctgtttcctgtgtctgctgtgaccttcagcggcatccacctgctgcgctgcttcatcgcctctgtgacaggcagcctggactag

SEQ ID NO: 34685 - DNA, 522 bp, Artificial Sequence
  Description of Artificial Sequence: Synthetic coding sequence
atggtgtgcttcatcggccgcagcaatgtgggcaagagcagcctcatcaaggccctcttcagcctggcccctgaggtggaggtgcgggtgtccaagaagccaggccacaccaagaagatgaacttcttcaaggtgggcaagcacttcaccgtggtggacatgcctggctacggcttccgggccccagaagattttgtggacatggtggagacctacctgaaggagaggaggaacctgaagaggaccttcctgctggtggacagcgtggtgggcatccagaagacagacaacatcgccatcgagatgtgtgaggagtttgccctgccctacgtgattgtgctgaccaagattgacaagagcagcaagggccacctgctgaagcaggtgctgcagatccagaagtttgtgaacatgaagacccagggctgcttcccccagctgtttcctgtgtctgctgtgaccttcagcggcatccacctgctgcgctgcttcatcgcctctgtgacaggcagcctggactag

SEQ ID NO: 34686 - DNA, 405 bp, Artificial Sequence
  Description of Artificial Sequence: Synthetic coding sequence
atgaacttcttcaaggtgggcaagcacttcaccgtggtggacatgcctggctacggcttccgggcccctgaggactttgtggacatggtggagacctacctgaaggagaggaggaacctgaagaggaccttcctgctggtggacagcgtggtgggcatccagaagacagacaacatcgccatcgagatgtgtgaggagtttgccctgccctacgtgattgtgctgaccaagattgacaagagcagcaagggccacctgctgaagcaggtgctgcagatccagaagtttgtgaacatgaagacccagggctgcttcccccagctgtttcctgtgtctgctgtgaccttcagcggcatccacctgctgcgctgcttcatcgcctctgtgacaggcagcctggactag

SEQ ID NO: 34687 - DNA, 756 bp, Artificial Sequence; identical to SEQ ID NO: 34683
  Description of Artificial Sequence: Synthetic coding sequence

SEQ ID NO: 34688 - DNA, 462 bp, Artificial Sequence
  Description of Artificial Sequence: Synthetic coding sequence
atgacagagcagatgaccctgcggggcaccctgaagggccacaacggctgggtgacccagatcgccaccaccccccagttcccagacatgatcctgagcgccagccgggacaagaccatcatcatgtggaagctgaccagagatgagaccaactacggcatcccccagagggccctgcggggccacagccactttgtgtctgatgtggtgatcagcagtgatggccagtttgccctgagcggctcctgggatggcaccctgcggctgtgggacctgaccaccggcaccaccaccaggagatttgtgggccacaccaaggatgtgctgtctgtggccttcagcagtgacaaccggcagatcgtgtctggcagccgggacaagaccatcaagctgtggaacaccctgggcgtgtgcaagtacacagtgcagagccacagcgtggcccaggccggcgtgcagtag

SEQ ID NO: 34689 - DNA, 954 bp, Artificial Sequence
  Description of Artificial Sequence: Synthetic coding sequence
atgacagagcagatgaccctgcggggcaccctgaagggccacaacggctgggtgacccagatcgccaccaccccccagttcccagacatgatcctgagcgccagccgggacaagaccatcatcatgtggaagctgaccagagatgagaccaactacggcatcccccagagggccctgcggggccacagccactttgtgtctgatgtggtgatcagcagtgatggccagtttgccctgagcggctcctgggatggcaccctgcggctgtgggacctgaccaccggcaccaccaccaggagatttgtgggccacaccaaggatgtgctgtctgtggccttcagcagtgacaaccggcagatcgtgtctggcagccgggacaagaccatcaagctgtggaacaccctgggcgtgtgcaagtacacagtgcaggatgagagccacagcgagtgggtgtcctgtgtgcgcttcagccccaacagcagcaaccccatcatcgtgtcctgtggctgggacaagctggtgaaggtgtggaacctggccaactgcaagctgaagaccaaccacatcggccacacaggctacctgaacacagtgacagtgtccccagatggcagcctgtgtgccagcggcggcaaggatggccaggccatgctgtgggacctgaatgaaggcaagcacctgtacaccctggatggaggagacatcatcaatgccctgtgcttcagccccaaccgctactggctgtgtgccgccaccggccccagcatcaagatctgggacctggagggcaagatcatcgtggatgagctgaagcaggaggtgatcagcaccagcagcaaggccgagcccccccagtgcaccagcctggcctggagcgcagatggccagaccctgtttgctggctacacagacaacctggtgcgggtgtggcaggtgaccatcggcaccaggtag

SEQ ID NO: 34690 - DNA, 207 bp, Artificial Sequence
  Description of Artificial Sequence: Synthetic coding sequence
atgagcagcggggccagcgccagcgccctgcagaggctggtggagcagctgaagctggaggccggcgtggagcgcatcaaggtgtcccaggccgctgctgagctgcagcagtactgcatgcagaatgcctgcaaggatgccctgctggtgggcgtgcctgctggcagcaaccccttccgggagcccaggagctgtgccctgctgtag

SEQ ID NO: 34691 - DNA, 219 bp, Artificial Sequence
  Description of Artificial Sequence: Synthetic coding sequence
atgagcagcaagacagccagcaccaacaacatcgcccaggccaggagaacagtgcagcagctgcggctggaggccagcattgagcgcatcaaggtgtccaaggccagcgctgacctgatgagctactgtgaggagcacgcccggagtgaccccctgctgattggcatccccaccagcgagaaccccttcaaggacaagaagacctgcatcatcctgtag

SEQ ID NO: 34692 - DNA, 228 bp, Artificial Sequence
  Description of Artificial Sequence: Synthetic coding sequence
atgaagggggagacccctgtgaacagcaccatgagcatcggccaggccaggaagatggtggagcagctgaagattgaggccagcctgtgccgcatcaaggtgtccaaggctgctgctgacctgatgacctactgtgatgcccacgcctgtgaggaccccctcatcacccctgtgcccaccagcgagaaccccttccgggagaagaagttcttctgtgccctgctgtag

SEQ ID NO: 34693 - DNA, 228 bp, Artificial Sequence
  Description of Artificial Sequence: Synthetic coding sequence
atgaaggagggcatgagcaacaacagcaccaccagcatcagccaggccaggaaggctgtggagcagctgaagatggaggcctgcatggacagagtgaaggtgtcccaggccgctgctgacctgctggcctactgtgaggcccacgtgcgggaggaccccctcatcatccctgtgcctgccagcgagaaccccttccgggagaagaagttcttctgcaccatcctgtag

SEQ ID NO: 34694 - DNA, 228 bp, Artificial Sequence; identical to SEQ ID NO: 34693
  Description of Artificial Sequence: Synthetic coding sequence

SEQ ID NO: 34695 - DNA, 228 bp, Artificial Sequence; identical to SEQ ID NO: 34693
  Description of Artificial Sequence: Synthetic coding sequence

SEQ ID NO: 34696 - DNA, 228 bp, Artificial Sequence; identical to SEQ ID NO: 34693
  Description of Artificial Sequence: Synthetic coding sequence

SEQ ID NO: 34697 - DNA, 207 bp, Artificial Sequence
  Description of Artificial Sequence: Synthetic coding sequence
atgtctgccaccaacaacatcgcccaggccaggaagctggtggagcagctgagaattgaagctggcatcgagcgcatcaaggtgtccaaggccgccagtgacctgatgagctactgtgagcagcacgccagaaatgaccccctgctggtgggcgtgcctgccagcgagaaccccttcaaggacaagaagccctgcatcatcctgtag

SEQ ID NO: 34698 - DNA, 141 bp, Artificial Sequence
  Description of Artificial Sequence: Synthetic coding sequence
atgcctgtgatcaacatcgaggacctgacagagaaggacaagctgaagatggaggtggaccagctgaagaaggaggtgaccctggagaggatgctgatcccagcccggcacctgcagaaccagagcctgatggactactag

SEQ ID NO: 34699 - DNA, 141 bp, Artificial Sequence; identical to SEQ ID NO: 34698
  Description of Artificial Sequence: Synthetic coding sequence

SEQ ID NO: 34700 - DNA, 141 bp, Artificial Sequence; identical to SEQ ID NO: 34698
  Description of Artificial Sequence: Synthetic coding sequence

SEQ ID NO: 34701 - DNA, 1065 bp, Artificial Sequence
  Description of Artificial Sequence: Synthetic coding sequence
atgggcagcggcatcagcagcgagagcaaggagagcgccaagaggagcaaggagctggagaagaagctgcaggaggatgctgagagagatgccaggacagtgaagctgctgctgctgggcgctggggagagcggcaagagcaccatcgtgaagcagatgaagatcatccacaagaatggctacagcgagcaggagtgcatggagttcaaggctgtgatctacagcaacaccctgcagagcatcctggccatcgtgaaggccatgaccaccctgggcattgattatgtgaaccccaggtctgctgaggaccagaggcagctgtatgccatggccaacaccctggaggatggcggcatgaccccccagctggccgaggtgatcaagaggctgtggagggaccccggcatccaggcctgctttgagcgggccagcgagtaccagctgaatgattctgctgcctactacctgaatgacctggaccgcatcacagccagcggctacgtgcccaatgagcaggatgtgctgcacagccgggtgaagaccaccggcatcatcgagacccagttctccttcaaggacctgcacttcaggatgtttgatgtgggcggccagaggtctgagaggaagaagtggatccactgctttgaaggagtgacctgcatcatcttctgtgccgccctgagcgcctatgacatggtgctggtggaggatgaggaggtgaacaggatgcatgagagcctgcacctgttcaacagcatctgcaaccacaagtacttcagcaccaccagcatcgtgctcttcctgaacaagaaggacatcttccaggagaaggtgaccaaggtgcacctgagcatctgcttccctgagtacacaggccccaacacctttgaagatgctggcaactacatcaagaaccagttcctggacctgaacctgaagaaggaggacaaggagatctacagccacatgacctgtgccacagacacccagaatgtgaagtttgtgtttgatgctgtgacagacatcatcatcaaggagaacctgaaggactgtggcctcttctag

SEQ ID NO: 34702 - DNA, 1749 bp, Artificial Sequence
  Description of Artificial Sequence: Synthetic coding sequence
atgatgaagctgcggcacaagaacaagaagccaggagagggcagcaagggccacaagaagatctcctggccctacccccagcctgccaagcagaatggcaagaaggccaccagcaaggtgcccagcgccccccactttgtgcaccccaatgaccacgccaaccgggaggccgagctgaagaagaagtgggtggaggagatgagggagaagcagcaggccgcccgggagcaggagcggcagaagaggaggaccatcgagagctactgccaggatgtgctgcggcggcaggaggagtttgagcacaaggaggaggtgctgcaggagctgaacatgttcccccagctggatgatgaggccaccaggaaggcctactacaaggagttcaggaaggtggtggagtacagtgatgtgatcctggaggtgctggatgcccgggaccccctgggctgccgctgcttccagatggaggaggccgtgctgcgggcccagggcaacaagaagctggtgctggtgctgaacaagattgacctggtgcccaaggaggtggtggagaagtggctggactacctgagaaatgagctgcccaccgtggccttcaaggccagcacccagcaccaggtgaagaacctgaaccgctgcagcgtgcctgtggaccaggccagcgagagcctgctgaagagcaaggcctgctttggagctgagaacctgatgagggtgctgggcaactactgccgcctgggggaggtgaggacccacatccgggtgggcgtggtgggcctgcccaacgtgggcaagagcagcctcatcaacagcctgaagaggagccgggcctgcagcgtgggcgctgtgcccggcatcaccaagttcatgcaggaggtgtacctggacaagttcatccggctgctggatgcccctggcatcgtgcccggccccaacagcgaggtgggcaccatcctgaggaactgtgtgcacgtgcagaagctggccgaccctgtgacccctgtggagaccatcctgcagcgctgcaacctggaggagatcagcaactactatggagtgtctggcttccagaccacagagcacttcctgacagctgtggcccaccggctgggcaagaagaagaagggcggcctgtacagccaggagcaggccgccaaggctgtgctggccgactgggtgtctgggaagatctccttctacatccccccaccagccacccacaccctgcccacccacctgtctgctgagatcgtgaaggagatgacagaggtgtttgatattgaggacacagagcaggccaatgaagacaccatggagtgcctggccactggagagagtgatgagctgctgggggacacagaccccctggagatggagatcaagctgctgcacagccccatgaccaagattgctgatgccatcgagaacaagaccaccgtgtacaagattggagacctgaccggctactgcaccaaccccaacagacaccagatgggctgggccaagagaaatgtggaccaccggcccaagagcaacagcatggtggatgtgtgcagcgtggaccggcgctctgtgctgcagaggatcatggagacagaccccctgcagcagggccaggccctggccagcgccctgaagaacaagaagaagatgcagaagagagctgacaagatcgccagcaagctgagtgacagcatgatgtctgccctggacctgtctggaaatgctgatgatggagtgggggactag

SEQ ID NO: 34703 - DNA, 1749 bp, Artificial Sequence; identical to SEQ ID NO: 34702
  Description of Artificial Sequence: Synthetic coding sequence

SEQ ID NO: 34704 - DNA, 2010 bp, Artificial Sequence
  Description of Artificial Sequence: Synthetic coding sequence
atgtggaccctggtgggccggggctggggctgtgcccgggccctggccccccgggccaccggggccgccctgctggtggcccctggccccaggtctgcccccaccctgggcgccgcccctgagagctgggccacagaccggctgtacagcagcgctgagttcaaggagaagctggacatgagccgcttccctgtggagaacatccggaacttcagcatcgtggcccacgtggaccacggcaagagcaccctggccgaccggctgctggagctgaccggcaccatcgacaagaccaagaacaacaagcaggtgctggacaagctgcaggtggagcgggagcggggcatcaccgtgaaggcccagacagccagcctcttctacaactgtgagggcaagcagtacctgctgaacctgattgacaccccaggccacgtggacttctcctatgaggtgagccgcagcctgagcgcctgccagggcgtgctgctggtggtggatgccaatgaaggcatccaggcccagacagtggccaacttcttcctggcctttgaggcccagctgagcgtcatccctgtgatcaacaagattgacctgaagaatgctgaccctgagcgggtggagaaccagatcgagaaggtgtttgacatccccagtgatgagtgcatcaagatcagcgccaagctgggcaccaacgtggagagcgtgctgcaggccatcatcgagcgcatccccccacccaaggtgcacaggaagaaccccctgcgggccctggtgtttgacagcacctttgaccagtaccggggcgtcatcgccaacgtggccctgtttgatggagtggtgtccaagggggacaagatcgtgtctgcccacacccagaagacctatgaggtgaatgaggtgggcgtgctgaaccccaatgagcagcccacccacaagctgtatgccggccaggtgggctacctgattgctggcatgaaggatgtgacagaggcccagattggagacaccctgtgcctgcacaagcagcctgtggagcccctgcccggcttcaagagcgccaagcccatggtgtttgctggcatgtaccccctggaccagagcgagtacaacaacctgaagagcgccatcgagaagctgaccctgaatgacagctctgtgacagtgcaccgggacagcagcctggccctgggcgccggctggaggctgggcttcctgggcctgctgcacatggaggtgttcaaccagaggctggagcaggagtacaatgccagcgtcatcctgaccacccccaccgtgccctacaaggctgtgctgagcagcagcaagctgatcaaggagcaccgggagaaggagatcaccatcatcaacccagcccagttcccagacaagagcaaggtgacagagtacctggagcctgtggtgctgggcaccatcatcaccccagatgagtacacaggcaagatcatgatgctgtgtgaggccaggagagctgtgcagaagaacatgatcttcatcgaccagaacagagtgatgctgaagtacctgttccccctgaatgaaattgtggtggacttctatgacagcctgaagagcctgagcagcggctacgccagctttgattatgaagatgctggctaccagacagctgagctggtgaagatggacatcctgctgaatggaaacacagtggaggagctggtgacagtggtgcacaaggacaaggcccacagcatcggcaaggccatctgtgagcggctgaaggacagcctgccccggcagctgtttgaaattgccatccaggccgccatcggcagcaagatcatcgcccgggagaccgtgaaggcctacaggaagaatgtgctggccaagtgctatggaggagacatcaccaggaagatgaagctgctgaagaggcaggccgagggcaagaagaagctgaggaagattggaaatgtggaggtgcccaaggatgccttcatcaaggtgctgaagacccagagcagcaagtag

SEQ ID NO: 34705 - DNA, 756 bp, Artificial Sequence
  Description of Artificial Sequence: Synthetic coding sequence
atggcccaccggctgcagatccggctgctgacctgggatgtgaaggacaccctgctgcggctgcggcaccccctgggggaggcctatgccaccaaggcccgggcccacggcctggaggtggagcccagcgccctggagcagggcttccggcaggcctaccgggcccagagccacagcttccccaactacggcctgagccacggcctgaccagccggcagtggtggctggatgtggtgctgcagaccttccacctggccggcgtgcaggatgcccaggccgtggcccccatcgccgagcagctgtacaaggacttcagccacccctgcacctggcaggtgctggatggagctgaggacaccctgagagaatgtaggacccggggcctgcggctggccgtcatcagcaactttgaccggcggctggagggcatcctgggcggcctgggcctgcgggagcactttgattttgtgctgaccagcgaggccgccggctggcccaagccagacccccgcatcttccaggaggccctgcggctggcccacatggagcctgtggtggccgcccacgtgggggacaactacctgtgtgactaccagggccccagggctgtgggcatgcacagcttcctggtggtgggcccccaggccctggaccctgtggtgcgggacagcgtgcccaaggagcacatcctgcccagcctggcccacctgctgcctgccctggactgcctggagggcagcaccccaggcctgtag

SEQ ID NO: 34706 - DNA, 756 bp, Artificial Sequence; identical to SEQ ID NO: 34705
  Description of Artificial Sequence: Synthetic coding sequence

SEQ ID NO: 34707 - DNA, 867 bp, Artificial Sequence
  Description of Artificial Sequence: Synthetic coding sequence
atggacatcggcctgagcatcgccaacagcagcggcttccagctgtctgagttcatcctgattggcttccctggcatccacgagtggcagcactggctgagcctgcccctggccctgggcgccaacctgctgatcatcatcaccatccagcacgagaccatgctgcacgagcccatgtaccacctgctgggcatcctggccgtggtggacatcggcctggccaccaccatcatgcccaagatcctggccatcttctggtttgatgccaaggccatcagcctgcctgagtgctttgcccagatctatgccatccacagcttcatgtgcatggagagcggcatcttcctgtgcatggctgtggaccgctacatggccatctgctaccccctgcagtacaccagcatcgtgacagaggccttcgtcatcaaggccaccctgtctgtggtgctgagaaatggcctgctgaccatccctgtgcctgtgctggccgcccagaggcactactgcagcagaaatgaaattgaccagtgcctgtgcagcaacctgggcgtgaccagcctggcctgtgatgacaccaccatcaaccgcttctaccagctggccctggtgtgggtggtggtgggcagtgacatgggcctggtgtttgccagctacagcctcatcatccacagcgtgctgaagctgaacagcgccaaggccaccagcaaggccctgaacacctgcagcagccacctgatcctgatcctcttcttctacacagccatcatcgtggtgtctgtgaccacctggcaggaggagggcctgcctgccagcctcttcagctccatgtgctgcatcctgagcagcccccagcccctgaccccctag

SEQ ID NO: 34708 - DNA, 513 bp, Artificial Sequence
  Description of Artificial Sequence: Synthetic coding sequence
atggcctctgtgagcagcgccaccttcagcggccacggggcccggagcctgctgcagttcctgcggctggtgggccagctgaagagggtgcccaggacaggctgggtgtacagaaatgtgcagaggcctgagagcgtgtctgaccacatgtacaggatggctgtgatggccatggtgatcaaggatgaccggctgaacaaggaccgggaggccatgaagcagatcacccagctgctgcctgaggacctgaggaaggagctgtatgagctgtgggaggagtatgagacccagagcagcgctgaggccaagtttgtgaagcagctggaccagtgtgagatgatcctgcaggcctctgaatatgaggacctggagcacaagccaggccgcctgcaggacttctatgacagcacagctgggaagttcaaccaccctgagatcgtgcagctggtgtctgagctggaggccgagaggagcaccaacattgctgctgctgccagcgagccccacagctag

SEQ ID NO: 34709 - DNA, 615 bp, Artificial Sequence
  Description of Artificial Sequence: Synthetic coding sequence
atggcctctgtgagcagcgccaccttcagcggccacggggcccggagcctgctgcagttcctgcggctggtgggccagctgaagagggtgcccaggacaggctgggtgtacagaaatgtgcagaggcctgagagcgtgtctgaccacatgtacaggatggctgtgatggccatggtgatcaaggatgaccggctgaacaaggacagatgtgtgcggctggccctggtgcatgacatggctgaatgtattgtgggggacatcgccccagctgacaacatccccaaggaggagaagcaccggcgggaggaggaggccatgaagcagatcacccagctgctgcctgaggacctgaggaaggagctgtatgagctgtgggaggagtatgagacccagagcagcgctgaggccaagtttgtgaagcagctggaccagtgtgagatgatcctgcaggcctctgaatatgaggacctggagcacaagccaggccgcctgcaggacttctatgacagcacagctgggaagttcaaccaccctgagatcgtgcagctggtgtctgagctggaggccgagaggagcaccaacattgctgctgctgccagcgagccccacagctag

SEQ ID NO: 34710 - DNA, 3135 bp, Artificial Sequence
  Description of Artificial Sequence: Synthetic coding sequence
atggccctgagccctggggccaacctggtgttccacgaggaccccaagatgacccccagcccccccagctgtggggcccctggcctgggcagcggcaccatcccccagccccacccagacatggcccaggtgcccatgctgaacctgctgcccagccctggcctggccctggtgcctgacctgaatgacagcctgagccctgtgtctggagaggccagcggcctggtgtctgagaacacccccaggccagatgacagccgggccatcgccccagccagcctgcagatcaccagcagctgcagcggggaggccctggacctggacagcaaggatgtgtccaggccagacagccagggccgcctgtgcccagccagcaaccccatcctgagccccagcagcacagaggccccccggctgagcagcggcaaccacccccagagcaacagtgaagatgccttcaagtgcctgagcagcaagatcttcaagctgggccagaggaacagcaaccccagcagacatgagctgaaccccttcatccgccaccacagccgggagggcctggtgctgggccactgcatcagccggcccagcagcaaggccctgctgatccccaccagcaacagcagcctggacctggacagcaaccccctgctgaacatgggcagcaggaacaccagcaagctgaacctgaatgtggccccagacagccacggcaccctcatcccagacaccaatgagaccatcaccctggccagccacaacatcagcgagagcgtgtccaaaggagccttcagcaccacctggagcaccagcagcaaggagaccatgaatgtggccagcagcggccacagcagaagtgacctgtctgtgaccatcacccaggccagctatgtgaccctcatccctggcagcagctatggcatcagcctgcacagcagcacccatgagcccaacagcaccatcagcccccccagctgcatgaccctcatcctgggcagcaatgagaccctgagcctggacagcagcctgctcttcagtgacaccagcaccctgaccctgagcagccagcaggatgatgccaaggacaacagcatccacacagtgcccctggaggagaacctggagagctggagcgagatggccagcatcaaggtgggccagttccccctgggcttccccatcagcaacccagctgggaaggatgctgtgaccctgcagggcatccctgagggcgcctttgatgaggtgaccagctgcctggtgaaggtgcctgagaagacagaaggaggcaacaacatggccctggtggagaatgtgaccaccctgcagaagagccaggacctgctggaggccgagggggagaagaagaccatgatcaagaagatcatgaggcagatccaggaggagcccctggacagcctgagcagctctgtgaggaagcaggccatggagatcctgacccagctgagccacacccagcccaccctgggcatgagggagaggtctgagctggtgaatgtgtgtgtgcacagcgtcttcagcctgcccagcgtgcaggccatgcaggagaaggatgaggccaaggccgagaccatccaggccctgtaccaccagaccctggaggccctgcagaccctgctgaaggccctcttcatcgaggaccccaccccagctggcctgaagagcatcctggaggccctgggcccctggatgaacagcggcaaggcccacgagcgggcccgggctgtgaacaccaacgtgtctgtgctgaaccacatgctgctgaccctgcccttcttcatgcccctgggcttccctgccctgggcctgctgctgggccgcctcatcctgcacatcggggaccctgatgaggagatcggctgtgaggccctggatggcatcatcatcctgtacaccatcctggagctgcagaagagggcccgggacaaggaggagaccaacaagaaggagctgtatgagagcaacaagcacttcctgggcccctacaaccctgtgagcccctgccagaacatcctgcgggtcatcgaggagtttggagacttcctgggcccccagcagatcaaggacctgctgctggccgccctggagggcctgaagggcagcagcgaggcccctgggaaggacagccgggagatgatgcagctggccagcgaggtgatgctgagctctgtgctggagtggtaccgccaccgggccctggaggtgattcctgagatcatgcagggcatctacatgcagctgagccacatccaggagccccgggcccggcaggtggccctgctgcctgtgtccctgctggccagcagcttcatgacagaggtggtggtggccctgctgatgtgccccctgcccctgaacagcaatggagctgagatgtggaggcagctgatcctgtgcaagcccagctgtgatgtgcgggacctgctggacctgctgctgggcagcctgaaggagaagcctgtgaccaaggagggccgggccagcatcgtgcccctggccgccgccagcggcctgtgtgagctgctgtctgtgaacagctgcatgggccgggtgcggcgcatctacccccagctgctgctggccctgctgatccaggtgcactaccacatcggcctgaacctgcccggctgtgtggccccacccaaggacaccaagaagggggcccagcccagcccctttgtgcctgtgcgctgggtggtgaaggtggtgaagaccctgctgctgaggatgggctgcagctatgagaccaccttcctggaggaccagggcggctgggagctgatggagcaggtggagagccaccaccggggcgtggccctgctggcccgggccatggtgcagtacagctgccaggagctgtgccgcatcctgtacctgctgatccccctgctggagagaggagatgagaagcaccgcatcacagccacagccttctttgtggagcagccctgtgaggagggcatcgtcatcctgatgctgcgcatctcctgggagcggcagcagcaggccgtgactggagcccgctcctggagggtgacccacagcgccctgccccacggggctgatggccaccagacagagaccagcagcaacctgctggtgctgcaggtgtag

SEQ ID NO: 34711 - DNA, 1179 bp, Artificial Sequence
  Description of Artificial Sequence: Synthetic coding sequence
atggtgctgatggacatcagaagaaggctgcctgccatctgctggttctgcaagtctgaggcccctggccgggcagagcccggcatccagtgtgccatccctgtgcacggccggcctgggggctgcccagcccccctgagcctgggcagcaatgaccccctgctgccccagctgctgcagatggagcaggtgcggcgcatccctgaggagtacagcctgggccgcatggccgagggcctgagccaccacgaccccatcatgaaggtgctgagcatccggggcctggtgatcctggcccggcgctctgagaagacagccaaggtgaaggccctgctgcccagcatggtgaagggcctgaagaacatggatggcatgctggtggtggaggccgtgcacaacctgaaggctgtgttcaagggccgggaccagaagctgatggacagcgctgtgtatgtggagatgctgcagatcctgctgccccacttcagtgatgcccgggaggtggtgcgcagcagctgcatcaacctgtatggcaaggtggtgcagaagctgcgggcccccaggacccaggccatggaggagcagctggtgtccaccctggtgcccctgctgctgaccatgcaggagggcaacagcaaggtgtcccagaagtgtgtgaagaccctgctgcgctgcagctacttcatggcctgggagctgcccaagagggcctacagcaggaagccctgggacaaccagcagcagacagtggccaagatctgcaagtgcctggtgaacacccaccgggacagcgccttcatcttcctgagccagagcctggagtatgccaagaacagccgggccagcctgaggaaatgttctgtgatgtttattggcagcctggtgccctgcatggagagcatcatgacagaggaccggctgaatgaggtgaaggccgccctggacaacctgcggcatgaccctgaggcctctgtgtgcatctatgctgcccaggtgcaggaccacatcctggccagctgctggcagaacagctggctgccccacggcaacagctgggtgtgctacagcgccaccacccaccgctggagccccagctgtgagaacctgcccaccagccaccagaggaggtcctggatcatgcaggccctgggctcctggaagatgagcctgaagaagtag

SEQ ID NO: 34712 - DNA, 3093 bp, Artificial Sequence
  Description of Artificial Sequence: Synthetic coding sequence
atggccctgagccctggggccaacctggtgttccacgaggaccccaagatgacccccagcccccccagctgtggggcccctggcctgggcagcggcaccatcccccagccccacccagacatggcccaggtgcccatgctgaacctgctgcccagccctggcctggccctggtgcctgacctgaatgacagcctgagccctgtgtctggagaggccagcggcctggtgtctgagaacacccccaggccagatgacagccgggccatcgccccagccagcctgcagatcaccagcagctgcagcggggaggccctggacctggacagcaaggatgtgtccaggccagacagccagggccgcctgtgcccagccagcaaccccatcctgagccccagcagcacagaggccccccggctgagcagcggcaaccacccccagagcaacagtgaagatgccttcaagtgcctgagcagcaagatcttcaagctgggccagaggaacagcaaccccagcagacatgagctgaaccccttcatccgccaccacagccgggagggcctggtgctgggccactgcatcagccggcccagcagcaaggccctgctgatccccaccagcaacagcagcctggacctggacagcaaccccctgctgaacatgggcagcaggaacaccagcaagctgaacctgaatgtggccccagacagccacggcaccctcatcccagacaccaatgagaccatcaccctggccagccacaacatcagcgagagcgtgtccaaaggagccttcagcaccacctggagcaccagcagcaaggagaccatgaatgtggccagcagcggccacagcagaagtgacctgtctgtgaccatcacccaggccagctatgtgaccctcatccctggcagcagctatggcatcagcctgcacagcagcacccatgagcccaacagcaccatcagcccccccagctgcatgaccctcatcctgggcagcaatgagaccctgagcctggacagcagcctgctcttcagtgacaccagcaccctgaccctgagcagccagcaggatgatgccaaggacaacagcatccacacagtgcccctggaggagaacctggagagctggagcgagatggccagcatcaaggtgggccagttccccctgggcttccccatcagcaacccagctgggaaggatgctgtgaccctgcagggcatccctgagggcgcctttgatgaggtgaccagctgcctggtgaaggtgcctgagaagacagaaggaggcaacaacatggccctggtggagaatgtgaccaccctgcagaagagccaggacctgctggaggccgagggggagaagaagaccatgatcaagaagatcatgaggcagatccaggaggagcccctggacagcctgagcagctctgtgaggaagcaggccatggagatcctgacccagctgagccacacccagcccaccctgggcatgagggagaggtctgagctggtgaatgtgtgtgtgcacagcgtcttcagcctgcccagcgtgcaggccatgcaggagaaggatgaggccaaggccgagaccatccaggccctgtaccaccagaccctggaggccctgcagaccctgctgaaggccctcttcatcgaggaccccaccccagctggcctgaagagcatcctggaggccctgggcccctggatgaacagcggcaaggcccacgagcgggcccgggctgtgaacaccaacgtgtctgtgctgaaccacatgctgctgaccctgcccttcttcatgcccctgggcttccctgccctgggcctgctgctgggccgcctcatcctgcacatcggggaccctgatgaggagatcggctgtgaggccctggatggcatcatcatcctgtacaccatcctggagctgcagaagagggcccgggacaaggaggagaccaacaagaaggagctgtatgagagcaacaagcacttcctgggcccctacaaccctgtgagcccctgccagaacatcctgcgggtcatcgaggagtttggagacttcctgggcccccagcagatcaaggacctgctgctggccgccctggagggcctgaagggcagcagcgaggcccctgggaaggacagccgggagatgatgcagctggccagcgaggtgatgctgagctctgtgctggagtggtaccgccaccgggccctggaggtgattcctgagatcatgcagggcatctacatgcagctgagccacatccaggagccccgggcccggcaggtggccctgctgcctgtgtccctgctggccagcagcttcatgacagaggtggtggtggccctgctgatgtgccccctgcccctgaacagcaatggagctgagatgtggaggcagctgatcctgtgcaagcccagctgtgatgtgcgggacctgctggacctgctgctgggcagcctgaaggagaagcctgtgaccaaggagggccgggccagcatcgtgcccctggccgccgccagcggcctgtgtgagctgctgtctgtgaacagctgcatgggccgggtgcggcgcatctacccccagctgctgctggccctgctgatccaggtgcactaccacatcggcctgaacctgcccggctgtgtggccccacccaaggacaccaagaagggggcccagcccagcccctttgtgcctgtgcgctgggtggtgaaggtggtgaagaccctgctgctgaggatgggctgcagctatgagaccaccttcctggaggaccagggcggctgggagctgatggagcaggtggagagccaccaccggggcgtggccctgctggcccgggccatggtgcagtacagctgccaggagctgtgccgcatcctgtacctgctgatccccctgctggagagaggagatgagaagcaccgcatcacagccacagccttctttgtggagcagccctgtgaggagggcatcgtcatcctgatgctgcggccccaggacctgatgggcaaggccaccaccagcagccaccggggcagcgagctggagagtgacaccctgagctttgccacctggtgctag

SEQ ID NO: 34713 - DNA, 3870 bp, Artificial Sequence
  Description of Artificial Sequence: Synthetic coding sequence
atggccctgagccctggggccaacctggtgttccacgaggaccccaagatgacccccagcccccccagctgtggggcccctggcctgggcagcggcaccatcccccagccccacccagacatggcccaggtgcccatgctgaacctgctgcccagccctggcctggccctggtgcctgacctgaatgacagcctgagccctgtgtctggagaggccagcggcctggtgtctgagaacacccccaggccagatgacagccgggccatcgccccagccagcctgcagatcaccagcagctgcagcggggaggccctggacctggacagcaaggatgtgtccaggccagacagccagggccgcctgtgcccagccagcaaccccatcctgagccccagcagcacagaggccccccggctgagcagcggcaaccacccccagagcaacagtgaagatgccttcaagtgcctgagcagcaagatcttcaagctgggccagaggaacagcaaccccagcagacatgagctgaaccccttcatccgccaccacagccgggagggcctggtgctgggccactgcatcagccggcccagcagcaaggccctgctgatccccaccagcaacagcagcctggacctggacagcaaccccctgctgaacatgggcagcaggaacaccagcaagctgaacctgaatgtggccccagacagccacggcaccctcatcccagacaccaatgagaccatcaccctggccagccacaacatcagcgagagcgtgtccaaaggagccttcagcaccacctggagcaccagcagcaaggagaccatgaatgtggccagcagcggccacagcagaagtgacctgtctgtgaccatcacccaggccagctatgtgaccctcatccctggcagcagctatggcatcagcctgcacagcagcacccatgagcccaacagcaccatcagcccccccagctgcatgaccctcatcctgggcagcaatgagaccctgagcctggacagcagcctgctcttcagtgacaccagcaccctgaccctgagcagccagcaggatgatgccaaggacaacagcatccacacagtgcccctggaggagaacctggagagctggagcgagatggccagcatcaaggtgggccagttccccctgggcttccccatcagcaacccagctgggaaggatgctgtgaccctgcagggcatcccagaagatggagtgtccctgctgctgccccggctggagtgcaatggagccatcagcgcccactgcaacctgtgcctgcccggggcctttgatgaggtgaccagctgcctggtgaaggtgcctgagaagacagagggcggcaacaacatggccctggtggagaatgtgaccaccctgcagaagagccaggacctgctggaggccgagggggagaagaagaccatgatcaagaagatcatgaggcagatccaggaggagcccctggacagcctgagcagctctgtgaggaagcaggccatggagatcctgacccagctgagccacacccagcccaccctgggcatgagggagaggtctgagctggtgaatgtgtgtgtgcacagcgtcttcagcctgcccagcgtgcaggccatgcaggagaaggatgaggccaaggccgagaccatccaggccctgtaccaccagaccctggaggccctgcagaccctgctgaaggccctcttcatcgaggaccccaccccagctggcctgaagagcatcctggaggccctgggcccctggatgaacagcggcaaggcccacgagcgggcccgggctgtgaacaccaacgtgtctgtgctgaaccacatgctgctgaccctgcccttcttcatcgccatccagatgcccctgggcttccctgccctgggcctgctgctgggccgcctcatcctgcacatcggggaccctgatgaggagatcggctgtgaggccctggatggcatcatcatcctgtacaccatcctggagctgcagaagagggcccgggacaaggaggagaccaacaagaaggagctgtatgagagcaacaagcacttcctgggcccctacaaccctgtgagcccctgccagaacatcctgcgggtgattgaggagtttggagacttcctgggcccccagcagatcaaggacctgctgctggccgccctggagggcctgaagggcagcagcgaggcccctgggaaggacagccgggagatgatgcagctggccagcgaggtgatgctgagctctgtgctggagtggtaccgccaccgggccctggaggtgattcctgagatcatgcagggcatctacatgcagctgagccacatccaggagccccgggcccggcaggtggccctgctgcctgtgtccctgctggccagcagcttcatgacagaggtggtggtggccctgctgatgtgccccctgcccctgaacagcaatggagctgagatgtggaggcagctgatcctgtgcaagcccagctgtgatgtgcgggacctgctggacctgctgctgggcagcctgaaggagaagcctgtgaccaaggagggccgggccagcatcgtgcccctggccgccgccagcggcctgtgtgagctgctgtctgtgaacagctgcatgggccgggtgcggcgcatctacccccagctgctgctggccctgctgatccaggtgcactaccacatcggcctgaacctgcccggctgtgtggccccacccaaggacaccaagaagggggcccagcccagcccctttgtgcctgtgcgctgggtggtgaaggtggtgaagaccctgctgctgaggatgggctgcagctatgagaccaccttcctggaggaccagggcggctgggagctgatggagcaggtggagagccaccacagaggagtggccctgctggcccgggccatggtgcagtacagctgccaggagctgtgccgcatcctgtacctgctgatccccctgctggagagaggagatgagaagcaccgcatcacagccacagccttctttgtggagctgctgcagatggagcaggtgcggcgcatccctgaggagtacagcctgggccgcatggccgagggcctgagccaccacgaccccatcatgaaggtgctgagcatccggggcctggtgatcctggcccggcgctctgagaagacagccaaggtgaaggccctgctgcccagcatggtgaagggcctgaagaacatggatggcatgctggtggtggaggccgtgcacaacctgaaggctgtgttcaagggccgggaccagaagctgatggacagcgctgtgtatgtggagatgctgcagatcctgctgccccacttcagtgatgcccgggaggtggtgcgcagcagctgcatcaacctgtatggcaaggtggtgcagaagctgcgggcccccaggacccaggccatggaggagcagctggtgtccaccctggtgcccctgctgctgaccatgcaggagggcaacagcaaggtgtcccagaagtgtgtgaagaccctgctgcgctgcagctacttcatggcctgggagctgcccaagagggcctacagcaggaagccctgggacaaccagcagcagacagtggccaagatctgcaagtgcctggtgaacacccaccgggacagcgccttcatcttcctgagccagagcctggagtatgccaagaacagccgggccagcctgaggaaatgttctgtgatgtttattgccaccccccggggccagcgcttccacctgctgtgcccccccctgtacagccagcccctggagcaggccggcagcgctgagcgggccaagaacctgaagaggagcccctacctgtag

SEQ ID NO: 34714 - DNA, 3972 bp, Artificial Sequence
  Description of Artificial Sequence: Synthetic coding sequence
atggccctgagccctggggccaacctggtgttccacgaggaccccaagatgacccccagcccccccagctgtggggcccctggcctgggcagcggcaccatcccccagccccacccagacatggcccaggtgcccatgctgaacctgctgcccagccctggcctggccctggtgcctgacctgaatgacagcctgagccctgtgtctggagaggccagcggcctggtgtctgagaacacccccaggccagatgacagccgggccatcgccccagccagcctgcagatcaccagcagctgcagcggggaggccctggacctggacagcaaggatgtgtccaggccagacagccagggccgcctgtgcccagccagcaaccccatcctgagccccagcagcacagaggccccccggctgagcagcggcaaccacccccagagcaacagtgaagatgccttcaagtgcctgagcagcaagatcttcaagctgggccagaggaacagcaaccccagcagacatgagctgaaccccttcatccgccaccacagccgggagggcctggtgctgggccactgcatcagccggcccagcagcaaggccctgctgatccccaccagcaacagcagcctggacctggacagcaaccccctgctgaacatgggcagcaggaacaccagcaagctgaacctgaatgtggccccagacagccacggcaccctcatcccagacaccaatgagaccatcaccctggccagccacaacatcagcgagagcgtgtccaaaggagccttcagcaccacctggagcaccagcagcaaggagaccatgaatgtggccagcagcggccacagcagaagtgacctgtctgtgaccatcacccaggccagctatgtgaccctcatccctggcagcagctatggcatcagcctgcacagcagcacccatgagcccaacagcaccatcagcccccccagctgcatgaccctcatcctgggcagcaatgagaccctgagcctggacagcagcctgctcttcagtgacaccagcaccctgaccctgagcagccagcaggatgatgccaaggacaacagcatccacacagtgcccctggaggagaacctggagagctggagcgagatggccagcatcaaggtgggccagttccccctgggcttccccatcagcaacccagctgggaaggatgctgtgaccctgcagggcatccctgagggcgcctttgatgaggtgaccagctgcctggtgaaggtgcctgagaagacagaaggaggcaacaacatggccctggtggagaatgtgaccaccctgcagaagagccaggacctgctggaggccgagggggagaagaagaccatgatcaagaagatcatgaggcagatccaggaggagcccctggacagcctgagcagctctgtgaggaagcaggccatggagatcctgacccagctgagccacacccagcccaccctgggcatgagggagaggtctgagctggtgaatgtgtgtgtgcacagcgtcttcagcctgcccagcgtgcaggccatgcaggagaaggatgaggccaaggccgagaccatccaggccctgtaccaccagaccctggaggccctgcagaccctgctgaaggccctcttcatcgaggaccccaccccagctggcctgaagagcatcctggaggccctgggcccctggatgaacagcggcaaggcccacgagcgggcccgggctgtgaacaccaacgtgtctgtgctgaaccacatgctgctgaccctgcccttcttcatgcccctgggcttccctgccctgggcctgctgctgggccgcctcatcctgcacatcggggaccctgatgaggagatcggctgtgaggccctggatggcatcatcatcctgtacaccatcctggagctgcagaagagggcccgggacaaggaggagaccaacaagaaggagctgtatgagagcaacaagcacttcctgggcccctacaaccctgtgagcccctgccagaacatcctgcgggtcatcgaggagtttggagacttcctgggcccccagcagatcaaggacctgctgctggccgccctggagggcctgaagggcagcagcgaggcccctgggaaggacagccgggagatgatgcagctggccagcgaggtgatgctgagctctgtgctggagtggtaccgccaccgggccctggaggtgattcctgagatcatgcagggcatctacatgcagctgagccacatccaggagccccgggcccggcaggtggccctgctgcctgtgtccctgctggccagcagcttcatgacagaggtggtggtggccctgctgatgtgccccctgcccctgaacagcaatggagctgagatgtggaggcagctgatcctgtgcaagcccagctgtgatgtgcgggacctgctggacctgctgctgggcagcctgaaggagaagcctgtgaccaaggagggccgggccagcatcgtgcccctggccgccgccagcggcctgtgtgagctgctgtctgtgaacagctgcatgggccgggtgcggcgcatctacccccagctgctgctggccctgctgatccaggtgcactaccacatcggcctgaacctgcccggctgtgtggccccacccaaggacaccaagaagggggcccagcccagcccctttgtgcctgtgcgctgggtggtgaaggtggtgaagaccctgctgctgaggatgggctgcagctatgagaccaccttcctggaggaccagggcggctgggagctgatggagcaggtggagagccaccaccggggcgtggccctgctggcccgggccatggtgcagtacagctgccaggagctgtgccgcatcctgtacctgctgatccccctgctggagagaggagatgagaagcaccgcatcacagccacagccttctttgtggagctgctgcagatggagcaggtgcggcgcatccctgaggagtacagcctgggccgcatggccgagggcctgagccaccacgaccccatcatgaaggtgctgagcatccggggcctggtgatcctggccaggagaagtgagaagacagccaaggtgaaggccctgctgcccagcatggtgaagggcctgaagaacatggatggcatgctggtggtggaggccgtgcacaacctgaaggctgtgttcaagggccgggaccagaagctgatggattctgctgtgtatgtggagatgctgcagatcctgctgccccacttcagtgatgcccgggaggtggtgcgcagcagctgcatcaacctgtatggcaaggtggtgcagaagctgcgggcccccaggacccaggccatggaggagcagctggtgtccaccctggtgcccctgctgctgaccatgcaggagggcaacagcaaggtgtcccagaagtgtgtgaagaccctgctgcgctgcagctacttcatggcctgggagctgcccaagagggcctacagcaggaagccctgggacaaccagcagcagacagtggccaagatctgcaagtgcctggtgaacacccaccgggacagcgccttcatcttcctgagccagagcctggagtatgccaagaacagccgggccagcctgaggaagtgcagcgtgatgttcatcggcagcctggtgccctgcatggagagcatcatgacagaagatcggctgaatgaggtgaaggccgccctggacaacctgcggcatgaccctgaggcctctgtgtgcatctatgctgcccaggtgcaggaccacatcctggccagctgctggcagaacagctggctgccccacggcaacagctgggtgtgctacagcgccaccacccaccgctggagccccagctgtgagaacctgcccaccagccaccagaggaggtcctggatcatgcaggccctgggctcctggaagatgagcctgaagaagtag

SEQ ID NO: 34715 - DNA, 2526 bp, Artificial Sequence
  Description of Artificial Sequence: Synthetic coding sequence
atggagatcctgacccagctgagccacacccagcccaccctgggcatgagggagaggtctgagctggtgaatgtgtgtgtgcacagcgtcttcagcctgcccagcgtgcaggccatgcaggagaaggatgaggccaaggccgagaccatccaggccctgtaccaccagaccctggaggccctgcagaccctgctgaaggccctcttcatcgaggaccccaccccagctggcctgaagagcatcctggaggccctgggcccctggatgaacagcggcaaggcccacgagcgggcccgggctgtgaacaccaacgtgtctgtgctgaaccacatgctgctgaccctgcccttcttcatgcccctgggcttccctgccctgggcctgctgctgggccgcctcatcctgcacatcggggaccctgatgaggagatcggctgtgaggccctggatggcatcatcatcctgtacaccatcctggagctgcagaagagggcccgggacaaggaggagaccaacaagaaggagctgtatgagagcaacaagcacttcctgggcccctacaaccctgtgagcccctgccagaacatcctgcgggtcatcgaggagtttggagacttcctgggcccccagcagatcaaggacctgctgctggccgccctggagggcctgaagggcagcagcgaggcccctgggaaggacagccgggagatgatgcagctggccagcgaggtgatgctgagctctgtgctggagtggtaccgccaccgggccctggaggtgattcctgagatcatgcagggcatctacatgcagctgagccacatccaggagccccgggcccggcaggtggccctgctgcctgtgtccctgctggccagcagcttcatgacagaggtggtggtggccctgctgatgtgccccctgcccctgaacagcaatggagctgagatgtggaggcagctgatcctgtgcaagcccagctgtgatgtgcgggacctgctggacctgctgctgggcagcctgaaggagaagcctgtgaccaaggagggccgggccagcatcgtgcccctggccgccgccagcggcctgtgtgagctgctgtctgtgaacagctgcatgggccgggtgcggcgcatctacccccagctgctgctggccctgctgatccaggtgcactaccacatcggcctgaacctgcccggctgtgtggccccacccaaggacaccaagaagggggcccagcccagcccctttgtgcctgtgcgctgggtggtgaaggtggtgaagaccctgctgctgaggatgggctgcagctatgagaccaccttcctggaggaccagggcggctgggagctgatggagcaggtggagagccaccaccggggcgtggccctgctggcccgggccatggtgcagtacagctgccaggagctgtgccgcatcctgtacctgctgatccccctgctggagagaggagatgagaagcaccgcatcacagccacagccttctttgtggagctgctgcagatggagcaggtgcggcgcatccctgaggagtacagcctgggccgcatggccgagggcctgagccaccacgaccccatcatgaaggtgctgagcatccggggcctggtgatcctggccaggagaagtgagaagacagccaaggtgaaggccctgctgcccagcatggtgaagggcctgaagaacatggatggcatgctggtggtggaggccgtgcacaacctgaaggctgtgttcaagggccgggaccagaagctgatggattctgctgtgtatgtggagatgctgcagatcctgctgccccacttcagtgatgcccgggaggtggtgcgcagcagctgcatcaacctgtatggcaaggtggtgcagaagctgcgggcccccaggacccaggccatggaggagcagctggtgtccaccctggtgcccctgctgctgaccatgcaggagggcaacagcaaggtgtcccagaagtgtgtgaagaccctgctgcgctgcagctacttcatggcctgggagctgcccaagagggcctacagcaggaagccctgggacaaccagcagcagacagtggccaagatctgcaagtgcctggtgaacacccaccgggacagcgccttcatcttcctgagccagagcctggagtatgccaagaacagccgggccagcctgaggaagtgcagcgtgatgttcatcggcagcctggtgccctgcatggagagcatcatgacagaagatcggctgaatgaggtgaaggccgccctggacaacctgcggcatgaccctgaggcctctgtgtgcatctatgctgcccaggtgcaggaccacatcctggccagctgctggcagaacagctggctgccccacggcaacagctgggtgtgctacagcgccaccacccaccgctggagccccagctgtgagaacctgcccaccagccaccagaggaggtcctggatcatgcaggccctgggctcctggaagatgagcctgaagaagtag

SEQ ID NO: 34716 - DNA, 1623 bp, Artificial Sequence
  Description of Artificial Sequence: Synthetic coding sequence
atggccctggtggagaatgtgaccaccctgcagaagagccaggacctgctggaggccgagggggagaagaagaccatgatcaagaagatcatgaggcagatccaggaggagcccctggacagcctgagcagctctgtgaggaagcaggccatggagatcctgacccagctgagccacacccagcccaccctgggcatgagggagaggtctgagctggtgaatgtgtgtgtgcacagcgtcttcagcctgcccagcgtgcaggccatgcaggagaaggatgaggccaaggccgagaccatccaggccctgtaccaccagaccctggaggccctgcagaccctgctgaaggccctcttcatcgaggaccccaccccagctggcctgaagagcatcctggaggccctgggcccctggatgaacagcggcaaggcccacgagcgggcccgggctgtgaacaccaacgtgtctgtgctgaaccacatgctgctgaccctgcccttcttcatgcccctgggcttccctgccctgggcctgctgctgggccgcctcatcctgcacatcggggaccctgatgaggagatcggctgtgaggccctggatggcatcatcatcctgtacaccatcctggagctgcagaagagggcccgggacaaggaggagaccaacaagaaggagctgtatgagagcaacaagcacttcctgggcccctacaaccctgtgagcccctgccagaacatcctgcgggtcatcgaggagtttggagacttcctgggcccccagcagatcaaggacctgctgctggccgccctggagggcctgaagggcagcagcgaggcccctgggaaggacagccgggagatgatgcagctggccagcgaggtgatgctgagctctgtgctggagtggtaccgccaccgggccctggaggtgattcctgagatcatgcagggcatctacatgcagctgagccacatccaggagccccgggcccggcaggtggccctgctgcctgtgtccctgctggccagcagcttcatgacagaggtggtggtggccctgctgatgtgccccctgcccctgaacagcaatggagctgagatgtggaggcagctgatcctgtgcaagcccagctgtgatgtgcgggacctgctggacctgctgctgggcagcctgaaggagaagcctgtgaccaaggagggccgggccagcatcgtgcccctggccgccgccagcggcctgtgtgagctgctgtctgtgaacagctgcatgggccgggtgcggcgcatctacccccagctgctgctggccctgctgatccaggtgcactaccacatcggcctgaacctgcccggctgtgtggccccacccaaggacaccaagaagggggcccagcccagcccctttgtgcctgtgcgctgggtggtgaaggtggtgaagaccctgctgctgaggatgggctgcagctatgagaccaccttcctggaggaccagggcggctgggagctgatggagcaggtggagagccaccaccggggcgtggccctgctggccagcagcagccgctggagccgctgtgccggcagccccaggaacaccctgtggggcggctggcagaaggcctag

SEQ ID NO: 34717 - DNA, 1416 bp, Artificial Sequence
  Description of Artificial Sequence: Synthetic coding sequence
atggcccgggagatgaccatcctgggcagcgctgtgctgaccctgctgctggccggctacctggcccagcagtacctgcccctgcccacccccaaggtgattggcatcgacctgggcaccacctactgcagcgtgggcgtcttcttccctggcaccgggaaggtgaaggtgatcccagatgaaaatggccacatcagcatccccagcatggtgtccttcacagacaatgatgtgtatgtgggctatgagagcgtggagctggccgacagcaacccccagaacaccatctatgatgccaagcgcttcatcggcaagatcttcaccgctgaggagctggaggccgagatcggccgctaccccttcaaggtgctgaacaagaatggcatggtggagttctctgtgaccagcaatgagaccatcaccgtgtccccagaatatgtgggcagccggctgctgctgaagctgaaggagatggccgaggcctacctgggcatgcctgtggccaatgctgtgatctctgtgcctgctgagtttgacctgaagcagaggaacagcaccattgaagctgccaacctggccggcctgaagatcctgcgggtcatcaatgagcccacagctgctgccatggcctacggcctgcacaaggcagatgtgttccacgtgctggtgattgacctgggcggcggcaccctggatgtgtccctgctgaacaagcagggcggcatgttcctgacccgggccatgagcggcaacaacaagctgggcggccaggacttcaaccagaggctgctgcagtacctgtacaagcagatctaccagacctacggctttgtgcccagcaggaaggaggagatccaccggctgcggcaggccgtggagatggtgaagctgaacctgaccctgcaccagagcgcccagctgtctgtgctgctgactgtggaggagcaggacaggaaggagccccacagcagtgacacagagctgcccaaggacaagctgagcagcgcagatgaccaccgggtgaacagcggcttcggccggggcctgagtgacaagaagagcggggagagccaggtgctgtttgaaacagagatcagcaggaagctgtttgacaccctgaatgaagatctcttccagaagatcctggtgcccatccagcaggtgctgaaggagggccacctggagaagacagaaattgatgaggtggtgctggtgggcggcagcacccgcatcccccgcatccggcaggtgatccaggagttcttcggcaaggaccccaacacctctgtggaccctgacctggccgtggtgactggagtggccatccaggccggcattgatggcggctcctggcccctgcaggtgtctgccctggagatccccaacaagcacctgcagaagaccaacttcaactag

SEQ ID NO: 34718 - DNA, 792 bp, Artificial Sequence
  Description of Artificial Sequence: Synthetic coding sequence
atggcctacggcctgcacaaggcagatgtgttccacgtgctggtgattgacctgggcggcggcaccctggatgtgtccctgctgaacaagcagggcggcatgttcctgacccgggccatgagcggcaacaacaagctgggcggccaggacttcaaccagaggctgctgcagtacctgtacaagcagatctaccagacctacggctttgtgcccagcaggaaggaggagatccaccggctgcggcaggccgtggagatggtgaagctgaacctgaccctgcaccagagcgcccagctgtctgtgctgctgactgtggaggagcaggacaggaaggagccccacagcagtgacacagagctgcccaaggacaagctgagcagcgcagatgaccaccgggtgaacagcggcttcggccggggcctgagtgacaagaagagcggggagagccaggtgctgtttgaaacagagatcagcaggaagctgtttgacaccctgaatgaagatctcttccagaagatcctggtgcccatccagcaggtgctgaaggagggccacctggagaagacagaaattgatgaggtggtgctggtgggcggcagcacccgcatcccccgcatccggcaggtgatccaggagttcttcggcaaggaccccaacacctctgtggaccctgacctggccgtggtgactggagtggccatccaggccggcattgatggcggctcctggcccctgcaggtgtctgccctggagatccccaacaagcacctgcagaagaccaacttcaactag

SEQ ID NO: 34719 - DNA, 1515 bp, Artificial Sequence
  Description of Artificial Sequence: Synthetic coding sequence
atgggcatcaagacagccctgcctgctgctgagctgggcctgtacagcctggtgctgagcggggccctggcctatgccggccggggcctgctggaggccagccaggatggagcccacaggaaggccttccgggagagcgtgcggcccggctgggagtacatcggcaggaagatggatgtggccgactttgagtgggtgatgtggttcaccagcttcagaaatgtcatcatctttgccctgagcggccacgtgctgtttgccaagctgtgcaccatggtggcccccaagctgcgctcctggatgtatgctgtgtatggagccctggccgtgatgggcaccatgggcccctggtacctgctgctgctgctgggccactgtgtgggcctgtatgtggccagcctgctgggccagccctggctgtgcctgggcctgggcctggccagcctggccagcttcaagatggaccccctcatctcctggcagagcggctttgtgacaggcacctttgacctgcaggaggtgctcttccatggaggcagcagcttcaccgtgctgcgctgcaccagctttgccctggagagctgtgcccacccagacagacactacagcctggccgacctgctgaagtacaacttctacctgcccttcttcttcttcggccccatcatgacctttgaccgcttccacgcccaggtgtcccaggtggagcctgtgagaagagaaggagagctgtggcacatccgggcccaggccggcctgtctgtggtggccatcatggctgtggacatcttcttccacttcttctacatcctgaccatccccagcgacctgaagtttgccaaccggctgcctgacagcgccctggccggcctggcctacagcaacctggtgtatgactgggtgaaggctgctgtgctgtttggagtggtgaacacagtggcctgcctggaccacctggaccccccccagccccccaagtgcatcacagccctgtatgtgtttgctgagacccactttgaccggggcatcaatgactggctgtgcaagtatgtgtacaaccacatcggcggggagcacagcgctgtgattcctgagctggccgccaccgtggccacctttgccatcaccaccctgtggctgggcccctgtgacatcgtgtacctgtggagcttcctgaactgcttcggcctgaactttgagctgtggatgcagaagctggccgagtggggccccctggccagaattgaggccagcctgtctgtgcagatgagcagaagagtgcgggccctgtttggagccatgaacttctgggccatcatcatgtacaacctggtgtccctgaacagcctgaagttcacagagctggtggcccggcggctgctgctgaccggcttcccccagaccaccctgagcatcctgtttgtgacctactgcggcgtgcagctggtgaaggagcgggagaggaccctggccctggaggaggagcagaagcaggacaaggagaagccagagtag

SEQ ID NO: 34720 - DNA, 738 bp, Artificial Sequence
  Description of Artificial Sequence: Synthetic coding sequence
atggtggcccccaagctgcgctcctggatgtatgctgtgtatggagccctggccgtgatgggcaccatgggcccctggtacctgctgctgctgctgggccactgtgtgggcctgtatgtggccagcctgctgggccagccctggctgtgcctgggcctgggcctggccagcctggccagcttcaagatggaccccctcatctcctggcagagcggctttgtgacaggcacctttgacctgcaggaggtgctcttccacggcggcagcagcttcaccgtgctgcgctgcaccagctttgccctggagagctgtgcccacccagacagacactacagcctggccgacctgctgaagtacaacttctacctgcccttcttcttcttcggccccatcatgacctttgaccgcttccacgcccaggtgtcccaggtggagcctgtgcggcgggagggggagctgtggcacatccgggcccaggccggcctgtctgtggtggccatcatggctgtggacatcttcttccacttcttctacatcctgagccctgccaccagcagcagccccacagccagccagacagtgcccagcgctggcctggcctacagcaacctggtgtatgactgggtgaagggccggcccctgtggtgctgccagcactggcacgccagcaccacctggacccaccccccacccaagtgcatcacagccctgtatgtgtttgctgagacccacttctag

SEQ ID NO: 34721 - DNA, 696 bp, Artificial Sequence
  Description of Artificial Sequence: Synthetic coding sequence
atgggcatcaagacagccctgcctgctgctgagctgggcctgtacagcctggtgctgagcggggccctggcctatgccggccggggcctgctggaggccagccaggatggagcccacaggaaggccttccgggagagcgtgcggcccggctgggagtacatcggcaggaagatggatgtggccgactttgagtgggtgatgtggttcaccagcttcagaaatgtcatcatctttgccctgagcggccacgtgctgtttgccaagctgtgcaccatggtggcccccaagctgcgctcctggatgtatgctgtgtatggagccctggccgtgatgggcaccatgggcccctggtacctgctgctgctgctgggccactgtgtgggcctgtatgtggccagcctgctgggccagccctggctgtgcctgggcctgggcctggccagcctggccagcttcaagatggaccccctcatctcctggcagagcggctttgtgacaggcacctttgacctgcaggaggtgctcttccatggaggcagcagcttcaccgtgctgcgctgcaccagctttgccctggagagctgtgcccacccagacagacactacagcctggccgacctgctgaagtacaacttctacctgcccttcttcttcttcggccccatcatgacctttgaccgcttccacgcccagtag

SEQ ID NO: 34722 - DNA, 1515 bp, Artificial Sequence; identical to SEQ ID NO: 34719
  Description of Artificial Sequence: Synthetic coding sequence

SEQ ID NO: 34723 - DNA, 282 bp, Artificial Sequence
  Description of Artificial Sequence: Synthetic coding sequence
atgatccacctgggccacatcctcttcctgctgctgctgcctgtggccgccgcccagaccaccccaggagagaggagcagcctgcctgccttctacccaggcaccagcggcagctgcagcggctgcggcagcctgagcctgcccctgctggccggcctggtggccgcagatgctgtggccagcctgctgattgtgggcgctgtgttcctgtgtgcccggcccaggaggagccctgcccaggaggatggcaaggtgtacatcaacatgcctggccggggctag

SEQ ID NO: 34724 - DNA, 279 bp, Artificial Sequence
  Description of Artificial Sequence: Synthetic coding sequence
atgatccacctgggccacatcctcttcctgctgctgctgcctgtggccgccgcccagaccaccccaggagagaggagcagcctgcctgccttctacccaggcaccagcggcagctgcagcggctgcggcagcctgagcctgcccctgctggccggcctggtggccgcagatgctgtggccagcctgctgattgtgggcgctgtgttcctgtgtgcccggcccaggaggagccctgcccaggacggcaaggtgtacatcaacatgcctggccggggctag

SEQ ID NO: 34725 - DNA, 924 bp, Artificial Sequence
  Description of Artificial Sequence: Synthetic coding sequence
atggccgccctgctgctgggcgctgtgctgctggtggcccagccccagctggtgcccagcaggcctgctgagctgggccagcaggagctgctgaggaaggccggcaccctgcaggatgatgtgagagatggagtggcccccaacggcagcgcccagcagctgccccagaccatcatcatcggcgtgaggaagggcggcacccgggccctgctggagatgctgagcctgcacccagatgtggccgctgctgaaaatgaggtgcacttctttgactgggaggagcactacagccacggcctgggctggtacctgagccagatgcccttctcctggccccaccagctgactgtggagaagaccccagcctacttcaccagccccaaggtgcctgagcgggtgtacagcatgaaccccagcatccggctgctgctgatcctgcgggaccccagcgagcgggtgctgagtgactacacccaggtgttctacaaccacatgcagaagcacaagccctaccccagcattgaggagttcctggtgagagatggccgcctgaatgtggactacaaggccctgaacagaagcctgtaccacgtgcacatgcagaactggctgcgcttcttccccctgcggcacatccacatcgtggatggagacaggctcatccgggaccccttccctgagatccagaaggtggagcgcttcctgaagctgagcccccagatcaatgccagcaacttctacttcaacaagaccaagggcttctactgcctgcgggacagcggccgggaccgctgcctgcacgagagcaagggccgggcccacccccaggtggaccccaagctgctgaacaagctgcacgagtacttccacgagcccaacaagaagttctttgagctggtgggccgcacctttgactggcactag

SEQ ID NO: 34726 - DNA, 252 bp, Artificial Sequence
  Description of Artificial Sequence: Synthetic coding sequence
atggccgccctgctgctgggcgctgtgctgctggtggcccagccccagctggtgcccagcaggcctgctgagctgggccagcaggagctgctgaggaaggccggcaccctgcaggatgatgtgagagatggagtggcccccaacggcagcgcccagcagctgccccagaccatcatcatcggcgtgaggaagggcggcacccgggccctgctggagatgctgagcctgcacccagatgtggccgccgcctag

SEQ ID NO: 34727 - DNA, 252 bp, Artificial Sequence; identical to SEQ ID NO: 34726
  Description of Artificial Sequence: Synthetic coding sequence

SEQ ID NO: 34728 - DNA, 1029 bp, Artificial Sequence
  Description of Artificial Sequence: Synthetic coding sequence
atggccggcagcggcggcctgggcggcggggccggcggcggccagggcgctggggccggccagggcgccgccctgcgggccagccgggcccccatgctgctggtggccctggtgctgggcgcctactgcctgtgtgccctgcccggccgctgccccccagctgcccgggccccagccccagccccagcccccagcgagcccagcagctctgtgcacaggcctggggcccctggcctgcccctggccagcggccctggaagaagacgcttcccccaggccctgattgtgggcgtgaagaagggcggcacccgggccctgctggagttcctgcggctgcacccagatgtgcgggccctgggcagcgagccccacttctttgaccgctgctatgaaagaggcctggcctggtaccgcagcctgatgcccaggaccctggatggccagatcaccatggagaagacccccagctactttgtgacccgggaggccccccggcgcatccacgccatgagcccagacaccaagctgattgtggtggtgagaaatcctgtgacccgggccatcagtgactatgcccagaccctgagcaagaccccaggcctgcccagcttccgggccctggccttcagacatggcctgggccctgtggacacagcctggagcgctgtgagaattggcctgtatgcccagcacctggaccactggctgcgctacttccccctgagccacttcctgtttgtgtctggagagcggctggtgtctgaccctgctggggaggtgggccgggtgcaggacttcctgggcctgaagagggtggtgacagacaagcacttctacttcaatgccaccaagggcttcccctgcctgaagaaggcccagggcggcagccggccccgctgcctgggcaagagcaagggccggccccacccccgggtgccccaggccctggtgcggcggctgcaggagttctaccggcccttcaacagacgcttctaccagatgacaggccaggactttggctggggctag

SEQ ID NO: 34729 - DNA, 936 bp, Artificial Sequence
  Description of Artificial Sequence: Synthetic coding sequence
atgctgctggtggccctggtgctgggcgcctactgcctgtgtgccctgcccggccgctgccccccagctgcccgggccccagccccagccccagcccccagcgagcccagcagctctgtgcacaggcctggggcccctggcctgcccctggccagcggccctggaagaagacgcttcccccaggccctgattgtgggcgtgaagaagggcggcacccgggccctgctggagttcctgcggctgcacccagatgtgcgggccctgggcagcgagccccacttctttgaccgctgctatgagcggggcctggcctggtaccgcagcctgatgcccaggaccctggatggccagatcaccatggagaagacccccagctactttgtgacccgggaggccccccggcgcatccacgccatgagcccagacaccaagctgattgtggtggtgaggaaccctgtgacccgggccatcagtgactatgcccagaccctgagcaagaccccaggcctgcccagcttccgggccctggccttccgccacggcctgggccctgtggacacagcctggagcgctgtgcgcatcggcctgtatgcccagcacctggaccactggctgcgctacttccccctgagccacttcctgtttgtgtctggagagcggctggtgtctgaccctgctggggaggtgggccgggtgcaggacttcctgggcctgaagagggtggtgacagacaagcacttctacttcaatgccaccaagggcttcccctgcctgaagaaggcccagggcggcagccggccccgctgcctgggcaagagcaagggccggccccacccccgggtgccccaggccctggtgcggcggctgcaggagttctaccggcccttcaacagacgcttctaccagatgacaggccaggactttggctggggctag

SEQ ID NO: 34730 - DNA, 1146 bp, Artificial Sequence
  Description of Artificial Sequence: Synthetic coding sequence
gctgctggccccccaggagctgagcacaagccaggcacccacggcctgagcggggcccgggcagagatgagggcccggctgctgccccccctgcccggcctggagcggcgggaccccatggccggcagcggcggcctgggcggcggggccggcggcggccagggcgctggggccggccagggcgccgccctgcgggccagccgggcccccatgctgctggtggccctggtgctgggcgcctactgcctgtgtgccctgcccggccgctgccccccagctgcccgggccccagccccagccccagcccccagcgagcccagcagctctgtgcacaggcctggggcccctggcctgcccctggccagcggccctggaagaagacgcttcccccaggccctgattgtgggcgtgaagaagggcggcacccgggccctgctggagttcctgcggctgcacccagatgtgcgggccctgggcagcgagccccacttctttgaccgctgctatgagcggggcctggcctggtaccgcagcctgatgcccaggaccctggatggccagatcaccatggagaagacccccagctactttgtgacccgggaggccccccggcgcatccacgccatgagcccagacaccaagctgattgtggtggtgaggaaccctgtgacccgggccatcagtgactatgcccagaccctgagcaagaccccaggcctgcccagcttccgggccctggccttccgccacggcctgggccctgtggacacagcctggagcgctgtgcgcatcggcctgtatgcccagcacctggaccactggctgcgctacttccccctgagccacttcctgtttgtgtctggagagcggctggtgtctgaccctgctggggaggtgggccgggtgcaggacttcctgggcctgaagagggtggtgacagacaagcacttctacttcaatgccaccaagggcttcccctgcctgaagaaggcccagggcggcagccggccccgctgcctgggcaagagcaagggccggccccacccccgggtgccccaggccctggtgcggcggctgcaggagttctaccggcccttcaacagacgcttctaccagatgacaggccaggactttggctggggctag

SEQ ID NO: 34731 - DNA, 906 bp, Artificial Sequence
  Description of Artificial Sequence: Synthetic coding sequence
atgttcagccacctgccctttgactgtgtgctgctgctgctgctgctgctgctgaccaggagcagcgaggtggagtacagagctgaggtgggccagaatgcctacctgccctgcttctacaccccagctgcccctggcaacctggtgcctgtgtgctggggcaaaggagcctgccctgtgtttgaatgtggaaatgtggtgctgaggacagatgaaagagatgtgaactactggaccagccgctactggctgaatggagacttcagaaaaggagatgtgtccctgaccattgaaaatgtgaccctggccgacagcggcatctactgctgccgcatccagatccctggcatcatgaatgatgagaagttcaacctgaagctggtgatcaagccagccaaggtgaccccagcccccacccggcagagggacttcaccgctgccttccccaggatgctgaccacccggggccacggccctgctgagacccagaccctgggcagcctgcctgacatcaacctgacccagatcagcaccctggccaatgagctgcgggacagccggctggccaatgacctgcgggacagcggggccaccatcagaattggcatctacatcggggccggcatctgtgccggcctggccctggccctgatctttggagccctgatcttcaagtggtacagccacagcaaggagaagatccagaacctgagcctcatcagcctggccaacctgccccccagcggcctggccaatgctgtggccgagggcatccgctctgaggagaacatctacaccattgaagaaaatgtgtatgaggtggaggagcccaatgagtactactgctacgtgagcagccggcagcagcccagccagcccctgggctgccgctttgccatgccctag

SEQ ID NO: 34732 - DNA, 3480 bp, Artificial Sequence
  Description of Artificial Sequence: Synthetic coding sequence
atgcccaggaagcagcctgctggctgcatcttcctgctgaccttcctgggcctgagcggcctggtgggcaccgtgaccaggacctactacatcggcatcgtggaggagtactggaactacgtgccccagggcaagaatgtcatcaccgggaagagcttcacagaggacaagctggccaccctcttcctggagcggggccccaaccgcatcggcagcatctacaagaaggctgtgtaccgccgcttcacagatggcacctacagcattgagatccccaagccaccctggctgggcttcctgggccccatcctgcgggcagaggtgggagatgtgattgtcatccacctgaagaactttgccagccggccctacagcctgcacccccatggagtcttctacaacaaggacagcgagggcgccctgtacccagatggcaccagcggcaggaacaagaatgatgacatggtgcccccaggcaagaactacacctacgtgtggcctgtgcgggaggagtatgcccccaccccagcagatgccaactgcctgacctgggtgtaccacagccacattgatgcccccaaggacatctgcagcggcctgattggccccctgctggtgtgcaaggagggcatcctgaaccgctacagcggcaccagaaatgatgtggaccgggagtttgtgatcatgttcaccctggtggatgagaaccagagctggtacctgaatgaaaacatcaagcacttctgcaccaacccagacagcgtggacaagaaggatgctgtgttccagaggagcaacaagatgcacgccctgaatggctacctgtttggaaacttccctgagccagacatgtgtgtgggggagagcgtgtcctggcacctgtttggcatgggaaatgaaattgacatccacagcatctacttctacggcaacaccttcatcagccggggccacaggacagatgtggtgaacctcttccctgccaccttcctgaccacagagatgattgctgagaaccctgggaagtggatgatcacctgccaggtgtctgaccacctgcaggccggcatgctgggccagtacaacgtggacaactgcaagagtgacatcttctaccccaagatgaagggccagcagaggcgctacttcatcgctgctgagaagatcctgtgggactatgccccccagggctacaacaagttcagcggcctgcccctgaatgccagcggcagtgacagcgacctgtacttcacccagggcgacaaccgcatcggcggcaagtactggaaggtgcgctacacagaatttgtggatgccaccttcaccaagaggaagaggctgtctgctgaggaggcccacctgggcatcctgggccctgtgatcaaggccgaggtgggggacaccctgctggtgacctttgccaacaaggctgacaaggtgtacagcatcctgccccacggcgtcatctatgacaaggccagtgatgctgcccccaacctggatggctttgtgaagccaggggcccacgtgaagccaggagagaccttcacctacaagtggacagtgcctgagagcgtgagccccacagctggggaccccccctgcctgacctacctgtacttctctgctgtggaccccatcaaggacaccagcagcggcctggtgggccccctgctggtgtgcaagaagggcgtgctgaatgctgatggcacccagaagggcatcgacaaggagttctacctgctcttcaccgtgtttgatgagaacctgagccgctactttgatgagaacatccagaagttcatctggcaccccttcagcattgacaaggaggacaaggagtttgtgaagagcaacaggatgcatgctgtgaatggctacatgtatggcaaccagcccggcctgaacatgtgcaagagggacagagtgtcctggcacctgattggcctgggcacagacacagacatgcatggaattgtgttccagggcaacaccatccacctgcggggcacccaccgggacagcctggccctcttcccccacatggccaccacagccttcatgcagcctgaccatgctggcatcttccgggtcttctgtgccaccatgccccacctgagccggggcatgggccagatctatgaggtgagcagctgtgacaacagagaccccagcgagcagagatatggcatgatccgcaccttctacatcgctgctgaggaggtggagtgggactatgcccccaacaagaactgggagtttgagaagcagcacgtggatgcccggggggagcggcacggggacatcttcatgaacagaacagagaactggattggcagccagtacaagaaggtggtgtaccgggagtacacagatggagaatttgtggagatcaaggcccggcccccccgggaggagcacctggagctgctgggccccatgattcatgctgaggtgggcaacacagtgctgatcatcttcaagaacaaggccagccggccctacagcatcagcgcccagggcgtggaggagatggattctgggaagcagttccaggtgcccatgaccaagccaggagaggtgaagacctaccgctggaacatccccaagaggagcggccctggccccagcgaccccaactgcatcccctgggtgtactacagcacagtgaactttgtgaaggacacctacagcggcctgatgggccccctcatcacctgcaggaaaggagtgctgaatgaaaaaggaagaagaagtgatgtggactatgaatttgccctgctcttcctggtgttcaatgaaaatgaatcctggtacctggatgacaacatcaagaagtacctgaacaaggacccccgggacttcaagaggacagatgactttgaggagagcaacaggatgcacgccatcaatggcaagatctttggaaacctgcacggcctcatcatgaatgaagacaccatgaccaactggtacctgctgggcatcggcagcgaggtggacatccacaccatccactaccacgccgagagcttcctgttcaagattgacaagagctaccgggaggatgtgtatgacctcttccctggcaccttccagaccatcgagctgtttgctgaccaccctggcacctggctgctgcactgccacgtgtctgaccacatccatgctggcatggagaccacctacacagtgctgagaaatattgacaaccgcatcccctacagcaccaccagccctggggtggccagccacccagccaccgtgcccagcaatgaaagacctgggaaggagcagctgtacttcttcggcaagaacctgggccccaccggggccaaggccgccctggtgatcctcttcatcatcggcctgctgctgctgatcaccaccgtcatcctgagcctgcggctgtgcagcgccatgaagcagacagactaccagcaggtgcagagctgtgccctgcccacagatgccctgtag

SEQ ID NO: 34733 - DNA, 1221 bp, Artificial Sequence
  Description of Artificial Sequence: Synthetic coding sequence
atggaccagagcggcatggagatccctgtgaccctcatcatcaaggcccccaaccagaagtacagcgaccagaccatcagctgcttcctgaactggacagtgggcaagctgaagacccacctgagcaatgtgtaccccagcaagcccctgaccaaggaccagaggctggtgtacagcggccgcctgctgcctgaccacctgcagctgaaggacatcctgaggaagcaggatgagtaccacatggtgcacctggtgtgcaccagcaggaccccacccagcagccccaagagcagcaccaaccgggagagccatgaggccctggccagcagcagcaacagcagcagtgaccacagcggcagcaccacccccagcagcggccaggagaccctgagcctggccgtgggcagcagcagcgagggcctgcggcagaggaccctgccccaggcccagacagaccaggcccagagccaccagttcccctacgtgatgcagggcaatgtggacaaccagtttcctggccaggccgcccctcctggcttccctgtgtacccagccttcagccccctgcagatgctgtggtggcagcagatgtatgcccaccagtactacatgcagtaccaggccgctgtgtctgcccaggccaccagcaatgtgaaccccacccagcccaccaccagccagcccctgaacctggcccacgtgcctggagaggagcccccaccagcccccaacctggtggcccaggagaaccggcccatgaatgaaaatgtgcagatgaatgcccagggcggccctgtgctgaatgaggaggacttcaacagagactggctggactggatgtacaccttcagccgggccgccatcctgctgagcatcgtgtacttctacagcagcttcagccgcttcatcatggtgatgggcgccatgctgctggtgtacctgcaccaggccggctggttccccttccggcaggagggcggccaccagcaggcccccaacaacaatgctgaggtgaacaatgatggccagaatgccaacaacctggagctggaggagatggagcggctgatggatgatggcctggaggatgaaagtggagaagatggaggagaagatgccagcgccatccagaggcctggcctgatggccagcgcctggagcttcatcaccaccttcttcaccagcctcatccctgagggccccccccaggtggccaactag

SEQ ID NO: 34734 - DNA, 1221 bp, Artificial Sequence; identical to SEQ ID NO: 34733
  Description of Artificial Sequence: Synthetic coding sequence

SEQ ID NO: 34735 - DNA, 1245 bp, Artificial Sequence
  Description of Artificial Sequence: Synthetic coding sequence
atgaaggcccagacagccctgtccttcttcctgatcctgatcaccagcctgagcggcagccagggcatcttccccctggccttcttcatctacgtgcccatgaatgagcagatcgtcatcggccgcctggatgaggacatcatcctgcccagcagctttgagcggggcagcgaggtggtgatccactggaagtaccaggacagctacaaggtgcacagctactacaagggcagtgaccacctggagagccaggaccccaggtatgccaacagaaccagcctcttctacaatgagatccagaatggaaatgccagcctcttcttcagaagagtgtccctgctggatgagggcatctacacctgctacgtgggcacagccatccaggtgatcaccaacaaggtggtgctgaaggtgggcgtcttcctgacccctgtgatgaagtatgagaagaggaacaccaacagcttcctgatctgcagcgtgctgtctgtgtacccccggcccatcatcacctggaagatggacaacacccccatcagcgagaacaacatggaggagaccggcagcctggacagcttcagcatcaacagccccctgaacatcaccggcagcaacagcagctatgaatgtaccatcgagaacagcctgctgaagcagacctggacaggccgctggaccatgaaggatggcctgcacaagatgcagagcgagcacgtgtccctgagctgccagcctgtgaatgactacttcagccccaaccaggacttcaaggtgacctggagcaggatgaagagcggcaccttctctgtgctggcctactacctgagcagcagccagaacaccatcatcaatgaaagccgcttctcctggaacaaggagctgatcaaccagagcgacttctccatgaacctgatggacctgaacctgagtgacagcggggagtacctgtgcaacatcagcagtgatgagtacaccctgctgaccatccacacagtgcacgtggagcccagccaggagacagccagccacaacaagggcctgtggatcctggtgcccagcgccatcctggccgccttcctgctgatctggagcgtgaagtgctgccgggcccagctggaggcccggcgcagccgccacccagcagatggagcccagcaggagcgctgctgcgtgcccccaggagagcgctgccccagcgccccagacaatggagaggagaatgtgcccctgagcggcaaggtgtag

SEQ ID NO: 34736 - DNA, 294 bp, Artificial Sequence
  Description of Artificial Sequence: Synthetic coding sequence
atgaaggcccagacagccctgtccttcttcctgatcctgatcaccagcctgagcggcagccagggcatcttccccctggccttcttcatctacgtgcccatgaatgagcagatcgtcatcggccgcctggatgaggacatcatcctgcccagcagctttgagcggggcagcgaggtggtgatccactggaagtaccaggacagctacaaggtgcacagctactacaagggcagtgaccacctggagagccaggaccccaggtatgccaacagaaccagcctcttctacaactag

SEQ ID NO: 34737 - DNA, 438 bp, Artificial Sequence
  Description of Artificial Sequence: Synthetic coding sequence
atgaaggcccagacagccctgtccttcttcctgatcctgatcaccagcctgagcggcagccagggcatcttccccctggccttcttcatctacgtgcccatgaatgagcagatcgtcatcggccgcctggatgaggacatcatcctgcccagcagctttgagcggggcagcgaggtggtgatccactggaagtaccaggacagctacaaggtgcacagctactacaagggcagtgaccacctggagagccaggaccccaggtatgccaacagaaccagcctcttctacaatgagatccagaatggaaatgccagcctcttcttcagaagagtgtccctgctggatgagggcatctacacctgctacgtgggcacagccatccaggtgatcaccaacaaggtggtgctgaaggtgggcgtcttcctgacccctgtgtag

SEQ ID NO: 34738 - DNA, 1245 bp, Artificial Sequence; identical to SEQ ID NO: 34735
  Description of Artificial Sequence: Synthetic coding sequence

SEQ ID NO: 34739 - DNA, 411 bp, Artificial Sequence
  Description of Artificial Sequence: Synthetic coding sequence
atgaaggcccagacagccctgtccttcttcctgatcctgatcaccagcctgagcggcagccagggcatcttccccctggccttcttcatctacgtgcccatgaatgagcagatcgtcatcggccgcctggatgaggacatcatcctgcccagcagctttgagcggggcagcgaggtggtgatccactggaagtaccaggacagctacaaggtgcacagctactacaagggcagtgaccacctggagagccaggaccccaggtatgccaacagaaccagcctcttctacaatgagatccagaatggaaatgccagcctcttcttcagaagagtgtccctgctggatgagggcatctacacctgctacgtgggcacagccatccaggtgatcaccaacaaggtggtgctgtag

SEQ ID NO: 34740 - DNA, 1245 bp, Artificial Sequence; identical to SEQ ID NO: 34735
  Description of Artificial Sequence: Synthetic coding sequence

SEQ ID NO: 34741 - DNA, 2193 bp, Artificial Sequence
  Description of Artificial Sequence: Synthetic coding sequence
atggctgctggggtggaggccgctgctgaggtggccgccacagagatcaagatggaggaggagagcggggcccctggggtgcccagcggaaatggagcccctggccccaagggggagggggagaggcctgcccagaatgagaagaggaaggagaagaacatcaagagaggaggcaacagatttgagccctatgccaaccccaccaagcgctaccgggccttcatcaccaacatcccctttgatgtgaagtggcagagcctgaaggacctggtgaaggagaaggtgggggaggtgacctacgtggagctgctgatggatgctgagggcaagagccggggctgtgctgtggtggagttcaagatggaggagagcatgaagaaggctgctgaggtgctgaacaagcacagcctgagcggccggcccctgaaggtgaaggaggaccctgatggagagcacgcccggcgggccatgcagaaggtgatggccaccaccggcggcatgggcatgggccctgggggccctggcatgatcaccatcccccccagcatcctgaacaaccccaacatccccaatgagatcatccacgccctgcaggccggccgcctgggcagcacagtgtttgtggccaacctggactacaaggtgggctggaagaagctgaaggaggtgttctccatggccggcgtggtggtgcgggctgacatcctggaggacaaggatggcaagagccggggcatcggcaccgtgacctttgagcagagcattgaagctgtgcaggccatctccatgtttaatggccagctgctgtttgaccggcccatgcacgtgaagatggatgagcgggccctgcccaagggggacttcttccccccagagcggccccagcagctgccccacggcctgggcggcatcggcatgggcctgggccctgggggccagcccattgatgccaaccacctgaacaagggcatcggcatgggcaacatcggccctgctggcatgggcatggagggcattggatttggcatcaacaagatgggcggcatggagggcccctttggaggcggcatggagaacatgggccgctttggaagtggcatgaacatgggccgcatcaatgagatcctgagcaatgccctgaagagaggagagatcatcgccaagcagggcggcggcggcggcggcggctctgtgcccggcattgaaagaatgggccctggcatcgaccggctgggcggggccggcatggagaggatgggcgccggcctgggccacggcatggacagagtgggcagcgagattgaaagaatgggcctggtgatggacaggatgggctctgtggagaggatgggcagcggcatcgagaggatgggccccctgggcctggaccacatggccagcagcattgaaagaatgggccagaccatggagagaattggcagcggcgtggagaggatgggcgccggcatgggcttcggcctggagaggatggccgcccccatcgacagagtgggccagaccatcgagaggatgggcagcggcgtggagaggatgggccctgccatcgagaggatgggcctgtccatggagaggatggtgcctgctggcatgggcgccggcctggagaggatgggccctgtgatggacaggatggccaccggcctggagaggatgggcgccaacaacctggagaggatgggcctggagaggatgggcgccaacagcctggagaggatgggcctggagaggatgggcgccaacagcctggagaggatgggccctgccatgggccctgccctgggcgccggcatcgagaggatgggcctggccatgggcggcggcggcggggccagctttgaccgggccatcgagatggagcggggcaactttggaggcagctttgctggcagctttggaggagctgggggccacgcccctggggtggccaggaaggcctgccagatctttgtgaggaacctgccctttgacttcacctggaagatgctgaaggacaagttcaatgaatgtggccacgtgctgtatgctgacatcaagatggagaatggcaagagcaagggctgcggcgtggtgaagtttgagagccctgaggtggccgagcgggcctgcaggatgatgaatggcatgaagctgagcggccgggagattgatgtgagaattgacagaaatgcctag

SEQ ID NO: 34742 - DNA, 2076 bp, Artificial Sequence
  Description of Artificial Sequence: Synthetic coding sequence
atggctgctggggtggaggccgctgctgaggtggccgccacagagatcaagatggaggaggagagcggggcccctggggtgcccagcggaaatggagcccctggccccaagggggagggggagaggcctgcccagaatgagaagaggaaggagaagaacatcaagagaggaggcaacagatttgagccctatgccaaccccaccaagcgctaccgggccttcatcaccaacatcccctttgatgtgaagtggcagagcctgaaggacctggtgaaggagaaggtgggggaggtgacctacgtggagctgctgatggatgctgagggcaagagccggggctgtgctgtggtggagttcaagatggaggagagcatgaagaaggctgctgaggtgctgaacaagcacagcctgagcggccggcccctgaaggtgaaggaggaccctgatggagagcacgcccggcgggccatgcagaaggccggccgcctgggcagcacagtgtttgtggccaacctggactacaaggtgggctggaagaagctgaaggaggtgttctccatggccggcgtggtggtgcgggctgacatcctggaggacaaggatggcaagagccggggcattggaacagtgacctttgagcagagcattgaggccgtgcaggccatctccatgttcaacggccagctgctgtttgaccggcccatgcacgtgaagatggatgagcgggccctgcccaagggggacttcttccccccagagcggccccagcagctgccccacggcctgggcggcatcggcatgggcctgggccctgggggccagcccattgatgccaaccacctgaacaagggcatcggcatgggcaacatcggccctgctggcatgggcatggagggcatcggcttcggcatcaacaagatgggcggcatggagggcccctttggaggcggcatggagaacatgggccgcttcggcagcggcatgaacatgggccgcatcaatgagatcctgagcaatgccctgaagagaggagagatcatcgccaagcagggcggcggcggcggcggcggctctgtgcccggcatcgagaggatgggccctggcatcgaccggctgggcggggccggcatggagaggatgggcgccggcctgggccacggcatggacagagtgggcagcgagattgaaagaatgggcctggtgatggacaggatgggctctgtggagaggatgggcagcggcattgaaagaatgggccccctgggcctggaccacatggccagcagcattgaaagaatgggccagaccatggagcgcatcggcagcggcgtggagaggatgggcgccggcatgggcttcggcctggagaggatggccgcccccatcgacagagtgggccagaccattgaaagaatgggcagcggcgtggagaggatgggccctgccattgaaagaatgggcctgtccatggagaggatggtgcctgctggcatgggcgccggcctggagaggatgggccctgtgatggacaggatggccaccggcctggagaggatgggcgccaacaacctggagaggatgggcctggagaggatgggcgccaacagcctggagaggatgggcctggagaggatgggcgccaacagcctggagaggatgggccctgccatgggccctgccctgggcgccggcattgaaagaatgggcctggccatgggcggcggcggcggggccagctttgaccgggccatcgagatggagcggggcaactttggaggcagctttgctggcagctttggaggagctgggggccacgcccctggggtggccaggaaggcctgccagatctttgtgaggaacctgccctttgacttcacctggaagatgctgaaggacaagttcaatgaatgtggccacgtgctgtatgctgacatcaagatggagaatggcaagagcaagggctgcggcgtggtgaagtttgagagccctgaggtggccgagcgggcctgcaggatgatgaatggcatgaagctgagcggccgggagattgatgtgagaattgacagaaatgcctag

SEQ ID NO: 34743 - DNA, 864 bp, Artificial Sequence
  Description of Artificial Sequence: Synthetic coding sequence
atgggctctgtggagaggatgggcagcggcattgaaagaatgggccccctgggcctggaccacatggccagcagcattgaaagaatgggccagaccatggagcgcatcggcagcggcgtggagaggatgggcgccggcatgggcttcggcctggagaggatggccgcccccatcgacagagtgggccagaccattgaaagaatgggcagcggcgtggagaggatgggccctgccattgaaagaatgggcctgtccatggagaggatggtgcctgctggcatgggcgccggcctggagaggatgggccctgtgatggacaggatggccaccggcctggagaggatgggcgccaacaacctggagaggatgggcctggagaggatgggcgccaacagcctggagaggatgggcctggagaggatgggcgccaacagcctggagaggatgggccctgccatgggccctgccctgggcgccggcattgaaagaatgggcctggccatgggcggcggcggcggggccagctttgaccgggccatcgagatggagcggggcaactttggaggcagctttgctggcagctttggaggagctgggggccacgcccctggggtggccaggaaggcctgccagatctttgtgaggaacctgccctttgacttcacctggaagatgctgaaggacaagttcaatgaatgtggccacgtgctgtatgctgacatcaagatggagaatggcaagagcaagggctgcggcgtggtgaagtttgagagccctgaggtggccgagcgggcctgcaggatgatgaatggcatgaagctgagcggccgggagattgatgtgagaattgacagaaatgcctag

SEQ ID NO: 34744 - DNA, 1848 bp, Artificial Sequence
  Description of Artificial Sequence: Synthetic coding sequence
aatggcagccacctgaagacctggctgaagaagaagggctgtgctgtggtggagttcaagatggaggagagcatgaagaaggctgctgaggtgctgaacaagcacagcctgagcggccggcccctgaaggtgaaggaggaccctgatggagagcacgcccggcgggccatgcagaaggtgatggccaccaccggcggcatgggcatgggccctgggggccctggcatgatcaccatcccccccagcatcctgaacaaccccaacatccccaatgagatcatccacgccctgcaggccggccgcctgggcagcacagtgtttgtggccaacctggactacaaggtgggctggaagaagctgaaggaggtgttctccatggccggcgtggtggtgcgggctgacatcctggaggacaaggatggcaagagccggggcatcggcaccgtgacctttgagcagagcattgaagctgtgcaggccatctccatgtttaatggccagctgctgtttgaccggcccatgcacgtgaagatggatgagcgggccctgcccaagggggacttcttccccccagagcggccccagcagctgccccacggcctgggcggcatcggcatgggcctgggccctgggggccagcccattgatgccaaccacctgaacaagggcatcggcatgggcaacatcggccctgctggcatggagggcccctttggaggcggcatggagaacatgggccgcttcggcagcggcatgaacatgggccgcatcaatgagatcctgagcaatgccctgaagagaggagagatcatcgccaagcagggcggcggcggcggcggcggctctgtgcccggcatcgagaggatgggccctggcatcgaccggctgggcggggccggcatggagaggatgggcgccggcctgggccacggcatggacagagtgggcagcgagattgaaagaatgggcctggtgatggacaggatgggctctgtggagaggatgggcagcggcattgaaagaatgggccccctgggcctggaccacatggccagcagcattgaaagaatgggccagaccatggagcgcatcggcagcggcgtggagaggatgggcgccggcatgggcttcggcctggagaggatggccgcccccatcgacagagtgggccagaccattgaaagaatgggcagcggcgtggagaggatgggccctgccattgaaagaatgggcctgtccatggagaggatggtgcctgctggcatgggcgccggcctggagaggatgggccctgtgatggacaggatggccaccggcctggagaggatgggcgccaacaacctggagaggatgggcctggagaggatgggcgccaacagcctggagaggatgggcctggagaggatgggcgccaacagcctggagaggatgggccctgccatgggccctgccctgggcgccggcattgaaagaatgggcctggccatgggcggcggcggcggggccagctttgaccgggccatcgagatggagcggggcaactttggaggcagctttgctggcagctttggaggagctgggggccacgcccctggggtggccaggaaggcctgccagatctttgtgaggaacctgccctttgacttcacctggaagatgctgaaggacaagttcaatgaatgtggccacgtgctgtatgctgacatcaagatggagaatggcaagagcaagggctgcggcgtggtgaagtttgagagccctgaggtggccgagcgggcctgcaggatgatgaatggcatgaagctgagcggccgggagattgatgtgagaattgacagaaatgcctag

SEQ ID NO: 34745 - DNA, 2754 bp, Artificial Sequence
  Description of Artificial Sequence: Synthetic coding sequence
atgtttgctgtgcacctgatggccttctacttcagcaagctgaaggaggaccagatcaagaaggtggaccgcttcctgtaccacatgaggctgagtgatgacaccctgctggacatcatgaggcgcttccgggcagagatggagaagggcctggccaaggacaccaaccccacagctgctgtgaagatgctgcccacctttgtgcgggccatcccagatggctctgaaaatggagagttcctgagcctggacctgggcggcagcaagttccgggtgctgaaggtgcaggtggccgaggagggcaagagacatgtgcagatggagagccagttctaccccaccccaaatgagatcatcagaggaaatggaacagagctgtttgaatatgtggccgactgcctggccgacttcatgaagaccaaggacctgaagcacaagaagctgcccctgggcctgaccttctccttcccctgccggcagaccaagctggaggagggcgtgctgctgtcctggaccaagaagttcaaggcccggggcgtgcaggacacagatgtggtgtcccggctgaccaaggccatgaggaggcacaaggacatggatgtggacatcctggccctggtgaatgacacagtgggcaccatgatgacctgtgcctatgatgacccctactgtgaggtgggcgtcatcatcggcaccggcaccaatgcctgctacatggaggacatgagcaacatcgacctggtggagggagatgagggccgcatgtgcatcaacacagagtggggcgcctttggagatgatggagccctggaggacatcagaacagaatttgaccgggagctggacctgggcagcctgaaccctgggaagcagctgtttgagaagatgatcagcggcctgtacctgggggagctggtgcggctcatcctgctgaagatggccaaggccggcctgctgtttggaggagagaagagcagcgccctgcacaccaagggcaagattgagaccaggcatgtggccgccatggagaagtacaaggagggcctggccaacacccgggagatcctggtggacctgggcctggagcccagcgaggccgactgcatcgctgtgcagcacgtgtgcaccatcgtgtccttccgcagcgccaacctgtgtgccgccgccctggccgccatcctgacccggctgcgggagaacaagaaggtggagcggctgcggaccaccgtgggcatggatggcaccctgtacaagatccacccccagtaccccaagaggctgcacaaggtggtgaggaagctggtgcccagctgtgatgtgcgcttcctgctgtctgagagcggcagcaccaagggagctgccatggtgacagctgtggccagccgggtgcaggcccagaggaagcagattgacagagtgctggccctcttccagctgacccgggagcagctggtggatgtgcaggccaagatgagagctgagctggagtatggcctgaagaagaagagccacggcctggccaccgtgaggatgctgcccacctacgtgtgtggcctgcctgatggaacagagaagggcaagttcctggccctggacctgggcggcaccaacttccgggtgctgctggtgaagatccgctctggaagaagatctgtgaggatgtacaacaagatctttgccatccccctggagatcatgcagggcactggagaggagctgtttgaccacatcgtgcagtgcatcgctgacttcctggactacatgggcctgaagggggccagcctgcccctgggcttcaccttctccttcccctgccggcagatgagcattgacaagggcaccctcatcggctggaccaagggcttcaaggccacagactgtgagggggaggatgtggtggacatgctgcgggaggccatcaagagaagaaatgaatttgacctggacatcgtggccgtggtgaatgacacagtgggcaccatgatgacctgtggctatgaggaccccaactgtgaaattggcctgattgctggcaccggcagcaacatgtgctacatggaggacatgaggaacatcgagatggtggagggcggggagggcaagatgtgcatcaacacagagtggggcggctttggagacaatggctgcattgatgacatctggaccaggtatgacacagaggtggatgagggcagcctgaaccctgggaagcagagatatgagaagatgaccagcggcatgtacctgggggagatcgtgcggcagatcctgattgacctgaccaagcagggcctgctcttccggggccagatcagcgagcggctgcggacccggggcatctttgagaccaagttcctgagccagattgaaagtgaccggctggccctgctgcaggtgcggcgcatcctgcagcagctgggcctggacagcacctgtgaagattccatcgtggtgaaggaggtgtgtggggctgtgtccagaagagctgcccagctgtgtggggccggcctggccgccatcgtggagaagaggcgggaggaccagggcctggagcacctgcgcatcaccgtgggcgtggatggcaccctgtacaagctgcacccccacttcagccgcatcctgcaggagaccgtgaaggagctggccccccgctgtgatgtgaccttcatgctgtctgaagatggcagcggcaagggggccgccctgatcacagctgtggccaagaggctgcagcaggcccagaaggagaactag

SEQ ID NO: 34746 - DNA, 2421 bp, Artificial Sequence
  Description of Artificial Sequence: Synthetic coding sequence
atgtttgctgtgcacctgatggccttctacttcagcaagctgaaggaggaccagatcaagaaggtggaccgcttcctgtaccacatgaggctgagtgatgacaccctgctggacatcatgaggcgcttccgggcagagatggagaagggcctggccaaggacaccaaccccacagctgctgtgaagatgctgcccacctttgtgcgggccatcccagatggctctgaaaatggagagttcctgagcctggacctgggcggcagcaagttccgggtgctgaaggtgcaggtggccgaggagggcaagagacatgtgcagatggagagccagttctaccccaccccaaatgagatcatcagaggaaatggaacagagctgtttgaatatgtggccgactgcctggccgacttcatgaagaccaaggacctgaagcacaagaagctgcccctgggcctgaccttctccttcccctgccggcagaccaagctggaggagggcgtgctgctgtcctggaccaagaagttcaaggcccggggcgtgcaggacacagatgtggtgtcccggctgaccaaggccatgaggaggcacaaggacatggatgtggacatcctggccctggtgaatgacacagtgggcaccatgatgacctgtgcctatgatgacccctactgtgaggtgggcgtcatcatcggcaccggcaccaatgcctgctacatggaggacatgagcaacatcgacctggtggagggagatgagggccgcatgtgcatcaacacagagtggggcgcctttggagatgatggagccctggaggacatcagaacagaatttgaccgggagctggacctgggcagcctgaaccctgggaagcagctgtttgagaagatgatcagcggcctgtacctgggggagctggtgcggctcatcctgctgaagatggccaaggccggcctgctgtttggaggagagaagagcagcgccctgcacaccaagggcaagattgagaccaggcatgtggccgccatggagaagtacaaggagggcctggccaacacccgggagatcctggtggacctgggcctggagcccagcgaggccgactgcatcgctgtgcagcacgtgtgcaccatcgtgtccttccgcagcgccaacctgtgtgccgccgccctggccgccatcctgacccggctgcgggagaacaagaaggtggagcggctgcggaccaccgtgggcatggatggcaccctgtacaagatccacccccagtaccccaagaggctgcacaaggtggtgaggaagctggtgcccagctgtgatgtgcgcttcctgctgtctgagagcggcagcaccaagggagctgccatggtgacagctgtggccagccgggtgcaggcccagaggaagcagattgacagagtgctggccctcttccagctgacccgggagcagctggtggatgtgcaggccaagatgagagctgagctggagtatggcctgaagaagaagagccacggcctggccaccgtgaggatgctgcccacctacgtgtgtggcctgcctgatggaacagagaagggcaagttcctggccctggacctgggcggcaccaacttccgggtgctgctggtgaagatccgctctggaagaagatctgtgaggatgtacaacaagatctttgccatccccctggagatcatgcagggcactggagaggagctgtttgaccacatcgtgcagtgcatcgctgacttcctggactacatgggcctgaagggggccagcctgcccctgggcttcaccttctccttcccctgccggcagatgagcattgacaagggcaccctcatcggctggaccaagggcttcaaggccacagactgtgagggggaggatgtggtggacatgctgcgggaggccatcaagagaagaaatgaatttgacctggacatcgtggccgtggtgaatgacacagtgggcaccatgatgacctgtggctatgaggaccccaactgtgaaattggcctgattgctggcaccggcagcaacatgtgctacatggaggacatgaggaacatcgagatggtggagggcggggagggcaagatgtgcatcaacacagagtggggcggctttggagacaatggctgcattgatgacatctggaccaggtatgacacagaggtggatgagggcagcctgaaccctgggaagcagagatatgagaagatgaccagcggcatgtacctgggggagatcgtgcggcagatcctgattgacctgaccaagcagggcctgctcttccggggccagatcagcgagcggctgcggacccggggcatctttgagaccaagttcctgagccagattgaaagaatgctgtctgtgattgatgcctactgcctggacctgctcttccactag

SEQ ID NO: 34747 - DNA, 2211 bp, Artificial Sequence
  Description of Artificial Sequence: Synthetic coding sequence
atgtttgctgtgcacctgatggccttctacttcagcaagctgaaggaggaccagatcaagaaggtggaccgcttcctgtaccacatgaggctgagtgatgacaccctgctggacatcatgaggcgcttccgggcagagatggagaagggcctggccaaggacaccaaccccacagctgctgtgaagatgctgcccacctttgtgcgggccatcccagatggctctgaaaatggagagttcctgagcctggacctgggcggcagcaagttccgggtgctgaaggtgcaggtggccgaggagggcaagagacatgtgcagatggagagccagttctaccccaccccaaatgagatcatcagaggaaatggaacagagctgtttgaatatgtggccgactgcctggccgacttcatgaagaccaaggacctgaagcacaagaagctgcccctgggcctgaccttctccttcccctgccggcagaccaagctggaggagggcgtgctgctgtcctggaccaagaagttcaaggcccggggcgtgcaggacacagatgtggtgtcccggctgaccaaggccatgaggaggcacaaggacatggatgtggacatcctggccctggtgaatgacacagtgggcaccatgatgacctgtgcctatgatgacccctactgtgaggtgggcgtcatcatcggcaccggcaccaatgcctgctacatggaggacatgagcaacatcgacctggtggagggagatgagggccgcatgtgcatcaacacagagtggggcgcctttggagatgatggagccctggaggacatcagaacagaatttgaccgggagctggacctgggcagcctgaaccctgggaagcagctgtttgagaagatgatcagcggcctgtacctgggggagctggtgcggctcatcctgctgaagatggccaaggccggcctgctgtttggaggagagaagagcagcgccctgcacaccaagggcaagattgagaccaggcatgtggccgccatggagaagtacaaggagggcctggccaacacccgggagatcctggtggacctgggcctggagcccagcgaggccgactgcatcgctgtgcagcacgtgtgcaccatcgtgtccttccgcagcgccaacctgtgtgccgccgccctggccgccatcctgacccggctgcgggagaacaagaaggtggagcggctgcggaccaccgtgggcatggatggcaccctgtacaagatccacccccagtaccccaagaggctgcacaaggtggtgaggaagctggtgcccagctgtgatgtgcgcttcctgctgtctgagagcggcagcaccaagggagctgccatggtgacagctgtggccagccgggtgcaggcccagaggaagcagattgacagagtgctggccctcttccagctgacccgggagcagctggtggatgtgcaggccaagatgagagctgagctggagtatggcctgaagaagaagagccacggcctggccaccgtgaggatgctgcccacctacgtgtgtggcctgcctgatggaacagagaagggcaagttcctggccctggacctgggcggcaccaacttccgggtgctgctggtgaagatccgctctggaagaagatctgtgaggatgtacaacaagatctttgccatccccctggagatcatgcagggcactggagaggagctgtttgaccacatcgtgcagtgcatcgctgacttcctggactacatgggcctgaagggggccagcctgcccctgggcttcaccttctccttcccctgccggcagatgagcattgacaagggcaccctcatcggctggaccaagggcttcaaggccacagactgtgagggggaggatgtggtggacatgctgcgggaggccatcaagagaagaaatgaatttgacctggacatcgtggccgtggtgaatgacacagtgggcaccatgatgacctgtggctatgaggaccccaactgtgaaattggcctgattgctggcaccggcagcaacatgtgctacatggaggacatgaggaacatcgagatggtggagggcggggagggcaagatgtgcatctgcttctccttctgcctgtggtttgtgctgcaggtgctgattgtggtgctgagaattgtgcgctacaggaagagcagcaagctgatcaagaagttctag

SEQ ID NO: 34748 - DNA, 282 bp, Artificial Sequence
  Description of Artificial Sequence: Synthetic coding sequence
atgagcacagacacaggagtgtccctgcccagctatgaggaggaccagggcagcaagctgatcaggaaggccaaggaggccccctttgtgcctgtgggcattgctggctttgctgccatcgtggcctacggcctgtacaagctgaagagccggggcaacaccaagatgagcatccacctgatccacatgagggtggccgcccagggctttgtggtgggcgccatgacagtgggcatgggctacagcatgtaccgggagttctgggccaagcccaagccctag

SEQ ID NO: 34749 - DNA, 282 bp, Artificial Sequence; identical to SEQ ID NO: 34748
  Description of Artificial Sequence: Synthetic coding sequence

SEQ ID NO: 34750 - DNA, 324 bp, Artificial Sequence
  Description of Artificial Sequence: Synthetic coding sequence
atggagcagaagctggtggaggagatcctgcaggccatcaccatgagcacagacacaggagtgtccctgcccagctatgaggaggaccagggcagcaagctgatcaggaaggccaaggaggccccctttgtgcctgtgggcattgctggctttgctgccatcgtggcctacggcctgtacaagctgaagagccggggcaacaccaagatgagcatccacctgatccacatgagggtggccgcccagggctttgtggtgggcgccatgacagtgggcatgggctacagcatgtaccgggagttctgggccaagcccaagccctag

SEQ ID NO: 34751 - DNA, 300 bp, Artificial Sequence
  Description of Artificial Sequence: Synthetic coding sequence
atgtctgccaacagacgctggtgggtgcccccagatgatgaggactgtgtgtctgagaagctgctgaggaagacccgggagagccccctggtgcccatcggcctgggcggctgcctggtggtggccgcctaccgcatctaccgcctgcggagccggggcagcaccaagatgagcatccacctgatccacaccagggtggccgcccaggcctgtgctgtgggcgccatcatgctgggcgctgtgtacaccatgtacagcgactatgtgaagaggatggcccaggatgctggggagaagtag

SEQ ID NO: 34752 - DNA, 321 bp, Artificial Sequence
  Description of Artificial Sequence: Synthetic coding sequence
atggccaccccaggccctgtgattcctgaggtgccctttgagcccagcaagccccctgtgattgagggcctgagccccaccgtgtacagaaatcctgagagcttcaaggagaagtttgtgaggaagaccagagaaaatcctgtggtgcccatcggctgcctggccacagctgctgccctgacctacggcctgtacagcttccaccggggcaacagccagaggagccagctgatgatgaggaccagaattgctgcccagggcttcaccgtggccgccatcctgctgggcctggccgtgacagccatgaagagccggccctag

SEQ ID NO: 34753 - DNA, 321 bp, Artificial Sequence
  Description of Artificial Sequence: Synthetic coding sequence
atggccaccctgggctttgtgaccccagaggccccctttgagagcagcaagccacccatctttgagggcctgagccccaccgtgtacagcaaccctgagggcttcaaggagaagttcctgaggaagaccagagaaaatcctgtggtgcccatcggcttcctgtgcacagctgctgtgctgaccaacggcctgtactgcttccaccagggcaacagccagtgcagccggctgatgatgcacacccagattgctgcccagggcttcaccatcgccgccatcctgctgggcctggccgccacagccatgaagagccccccatag

SEQ ID NO: 34754 - DNA, 1473 bp, Artificial Sequence
  Description of Artificial Sequence: Synthetic coding sequence
atgacccagggcaagaagaagaagagagctgccaacagaagcatcatgctggccaagaagatcatcatcaaggatggcggcaccccccagggcatcggcagccccagcgtgtaccacgccgtcatcgtcatcttcctggagttctttgcctggggcctgctgacagcccccaccctggtggtgctgcacgagaccttccccaagcacaccttcctgatgaatggcctcatccagggcgtgaagggcctgctgtccttcctgagcgcccccctcatcggggccctgagtgatgtgtggggcaggaagagcttcctgctgctgaccgtcttcttcacctgtgcccccatccccctgatgaagatcagcccctggtggtactttgctgtgatctctgtgtctggagtgtttgctgtgaccttctctgtggtgtttgcctacgtggccgacatcacccaggagcacgagaggtccatggcctacggcctggtgtctgccacctttgctgccagcctggtgaccagccctgccatcggggcctacctgggccgggtgtatggagacagcctggtggtggtgctggccacagccatcgccctgctggacatctgcttcatcctggtggccgtgcctgagagcctgcctgagaagatgaggcctgcctcctggggcgcccccatctcctgggagcaggccgacccctttgccagcctgaagaaggtgggccaggacagcatcgtgctgctgatctgcatcaccgtcttcctgagctacctgcctgaggccggccagtacagcagcttcttcctgtacctgcggcagatcatgaagttcagccctgagagcgtggccgccttcatcgctgtgctgggcatcctgagcatcatcgcccagaccatcgtgctgagcctgctgatgaggagcatcggcaacaagaacaccatcctgctgggcctgggcttccagatcctgcagctggcctggtacggcttcggcagcgagccctggatgatgtgggccgccggggctgtggccgccatgagcagcatcaccttccctgctgtgtctgccctggtgtccaggacagcagatgctgaccagcagggcgtggtgcagggcatgatcaccggcatccggggcctgtgcaatggcctgggccctgccctgtatggcttcatcttctacatcttccacgtggagctgaaggagctgcccatcaccggcacagacctgggcaccaacaccagcccccagcaccactttgagcagaacagcatcatccctggcccccccttcctgtttggagcctgcagcgtgctgctggccctgctggtggccctcttcatccctgagcacaccaacctgagcctgcggagcagctcctggaggaagcactgcggcagccacagccacccccacaacacccaggcccctggagaggccaaggagcccctgctgcaggacaccaacgtgtag

SEQ ID NO: 34755 - DNA, 363 bp, Artificial Sequence
  Description of Artificial Sequence: Synthetic coding sequence
tgacatgagaccttccccaagcacaccttcctgatgaatggcctcatccagggcgtgaagggcctgctgtccttcctgagcgcccccctgattggagccctgagtgatgtgtggggcaggaagagcttcctgctgctgactgtgttcttcacctgtgcccccatccccctgatgaagatcagcccctggtggtactttgctgtgatctctgtgtctggagtgtttgctgtgaccttctctgtggtgtttgcctacgtggccgacatcacccaggagcacgagaggtccatggcctacggcctggtgtgcatgttcatcctgtacctgctgtacctgctgagaaatgccctcttcctgaggtag

SEQ ID NO: 34756 - DNA, 462 bp, Artificial Sequence
  Description of Artificial Sequence: Synthetic coding sequence
atggtgggcatcctgagcatcgtggcccagacagccttcctgagcatcctgatgaggagcctgggcaacaagaacacagtgctgctgggcctgggcttccagatgctgcagctggcctggtacggcttcggcagccaggcctggatgatgtgggccgccggcaccgtggccgccatgagcagcatcaccttccctgccatcagcgccctggtgtccagaaatgctgagagtgaccagcagggcgtggcccaggaccacaactggaacaagaggaccatgcagtggccaggggccctgtatggcttcatcttctacatgttccacgtggagctgacagagctgggccccaagctgaacagcaacaacgtgcccctgcagggcagctgccaccccaggcctgctgtgttcatctggggcatgtacagcccctacgtgttttctggctgcctgatccacagctag

SEQ ID NO: 34757 - DNA, 1521 bp, Artificial Sequence
  Description of Artificial Sequence: Synthetic coding sequence
atgtctgtggagcccccacctgagctggaggagaaggccgccagcgagcctgaggccggggccatgcctgagaagagagctggggcccaggccgccggcagcacctggctgcagggcttcggccggcccagcgtgtaccacgccgccatcgtcatcttcctggagttctttgcctggggcctgctgaccacccccatgctgactgtgctgcacgagaccttcagccagcacaccttcctgatgaatggcctcatccagggcgtgaagggcctgctgtccttcctgagcgcccccctcatcggggccctgagtgatgtgtggggcaggaagcccttcctgctgggcaccgtcttcttcacctgcttccccatccccctgatgaggatcagcccctggtggtactttgccatgatctctgtgtctggagtcttctctgtgaccttcagcgtcatctttgcctacgtggctgatgtgacccaggagcacgagaggagcacagcctacggctgggtgtctgccacctttgctgccagcctggtgagcagccctgccatcggggcctacctgagcgccagctatggagacagcctggtggtgctggtggccaccgtggtggccctgctggacatctgcttcatcctggtggccgtgcctgagagcctgcctgagaagatgaggcctgtgtcctggggcgcccagatctcctggaagcaggccgacccctttgccagcctgaagaaggtgggcaaggacagcacagtgctgctgatctgcatcaccgtcttcctgagctacctgcctgaggccggccagtacagcagcttcttcctgtacctgcggcaggtgattggatttggatctgtgaagattgctgccttcatcgccatggtgggcatcctgagcatcgtggcccagacagccttcctgagcatcctgatgaggagcctgggcaacaagaacacagtgctgctgggcctgggcttccagatgctgcagctggcctggtacggcttcggcagccaggcctggatgatgtgggccgccggcaccgtggccgccatgagcagcatcaccttccctgccatcagcgccctggtgtccagaaatgctgagagtgaccagcagggcgtggcccagggcatcatcaccggcatccggggcctgtgcaatggcctgggccctgccctgtatggcttcatcttctacatgtttcatgtggagctgacagagctgggccccaagctgaacagcaacaacgtgcccctgcagggcgctgtgattcctggcccccccttcctgtttggagcctgcatcgtgctgatgtccttcctggtggccctcttcatccctgagtacagcaaggccagcggcgtgcagaagcacagcaacagcagcagcggcagcctgaccaacaccccagagcggggcagtgatgaagatattgagcccctgctgcaggacagcagcatctgggagctgagcagctttgaggagcccggcaaccagtgcacagagctgtag

SEQ ID NO: 34758 - DNA, 936 bp, Artificial Sequence
  Description of Artificial Sequence: Synthetic coding sequence
atgctgactgtgctgcacgagaccttcagccagcacaccttcctgatgaatggcctcatccagggcgtgaagggcctgctgtccttcctgagcgcccccctgattggagccctgagtgatgtgtggggcaggaagcccttcctgctgggcaccgtcttcttcacctgcttccccatccccctgatgaggatcagcccctggtggtactttgccatgatctctgtgtctggagtcttctctgtgaccttcagcgtcatctttgcctacgtggctgatgtgacccaggagcacgagaggagcacagcctacggctgggtgtctgccacctttgctgccagcctggtgagcagccctgccatcggggcctacctgagcgccagctatggagacagcctggtggtgctggtggccaccgtggtggccctgctggacatctgcttcatcctggtggccgtgcctgagagcctgcctgagaagatgaggcctgtgtcctggggcgcccagatctcctggaagcaggccgacccctttgccagcctgaagaaggtgggcaaggacagcacagtgctgctgatctgcatcaccgtcttcctgagctacctgcctgaggccggccagtacagcagcttcttcctgtacctgcggcaggtgattggcttcggctctgtgaagattgctgccttcatcgccatggtgggcatcctgagcatcgtggcccagacagccttcctgagcatcctgatgaggagcctgggcaacaagaacacagtgctgctgggcctgggcttccagatgctgcagctggcctggtacggcttcggcagccaggcctggagctgccctggggaccacaactggaacaagaggaccatgcagtggccaggggccagcacagtgtggctgcacatcctgcacgtgccctgtggcacagactag

SEQ ID NO: 34759 - DNA, 405 bp, Artificial Sequence
  Description of Artificial Sequence: Synthetic coding sequence
atgtctgtggagcccccacctgagctggaggagaaggccgccagcgagcctgaggccggggccatgcctgagaagagagctggggcccaggccgccggcagcacctggctgcagggcttcggcccccccagcgtgtaccacgccgccatcgtcatcttcctggagttctttgcctggggcctgctgaccacccccatgctgactgtgctgcacgagaccttcagccagcacaccttcctgatgaatggcctcatccagggcgtgaagggcctgctgtccttcctgagcgcccccctcatcggggccctgagtgatgtgtggggcaggaagcccttcctgctgggcaccgtcttcttcacctgcttccccatccccctgatgaggatcagcccctgccaggcctag

SEQ ID NO: 34760 - DNA, 348 bp, Artificial Sequence
  Description of Artificial Sequence: Synthetic coding sequence
atgctgggcctgctgggcagcacagccctggtgggctggatcactggagctgctgtggccgtgctgctgctgctgctgctgctggccacctgcctcttccacggccggcaggactgtgatgtggagaggaacagaacagctgctgggggcaacagagtgcggcgggcccagccctggcccttcagaagaagaggccacctgggcatcttccaccaccaccgccaccctggccacgtgagccacgtgcccaacgtgggcctgcaccaccaccaccaccccaggcacaccccccaccacctgcaccaccaccaccacccccaccgccaccaccccaggcatgccaggtag

SEQ ID NO: 34761 - DNA, 1041 bp, Artificial Sequence
  Description of Artificial Sequence: Synthetic coding sequence
atgtacaacggcagctgctgcagaattgaaggagacaccatcagccaggtgatgccacccctgctgattgtggcctttgtgctgggcgccctgggcaatggagtggccctgtgtggcttctgcttccacatgaagacctggaagcccagcacagtgtacctgttcaacctggccgtggccgacttcctgctgatgatctgcctgcccttcagaacagactactacctgcggcggcggcactgggcctttggagacatcccctgccgggtgggcctcttcaccctggccatgaacagagctggcagcatcgtgttcctgactgtggtggccgctgaccgctacttcaaggtggtgcacccccaccacgctgtgaacaccatcagcaccagggtggccgccggcatcgtgtgcaccctgtgggccctggtgatcctgggcaccgtgtacctgctgctggagaaccacctgtgtgtgcaggagacagctgtgtcctgtgagagcttcatcatggagagcgccaacggctggcatgacatcatgttccagctggagttcttcatgcccctgggcatcatcctcttctgcagcttcaagatcgtgtggagcctgcggcggcggcagcagctggcccggcaggccaggatgaagaaggccacccgcttcatcatggtggtggccatcgtgttcatcacctgctacctgcccagcgtgtctgcccggctgtacttcctgtggacagtgcccagcagcgcctgtgaccccagcgtgcatggagccctgcacatcaccctgtccttcacctacatgaacagcatgctggaccccctggtgtactacttcagcagccccagcttccccaagttctacaacaagctgaagatctgcagcctgaagcccaagcagcccggccacagcaagacccagaggcctgaggagatgcccatcagcaacctgggccgccgcagctgcatctctgtggccaacagcttccagagccagagtgatggccagtgggacccccacatcgtggagtggcactag

SEQ ID NO: 34762 - DNA, 1041 bp, Artificial Sequence; identical to SEQ ID NO: 34761
  Description of Artificial Sequence: Synthetic coding sequence

SEQ ID NO: 34763 - DNA, 1041 bp, Artificial Sequence; identical to SEQ ID NO: 34761
  Description of Artificial Sequence: Synthetic coding sequence

SEQ ID NO: 34764 - DNA, 1092 bp, Artificial Sequence
  Description of Artificial Sequence: Synthetic coding sequence
atgaacagacaccacctgcaggaccacttcctggagattgacaagaagaactgctgcgtgttcagagatgacttcatcgtgaaggtgctgccccctgtgctgggcctggagttcatcttcggcctgctgggcaatggcctggccctgtggatcttctgcttccacctgaagtcctggaagagcagccgcatcttcctgttcaacctggccgtggccgacttcctgctgatcatctgcctgcccttcctgatggacaactacgtgcggcgctgggactggaagtttggagacatcccctgccgcctgatgctgttcatgctggccatgaaccggcagggcagcatcatcttcctgactgtggtggccgtggaccgctacttccgggtggtgcacccccaccacgccctgaacaagatcagcaacagaacagctgccatcatcagctgcctgctgtggggcatcaccatcggcctgactgtgcacctgctgaagaagaagatgcccatccagaatggaggagccaacctgtgcagcagcttcagcatctgccacaccttccagtggcatgaggccatgttcctgctggagttcttcctgcccctgggcatcatcctcttctgcagcgcccgcatcatctggagcctgcggcagaggcagatggacagacatgccaagatcaagagggccatcaccttcatcatggtggtggccatcgtgtttgtgatctgcttcctgcccagcgtggtggtgcgcatccgcatcttctggctgctgcacaccagcggcacccagaactgtgaggtgtacagatctgtggacctggccttcttcatcaccctgtccttcacctacatgaacagcatgctggaccctgtggtgtactacttcagcagccccagcttccccaacttcttcagcaccctcatcaaccgctgcctgcagaggaagatgaccggggagccagacaacaacagaagcacctctgtggagctgaccggggaccccaacaagaccaggggggcccctgaggccctgatggccaacagcggggagccctggagccccagctacctgggccccaccagcccctag

SEQ ID NO: 34765 - DNA, 1164 bp, Artificial Sequence
  Description of Artificial Sequence: Synthetic coding sequence
atgaacagacaccacctgcaggaccacttcctggagattgacaagaagaactgctgcgtgttcagagatgacttcatcgtgaaggtgctgccccctgtgctgggcctggagttcatcttcggcctgctgggcaatggcctggccctgtggatcttctgcttccacctgaagtcctggaagagcagccgcatcttcctgttcaacctggccgtggccgacttcctgctgatcatctgcctgcccttcctgatggacaactacgtgcggcgctgggactggaagtttggagacatcccctgccgcctgatgctgttcatgctggccatgaaccggcagggcagcatcatcttcctgactgtggtggccgtggaccgctacttccgggtggtgcacccccaccacgccctgaacaagatcagcaacagaacagctgccatcatcagctgcctgctgtggggcatcaccatcggcctgactgtgcacctgctgaagaagaagatgcccatccagaatggaggagccaacctgtgcagcagcttcagcatctgccacaccttccagtggcatgaggccatgttcctgctggagttcttcctgcccctgggcatcatcctcttctgcagcgcccgcatcatctggagcctgcggcagaggcagatggacagacatgccaagatcaagagggccatcaccttcatcatggtggtggccatcgtgtttgtgatctgcttcctgcccagcgtggtggtgcgcatccgcatcttctggctgctgcacaccagcggcacccagaactgtgaggtgtacagatctgtggacctggccttcttcatcaccctgtccttcacctacatgaacagcatgctggaccctgtggtgtactacttcagcagccccagcttccccaacttcttcagcaccctcatcaaccgctgcctgcagaggaagatgaccggggagccagacaacaacagaagcacctctgtggagctgaccggggaccccaacaagaccaggggggcccctgaggccctgatggccaacagcggggagccctggagccccagctacctgggccccaccagcaacaaccacgccaagaagggccactgccaccaggagcccggcagcctggagaagcagctgggctgctgcatcgagtag

SEQ ID NO: 34766 - DNA, 954 bp, Artificial Sequence
  Description of Artificial Sequence: Synthetic coding sequence
atgtggctgtacctggccgcctttgtgggcctgtactacctgctgcactggtaccgggagcggcaggtggtgagccacctgcaggacaagtatgtgttcatcaccggctgtgacagcggctttggaaacctgctggcccggcagctggatgcccggggcctgcgggtgctggccgcctgcctgacagagaagggagctgagcagctgcggggccagaccagtgaccggctggagaccgtgaccctggatgtgaccaagatggagagcattgctgctgccacccagtgggtgaaggagcacgtgggggaccggggcctgtggggcctggtgaacaatgccggcatcctgacccccatcaccctgtgtgagtggctgaacacagaggacagcatgaacatgctgaaggtgaacctgattggagtcatccaggtgaccctgtccatgctgcccctggtgagaagagcccggggcagaattgtgaatgtgagcagcatcctgggccgggtggccttctttgtgggcggctactgtgtgtccaaatatggagtggaggccttcagtgacatcctgcggcgggagatccagcactttggagtgaagatcagcatcgtggagcccggctacttcagaacaggcatgaccaacatgacccagagcctggagaggatgaagcagagctggaaggaggcccccaagcacatcaaggagacctacggccagcagtactttgatgccctgtacaacatcatgaaggagggcctgctgaactgcagcaccaacctgaacctggtgacagactgcatggagcacgccctgacctctgtgcaccccaggacccgctacagcgctggctgggatgccaagttcttcttcatccccctgagctacctgcccaccagcctggccgactacatcctgaccaggtcctggcccaagccagcccaggccgtgtag

SEQ ID NO: 34767 - DNA, 954 bp, Artificial Sequence; identical to SEQ ID NO: 34766
  Description of Artificial Sequence: Synthetic coding sequence

SEQ ID NO: 34768 - DNA, 267 bp, Artificial Sequence
  Description of Artificial Sequence: Synthetic coding sequence
atgtggctgtacctggccgcctttgtgggcctgtactacctgctgcactggtaccgggagcggcaggtggtgagccacctgcaggacaagtatgtgttcatcaccggctgtgacagcggctttggaaacctgctggcccggcagctggatgcccggggcctgcgggtgctggccgcctgcctgacagagaagggagctgagcagctgcggggccagaccagtgaccggctggagaccgtgaccctggatgtgaccaagatggagtag

SEQ ID NO: 34769 - DNA, 954 bp, Artificial Sequence; identical to SEQ ID NO: 34766
  Description of Artificial Sequence: Synthetic coding sequence

SEQ ID NO: 34770 - DNA, 954 bp, Artificial Sequence; identical to SEQ ID NO: 34766
  Description of Artificial Sequence: Synthetic coding sequence

SEQ ID NO: 34771 - DNA, 954 bp, Artificial Sequence; identical to SEQ ID NO: 34766
  Description of Artificial Sequence: Synthetic coding sequence

SEQ ID NO: 34772 - DNA, 228 bp, Artificial Sequence
  Description of Artificial Sequence: Synthetic coding sequence
atgtggctgtacctggccgcctttgtgggcctgtactacctgctgcactggtaccgggagcggcaggtggtgagccacctgcaggacaagtatgtgttcatcaccggctgtgacagcggctttggaaacctgctggcccggcagctggatgcccggggcctgcgggtgctggccgcctgcctgacagagaagggagctgagcagctgcggggccagaccagtgactag

SEQ ID NO: 34773 - DNA, 897 bp, Artificial Sequence
  Description of Artificial Sequence: Synthetic coding sequence
atggtgaccccagccctgcagatgaagaagcccaagcagttctgcaggaggatgggccagaagaagcagaggcctgcccgggccggccagccccacagcagcagtgatgctgcccaggccccagctgagcagccccacagcagcagtgatgctgcccaggccccctgcccccgggagcgctgcctgggcccccccaccaccccaggcccctaccgcagcatctacttcagcagccccaagggccacctgacccggctgggcctggagttctttgaccagcctgctgtgcccctggcccgggccttcctgggccaggtgctggtgcggcggctgcccaatggaacagagctgcggggcagaattgtggagacagaggcctacctgggcccagaagatgaggccgcccacagcagaggaggccggcagaccccaagaaacagaggcatgttcatgaagccaggcaccctgtatgtgtacatcatctacggcatgtacttctgcatgaacatcagcagccagggagatggagcctgtgtgctgctgcgggccctggagcccctggagggcctggagaccatgaggcagctgcggagcaccctgaggaagggcacagccagccgggtgctgaaggaccgggagctgtgcagcggccccagcaagctgtgccaggccctggccatcaacaagagctttgaccagagggacctggcccaggatgaagctgtgtggctggagcggggccccctggagcccagcgagcctgctgtggtggccgccgcccgggtgggcgtgggccatgctggggagtgggccaggaagcccctgcgcttctacgtgcggggcagcccctgggtgtctgtggtggacagagtggccgagcaggacacccaggcctag

SEQ ID NO: 34774 - DNA, 828 bp, Artificial Sequence
  Description of Artificial Sequence: Synthetic coding sequence
atggctgctgtggacagcttctacctgctgtaccgggagatcgcccggagctgcaactgctacatggaggccctggccctggtgggcgcctggtacacagccaggaagagcatcaccgtcatctgtgacttctacagcctcatccggctgcacttcatcccccggctgggcagcagagctgacctgatcaagcagtatggccgctgggccgtggtgtctggggccacagatggcatcggcaaggcctatgcagaggagctggccagccggggcctgaacatcatcctgatcagcagaaatgaggagaagctgcagtacttcacccagctgtctgaggacaagctgtgggacatcatcaacgtgaacattgctgctgccagcctgatggtgcacgtggtgctgcccggcatggtggagaggaagaagggggccatcgtgaccatcagcagcggcagctgctgcaagcccaccccccagctggccgccttcagcgccagcaaggcctacctggaccacttcagccgggccctgcagtatgaatatgccagcaagggcatctttgtgcagagcctcatccccttctacgtggccacctccatgacagcccccagcaacttcctgcaccgctgctcctggctggtgcccagccccaaggtgtatgcccaccacgctgtgtccaccctgggcatcagcaagaggaccaccggctactggagccacagcatccagttcctgtttgcccagtacatgcctgagtggctgtgggtgtggggcgccaacatcctgaacagaagcctgaggaaggaggccctgagctgcacagcctag

SEQ ID NO: 34775 - DNA, 2673 bp, Artificial Sequence
  Description of Artificial Sequence: Synthetic coding sequence
atggagggcggcggcaagcccaacagcagcagcaacagcagagatgatggcaacagcgtcttccctgccaaggccagcgccaccggggccggccctgctgctgctgagaagaggctgggcaccccacctgggggcggcggggccggggccaaggagcacggcaacagcgtgtgcttcaaggtggatggcggcggcggcggcggcggcggcggcggcggcggggaggagcctgctgggggctttgaagatgctgagggcccccggcggcagtatggcttcatgcagaggcagttcacctccatgctgcagcccggggtgaacaagttcagcctgaggatgtttggcagccagaaggctgtggagaaggagcaggagcgggtgaagacagctggcttctggatcatccacccctacagcgacttccgcttctactgggacctgatcatgctgatcatgatggtgggcaacctggtgatcatccctgtgggcatcaccttcttcacagagcagaccaccaccccctggatcatcttcaacgtggccagtgacaccgtcttcctgctggacctgatcatgaacttcagaacaggcaccgtgaatgaagacagcagcgagatcatcctggaccccaaggtgatcaagatgaactacctgaagtcctggtttgtggtggacttcatcagcagcatccctgtggactacatcttcctgattgtggagaagggcatggattctgaggtgtacaagacagcccgggccctgcgcatcgtgcgcttcaccaagatcctgagcctgctgcggctgctgcggctgagccgcctcatccgctacatccaccagtgggaggagatcttccacatgacctatgacctggccagcgctgtggtgcgcatcttcaacctgattggcatgatgctgctgctgtgccactgggatggctgcctgcagttcctggtgcccctgctgcaggacttccccccagactgctgggtgtccctgaatgagatggtgaatgacagctggggcaagcagtacagctatgccctcttcaaggccatgagccacatgctgtgcatcggctatggagcccaggcccctgtgtccatgtctgacctgtggatcaccatgctgtccatgattgtgggcgccacctgctacgccatgtttgtgggccacgccacagccctgatccagagcctggacagcagccggcggcagtaccaggagaagtacaagcaggtggagcagtacatgtccttccacaagctgcctgctgacatgaggcagaagatccatgactactatgagcaccgctaccagggcaagatctttgatgaggagaacatcctgaatgagctgaatgaccccctgcgggaggagatcgtgaacttcaactgcaggaagctggtggccaccatgcccctgtttgccaatgctgaccccaactttgtgacagccatgctgagcaagctgcgctttgaggtgttccagcccggggactacatcatccgggagggcgctgtgggcaagaagatgtacttcatccagcacggcgtggccggggtcatcaccaagagcagcaaggagatgaagctgacagatggcagctactttggagagatctgcctgctgaccaagggccgcaggacagcctctgtgcgggctgacacctactgccgcctgtacagcctgtctgtggacaacttcaatgaggtgctggaggagtaccccatgatgaggcgggcctttgaaacagtggccatcgaccggctggaccgcatcggcaagaagaacagcatcctgctgcagaagttccagaaggacctgaacacaggagtcttcaacaaccaggagaatgagatcctgaagcagatcgtgaagcatgaccgggagatggtgcaggccatcgcccccatcaactacccccagatgaccaccctgaacagcaccagcagcaccaccacccccaccagcaggatgaggacccagagcccccctgtgtacacagccaccagcctgagccacagcaacctgcacagccccagccccagcacccagaccccccagcccagcgccatcctgagcccctgcagctacaccacagctgtgtgcagcccccctgtgcagagccccctggccgcccggaccttccactacgccagccccacagccagccagctgagcctgatgcagcagcagccccagcagcaggtgcagcagagccagcccccccagacccagccccagcagcccagcccccagccccagaccccaggcagcagcacccccaagaatgaggtgcacaagagcacccaggccctgcacaacaccaacctgacccgggaggtgcggcccctgagcgccagccagcccagcctgccccatgaggtgtccaccctcatcagccggccccaccccaccgtgggggagagcctggccagcatcccccagcctgtgacagctgtgcccggcaccggcctgcaggccggcggccgcagcacagtgccccagagggtgaccctcttccggcagatgagcagcggggccatcccccccaacagaggagtgcccccagcccctcctcctcctgctgctgccctgccccgggagagcagctctgtgctgaacacagatcctgatgctgagaagcccaggtttgccagcaacctgtag

SEQ ID NO: 34776 - DNA, 1170 bp, Artificial Sequence
  Description of Artificial Sequence: Synthetic coding sequence
atggagcccagcgccacccctggggcccagatgggcgtgcccccaggcagccgggagcccagccctgtgcccccagactatgaagatgagttcctgcgctacctgtggagggactacctgtaccccaagcagtatgagtgggtgctgattgctgcctacgtggccgtgtttgtggtggccctggtgggcaacaccctggtgtgcctggccgtgtggaggaaccaccacatgaggacagtgaccaactacttcatcgtgaacctgagcctggctgatgtgctggtgacagccatctgcctgcctgccagcctgctggtggacatcacagagagctggctgtttggccacgccctgtgcaaggtgatcccctacctgcaggccgtgtctgtgtctgtggccgtgctgaccctgtccttcatcgccctggaccgctggtacgccatctgccaccccctgctcttcaagagcacagcccggcgggcccggggcagcatcctgggcatctgggccgtgtccctggccatcatggtgccccaggccgctgtgatggagtgcagctctgtgctgcctgagctggccaacagaaccaggctcttctctgtgtgtgatgagcgctgggcagatgacctgtaccccaagatctaccacagctgcttcttcatcgtgacctacctggcccccctgggcctgatggccatggcctacttccagatcttcaggaagctgtggggccggcagatccctggcaccaccagcgccctggtgaggaactggaagaggcccagcgaccagctgggggacctggagcagggcctgtctggagagccccagccccgggcccgggccttcctggccgaggtgaagcagatgagggcccggaggaagacagccaagatgctgatggtggtgctgctggtgtttgccctgtgctacctgcccatctctgtgctgaatgtgctgaagagggtgtttggcatgttccggcaggccagtgaccgggaggccgtgtatgcctgcttcaccttcagccactggctggtgtatgccaacagcgctgccaaccccatcatctacaacttcctgagcggctgcaaggagaagagcctggccctgagctgccccagctgccccggccatgacccccacctggccgccgccctgtgcagctag

SEQ ID NO: 34777 - DNA, 1278 bp, Artificial Sequence
  Description of Artificial Sequence: Synthetic coding sequence
atggagcccagcgccacccctggggcccagatgggcgtgcccccaggcagccgggagcccagccctgtgcccccagactatgaagatgagttcctgcgctacctgtggagggactacctgtaccccaagcagtatgagtgggtgctgattgctgcctacgtggccgtgtttgtggtggccctggtgggcaacaccctggtgtgcctggccgtgtggaggaaccaccacatgaggacagtgaccaactacttcatcgtgaacctgagcctggctgatgtgctggtgacagccatctgcctgcctgccagcctgctggtggacatcacagagagctggctgtttggccacgccctgtgcaaggtgatcccctacctgcaggccgtgtctgtgtctgtggccgtgctgaccctgtccttcatcgccctggaccgctggtacgccatctgccaccccctgctcttcaagagcacagcccggcgggcccggggcagcatcctgggcatctgggccgtgtccctggccatcatggtgccccaggccgctgtgatggagtgcagctctgtgctgcctgagctggccaacagaaccaggctcttctctgtgtgtgatgagcgctgggcagatgacctgtaccccaagatctaccacagctgcttcttcatcgtgacctacctggcccccctgggcctgatggccatggcctacttccagatcttcaggaagctgtggggccggcagatccctggcaccaccagcgccctggtgaggaactggaagaggcccagcgaccagctgggggacctggagcagggcctgtctggagagccccagccccgggcccgggccttcctggccgaggtgaagcagatgagggcccggaggaagacagccaagatgctgatggtggtgctgctggtgtttgccctgtgctacctgcccatctctgtgctgaatgtgctgaagagggtgtttggcatgttccggcaggccagtgaccgggaggccgtgtatgcctgcttcaccttcagccactggctggtgtatgccaacagcgctgccaaccccatcatctacaacttcctgagcggcaagttccgggagcagttcaaggccgccttcagctgctgcctgcccggcctgggcccctgtggcagcctgaaggcccccagccccaggagcagcgccagccacaagagcctgagcctgcagagccgctgcagcatcagcaagatcagcgagcacgtggtgctgacctctgtgaccaccgtgctgccctag

SEQ ID NO: 34778 - DNA, 1278 bp, Artificial Sequence; identical to SEQ ID NO: 34777
  Description of Artificial Sequence: Synthetic coding sequence

SEQ ID NO: 34779 - DNA, 1335 bp, Artificial Sequence
  Description of Artificial Sequence: Synthetic coding sequence
atgagcggcaccaagctggaggacagccccccctgcaggaactggagcagcgccagcgagctgaatgagacccaggagcccttcctgaaccccacagattatgatgatgaggagttcctgcgctacctgtggagggagtacctgcaccccaaggagtatgagtgggtgctgattgctggctacatcatcgtgtttgtggtggccctgattggaaatgtgctggtgtgtgtggccgtgtggaagaaccaccacatgaggacagtgaccaactacttcatcgtgaacctgagcctggctgatgtgctggtgaccatcacctgcctgcctgccaccctggtggtggacatcacagagacctggttcttcggccagagcctgtgcaaggtgatcccctacctgcagacagtgtctgtgtctgtgtctgtgctgaccctgagctgcatcgccctggaccgctggtacgccatctgccaccccctgatgttcaagagcacagccaagagggccaggaacagcatcgtcatcatctggatcgtgtcctgcatcatcatgatcccccaggccatcgtgatggagtgcagcacagtgtttcctggcctggccaacaagaccaccctcttcaccgtgtgtgatgagcgctggggcggggagatctaccccaagatgtaccacatctgcttcttcctggtgacctacatggcccccctgtgcctgatggtgctggcctacctgcagatcttcaggaagctgtggtgccggcagatccctggcaccagctctgtggtgcagaggaagtggaagcccctgcagcctgtgtcccagccccggggccctggccagcccaccaagagcaggatgtctgctgtggccgctgagatcaagcagatccgggcccggaggaagacagccaggatgctgatgattgtgctgctggtgtttgccatctgctacctgcccatcagcatcctgaatgtgctgaagagggtgtttggcatgtttgcccacacagaagatcgggagaccgtgtatgcctggttcaccttcagccactggctggtgtatgccaacagcgctgccaaccccatcatctacaacttcctgagcggcaagttccgggaggagttcaaggccgccttcagctgctgctgcctgggcgtgcaccaccggcaggaggaccggctgacccggggccgcaccagcacagagagcaggaagagcctgaccacccagatcagcaactttgacaacatcagcaagctgtctgagcaggtggtgctgaccagcatcagcaccctgcctgctgccaacggggccggccccctgcagaactggtag

SEQ ID NO: 34780 - DNA, 1134 bp, Artificial Sequence
  Description of Artificial Sequence: Synthetic coding sequence
atgtctgaggtgaagagcaggaagaagagcggccccaagggggccccagctgctgagcccgggaagaggtctgagggcggcaagacccctgtggcccggagcagcggcggcggcggctgggccgaccccaggacctgcctgagcctgctgagcctgggcacctgcctgggcctggcctggtttgtgttccagcagagcgagaagtttgccaaggtggagaaccagtaccagctgctgaagctggagaccaatgagttccagcagctgcagagcaagatcagcctcatcagcgagaagctggagagcacagagagcatcctgcaggaggccaccagctccatgagcctgatgacccagtttgagcaggaggtgagcaacctgcaggacatcatgcatgacatccagaacaatgaggaggtgctgacccagaggatgcagagcctgaatgagaagttccagaacatcacagacttctggaagaggagcctggaggagatgaacatcaacacagacatcttcaagtctgaggccaagcacatccacagccaggtgacagtgcagatcaacagcgctgagcaggagatcaagctgctgacagagcggctgaaggacctggaggacagcaccctgaggaacatcagaacagtgaagaggcaggaggaggaggacctgctgcgggtggaggagcagctgggcagtgacaccaaggccatcgagaagctggaggaggagcagcacgccctgtttgccagagatgaggacctgaccaacaagctgagtgactatgagcccaaggtggaggagtgcaagacccacctgcccaccatcgagagcgccatccacagcgtgctgcgggtgtcccaggacctgattgaaacagagaagaagatggaggacctgaccatgcagatgttcaacatggaggatgacatgctgaaggctgtgtctgagatcatggagatgcagaagaccctggagggcatccagtatgacaacagcatcctgaagatgcagaatgagctggacatcctgaaggagaaggtgcatgacttcatcgcctacagcagcactggagagaagggcaccctgaaggagtacaacattgaaaataaaggaattggaggagacttctag

SEQ ID NO: 34781 - DNA, 1053 bp, Artificial Sequence
  Description of Artificial Sequence: Synthetic coding sequence
atgtctgaggtgaagagcaggaagaagagcggccccaagggggccccagctgctgagcccgggaagaggtctgagggcggcaagacccctgtggcccggagcagcggcggcggcggctgggccgaccccaggacctgcctgagcctgctgagcctgggcacctgcctgggcctggcctggtttgtgttccagcagagcgagaagtttgccaaggtggagaaccagtaccagctgctgaagctggagaccaatgagttccagcagctgcagagcaagatcagcctcatcagcgagaagtggcagaagtctgaggccatcatggagcagctgaagagcttccagatcatcgcccacctgaagaggctgcaggaggagatcaatgaggtgaagacctggagcaaccgcatcacagagaagcaggacatcctgaacaacagcctgaccaccctgagccaggacatcaccaaggtggaccagagcaccacctccatggccaaggatgtgggcctgaagatcacctctgtgaagacagacatccgccgcatcagcggcctggtgacagatgtgatcagcctgacagattctgtgcaggagctggagaacaagattgagaaggtggagaagaacacagtgaagaacatcggggacctgctgagcagcagcattgacagaacagccaccctgaggaagacagccagcgagaacagccagaggatcaacagcgtgaagaagaccctgacagagctgaagagtgactttgacaagcacacagaccgcttcctgagcctggagggggaccgggccaaggtgctgaagacagtgacctttgccaatgacctgaagcccaaggtgtacaacctgaagaaggacttcagccggctggagcccctggtgaatgacctgaccctgagaattggccgcctggtgacagacctgctgcagcgggagaaggagatcgccttcctgtctgagaagatcagcaacctgaccatcgtgcaggccgagatcaaggacatcaaggatgaaattgcccacatcagtgacatgaactag

SEQ ID NO: 34782 - DNA, 213 bp, Artificial Sequence
  Description of Artificial Sequence: Synthetic coding sequence
atgtctgaggtgaagagcaggaagaagagcggccccaagggggccccagctgctgagcccgggaagaggtctgagggcggcaagacccctgtggcccggagcagcggcggcggcggctgggccgaccccaggacctgcctgagcctgctgagcctgggcacctgcctgggcctggcctgtggcaggaacctgaagctgtcctggaacaactag

SEQ ID NO: 34783 - DNA, 735 bp, Artificial Sequence
  Description of Artificial Sequence: Synthetic coding sequence
atggagcagctgaagagcttccagatcatcgcccacctgaagaggctgcaggaggagatcaatgaggtgaagacctggagcaaccgcatcacagagaagcaggacatcctgaacaacagcctgaccaccctgagccaggacatcaccaaggtggaccagagcaccacctccatggccaaggatgtgggcctgaagatcacctctgtgaagacagacatccgccgcatcagcggcctggtgacagatgtgatcagcctgacagattctgtgcaggagctggagaacaagattgagaaggtggagaagaacacagtgaagaacatcggggacctgctgagcagcagcattgacagaacagccaccctgaggaagacagccagcgagaacagccagaggatcaacagcgtgaagaagaccctgacagagctgaagagtgactttgacaagcacacagaccgcttcctgagcctggagggggaccgggccaaggtgctgaagacagtgacctttgccaatgacctgaagcccaaggtgtacaacctgaagaaggacttcagccggctggagcccctggtgaatgacctgaccctgagaattggccgcctggtgacagacctgctgcagcgggagaaggagatcgccttcctgtctgagaagatcagcaacctgaccatcgtgcaggccgagatcaaggacatcaaggatgaaattgcccacatcagtgacatgaactag

SEQ ID NO: 34784 - DNA, 2445 bp, Artificial Sequence
  Description of Artificial Sequence: Synthetic coding sequence
atggctgtgcagagagctgccagcccccggcggcccccagcccccctgtggccccggctgctgctgcccctgctgctgctgctgctgcctgcccccagcgagggcctgggccacagcgctgagctggcctttgctgtggagcccagtgatgatgtggccgtgcccggccagcccatcgtgctggactgccgggtggagggcaccccacctgtgcgcatcacctggaggaagaatggagtggagctgcctgagagcacccacagcaccctgctggccaacggcagcctgatgatccgccacttccggctggagcccggcggcagccccagtgatgaaggagactatgaatgtgtggcccagaacagatttggcctggtggtgtccaggaaggcccgcatccaggccgccaccatgtctgacttccacgtgcacccccaggccaccgtgggggaggagggcggcgtggcccgcttccagtgccagatccacggcctgcccaagcccctcatcacctgggagaagaacagagtgcccatcgacacagacaatgaaagatacaccctgctgcccaagggcgtgctgcagatcaccggcctgcgggcagaagatggcggcatcttccactgtgtggccagcaacatcgccagcatccgcatcagccatggagcccggctgactgtgtctggcagcggcagcggggcctacaaggagcccgccatcctggtgggccctgagaacctgaccctgactgtgcaccagacagctgtgctggagtgtgtggccaccggcaacccccggcccatcgtgtcctggagccggctggatggccggcccatcggcgtggagggcatccaggtgctgggcactggaaacctgatcatcagtgatgtgacagtgcagcacagcggcgtgtatgtgtgtgccgccaaccggcccggcaccagggtgagaagaacagcccagggccgcctggtggtgcaggccccagctgagtttgtgcagcacccccagagcatcagcaggcctgctggcaccacagccatgttcacctgccaggcccagggcgagcccccaccccacgtgacctggctgaagaatggccaggtgctgggccctgggggccacgtgcggctgaagaacaacaacagcaccctgaccatcagcggcatcggcccagaagatgaggccatctaccagtgtgtggctgaaaattctgctggcagcagccaggccagcgcccggctgactgtgctgtgggccgagggcctgcccggccccccaagaaatgtgcgggctgtgtctgtgagcagcacagaggtgcgggtgtcctggagcgagcccctggccaacaccaaggagatcatcggctacgtgctgcacatcaggaaggctgctgaccccccagagctggagtaccaggaggccgtgtccaagagcaccttccagcacctggtgtctgacctggagcccagcacagcctacagcttctacatcaaggcctacacccccaggggggccagcagcgcctctgtgcccaccctggccagcaccctgggggaggccccagcccccccacccctgtctgtgcgggtgctgggcagcagcagcctgcagctgctgtgggagccctggccccggctggcccagcacgagggcggcttcaagctgttctacagacctgccagcaagaccagcttcaccggccccatcctgctgcccggcaccgtgagcagctacaacctgagccagctggaccccacagctgtgtatgaggtgaagctgctggcctacaaccagcacggagatggaaatgccaccgtgcgctttgtgtccctgcggggggccagcgagaggacagccctgagccccccctgtgactgcaggaaggaggaggccgccaaccagaccagcaccactggaattgtgattggcatccacatcggcgtgacctgcatcatcttctgtgtgctcttcctgctgtttggccagaggggccgggtgctgctgtgcaaggatgtggagaaccagctgagccccccccagggccccaggagccagagggaccccggcatcctggccctgaatggagcccggcggggccagaggggccagctgggcagagatgagaagagggtggacatgaaggagctggagcagctgttccccccagccagcgctgctggccagcctgacccccggcccacccaggaccctgctgccccagccccctgtgaggagacccagctgtctgtgctgcccctgcagggctgcggcctgatggagggcaagaccacagaggccaagaccacagaggccacagccccctgtgccggcctggccgccgcccctcctcctccagatggcggccctggcctgctgtctgagggccaggccagcaggcctgctgctgcccgggtgacccagcctgcccacagcgagcagtag

SEQ ID NO: 34785 - DNA, 1914 bp, Artificial Sequence
  Description of Artificial Sequence: Synthetic coding sequence
atgtctgacttccacgtgcacccccaggccaccgtgggggaggagggcggcgtggcccgcttccagtgccagatccacggcctgcccaagcccctcatcacctgggagaagaacagagtgcccatcgacacagacaatgaaagatacaccctgctgcccaagggcgtgctgcagatcaccggcctgcgggcagaagatggcggcatcttccactgtgtggccagcaacatcgccagcatccgcatcagccacggggcccggctgactgtgtctggcagcggcagcggggcctacaaggagcccgccatcctggtgggccctgagaacctgaccctgactgtgcaccagacagctgtgctggagtgtgtggccactggaaacccccggcccatcgtgtcctggagccggctggatggccggcccatcggcgtggagggcatccaggtgctgggcaccggcaacctgatcatcagtgatgtgacagtgcagcacagcggcgtgtatgtgtgtgccgccaacagacctggcaccagggtgcggaggacagcccagggccgcctggtggtgcaggccccagctgagtttgtgcagcacccccagagcatcagcaggcctgctggcaccacagccatgttcacctgccaggcccagggcgagcccccacctcatgtgacctggctgaagaatggccaggtgctgggccctgggggccacgtgcggctgaagaacaacaacagcaccctgaccatctctggaattggaccagaagatgaggccatctaccagtgtgtggccgagaacagcgctggcagcagccaggccagcgcccggctgactgtgctgtgggccgagggcctgcccggccccccaagaaatgtgcgggctgtgtctgtgagcagcacagaggtgcgggtgtcctggagcgagcccctggccaacaccaaggagatcatcggctacgtgctgcacatcaggaaggctgctgaccccccagagctggagtaccaggaggccgtgtccaagagcaccttccagcacctggtgtctgacctggagcccagcacagcctacagcttctacatcaaggcctacacccccaggggggccagcagcgcctctgtgcccaccctggccagcaccctgggggaggccccagcccccccacccctgtctgtgcgggtgctgggcagcagcagcctgcagctgctgtgggagccctggccccggctggcccagcatgaaggaggcttcaagctgttctacagacctgccagcaagaccagcttcaccggccccatcctgctgcccggcaccgtgtcctcctacaacctgagccagctggaccccacagctgtgtatgaggtgaagctgctggcctacaaccagcacggagatggaaatgccaccgtgcgctttgtgtccctgcggggggccagcgagaggacagccctgagccccccctgtgactgcaggaaggaggaggccgccaaccagaccagcaccaccggcatcgtcatcggcatccacatcggcgtgacctgcatcatcttctgtgtgctcttcctgctgtttggccagaggggccgggtgctgctgtgcaaggatgtggacatgaaggagctggagcagctgttccccccagccagcgctgctggccagcctgacccccggcccacagatcctgctgccccagccccctgtgaggagacccagctgtctgtgctgcccctgcagggctgcggcctgatggagggcaagaccacagaggccaagaccacagaggccacagccccctgtgccggcctggccgccgcccctcctcctccagatggcggccctggcctgctgtctgagggccaggccagcaggcctgctgctgcccgggtgacccagcctgcccacagcgagcagtag

SEQ ID NO: 34786 - DNA, 3753 bp, Artificial Sequence
  Description of Artificial Sequence: Synthetic coding sequence
atggcccggggagatgctggccggggccggggcctgctggccctgaccttctgcctgctggccgcccggggggagctgctgctgccccaggagaccaccgtggagctgagctgtggggtgggccccctgcaggtgatcctgggccctgagcaggccgctgtgctgaactgcagcctgggcgctgctgctgctggcccccccaccagggtgacctggagcaaggatggagacaccctgctggagcatgaccacctgcacctgctgcccaacggcagcctgtggctgagccagcccctggcccccaacggcagtgatgaatctgtgcctgaggccgtgggcgtgattgagggcaactacagctgcctggcccacggccccctgggcgtgctggccagccagacagctgtggtgaagctggccaccctggccgacttcagcctgcaccctgagagccagacagtggaggagaatggaacagccaggtttgagtgccacatcgagggcctgcctgcccccatcatcacctgggagaaggaccaggtgaccctgcctgaggagcccaggctcatcgtgctgcccaacggggtgctgcagatcctggatgtgcaggagagtgatgctggcccctaccgctgtgtggccaccaacagcgcccggcagcacttcagccaggaggccctgctgtctgtggcccaccggggcagcctggccagcacccggggccaggatgtggtgattgtggccgcccctgagaacaccaccgtggtgtctggccagagcgtggtgatggagtgtgtggccagcgctgaccccaccccatttgtgtcctgggtgcggcaggacggcaagcccatcagcacagatgtgattgtgctgggccgcaccaacctgctgattgccaatgcccagccctggcacagcggcgtgtatgtgtgccgggccaacaagcccaggacccgggactttgccacagctgctgctgagctgcgggtgctggccgccccagccatcacccaggcccctgaggccctgagcaggacccgggccagcacagccaggtttgtgtgccgggccagcggggagcccaggcctgccctgcgctggctgcacaatggagcccccctgcggcccaacggccgggtgaaggtgcagggcggcggcggcagcctggtgatcacccagatcggcctgcaggatgctggctactaccagtgtgtggccgagaacagcgctggcatggcctgtgccgccgccagcctggccgtggtggtgcgggagggcctgcccagcgcccccaccagggtgacagccacccccctgagcagcagcgctgtgctggtggcctgggagaggcctgagatgcacagcgagcagatcatcggcttcagcctgcactaccagaaggcccggggcatggacaacgtggagtaccagtttgctgtgaacaatgacaccacagagctgcaggtgcgggacctggagcccaacacagattatgagttctacgtggtggcctacagccagctgggcgccagcaggaccagcaccccagccctggtgcacaccctggatgatgtgcccagcgctgccccccagctgagcctgagcagccccaaccccagcgacatccgggtggcctggctgcccctgccccccagcctgagcaatggccaggtggtgaagtacaagattgaatatggcctgggcaaggaggaccagatcttcagcacagaggtgagaggaaatgagacccagctgatgctgaacagcctgcagcccaacaaggtgtacagagtgcgcatctctgctggaacagctgctggctttggagcccccagccagtggatgcaccacaggacccccagcatgcacaaccagagccacgtgccctttgccccagctgagctgaaggtgcaggccaagatggagagcctggtggtgtcctggcagcccccaccccaccccacccagatcagcggctacaagctgtactggagggaggtgggcgctgaggaggaggccaatggagaccggctgcccggcggccgcggggaccaggcctgggatgtgggccctgtgcggctgaagaagaaggtgaagcagtatgagctgacccagctggtgcccggccgcctgtatgaggtgaagctggtggccttcaacaagcatgaagatggctacgccgctgtgtggaagggcaagacagagaaggccccagccccagacatgcccatccagaggggcccccccctgcccccagcccacgtgcacgccgagagcaacagcagcaccagcatctggctgcgctggaagaagccagacttcaccaccgtgaagatcgtgaactacacagtgcgcttcagcccctggggcctgagaaatgccagcctggtgacctactacaccagcagcggggaggacatcctgattggaggcctgaagcccttcaccaagtatgaatttgctgtgcagagccacggcgtggacatggatggccccttcggctctgtggtggagaggagcaccctgcctgaccggcccagcaccccacccagcgacctgcggctgagccccctgacccccagcacagtgcggctgcactggtgccccccaacagagcccaatggagagatcgtggagtacctgatcctgtacagcagcaaccacacccagcctgagcaccagtggaccctgctgaccacccagggcaacatcttctctgctgaggtgcacggcctggagagtgacacccgctacttcttcaagatgggcgccaggacagaggtgggccctggccccttcagccggctgcaggatgtgatcaccctgcaggagaagctgagtgacagcctggacatgcacagcgtgacaggcatcatcgtgggcgtgtgcctgggcctgctgtgcctgctggcctgcatgtgtgccggcctgcggcgcagcccccaccgggagagcctgcccggcctgagcagcacagccaccccaggcaacccagccctgtacagccgggcccggctgggcccccccagccccccagctgcccacgagctggagagcctggtgcacccccacccccaggactggagccccccacccagtgatgtggaggacagagctgaggtgcacagcctgatgggcggcggcgtgtctgagggccgcagccacagcaagaggaagatctcctgggcccagcccagcggcctgtcctgggccggctcctgggccggctgtgagctgccccaggccggccccaggcctgccctgacccgggccctgctgcccccagctggcaccggccagaccctgctgctgcaggccctggtgtatgatgccatcaagggaaatggaaggaagaagagccccccagcctgcaggaaccaggtggaggccgaggtgattgtgcacagcgacttcagcgccagcaatggaaatccagacctgcacctgcaggacctggagcctgaggaccccctgcccccagaggccccagacctgatcagcggcgtgggggaccccggccagggcgccgcctggctggaccgggagctgggcggctgtgagctggccgcccctggccctgaccggctgacctgcctgcctgaggccgccagcgccagctgcagctacccagacctgcagcctggagaggtgctggaggagacccctggggacagctgccagctgaagagcccctgccccctgggcgccagccctggcctgcccaggagccctgtgagcagcagcgcctag

SEQ ID NO: 34787 - DNA, 2940 bp, Artificial Sequence
  Description of Artificial Sequence: Synthetic coding sequence
atgggccgcaggaagggccgcagcgccctgagccgcagcagcctggagcgggtgaaccagggcgaggtgaaggtgattggccgcggggcccgggagggcggcggcggccaggcctggggcactggaggcggccgggacctgagctgtggcatccccaggtctgccagccccctggcccccctggccgccccagccatcacccaggcccctgaggccctgagcaggacccgggccagcacagccaggtttgtgtgccgggccagcggggagcccaggcctgccctgcgctggctgcacaacggggcccccctgcggcccaacggccgggtgaaggtgcagggcggcggcggcagcctggtgatcacccagatcggcctgcaggatgctggctactaccagtgtgtggctgaaaattctgctggcatggcctgtgccgccgccagcctggccgtggtggtgcgggagggcctgcccagcgcccccaccagggtgacagccacccccctgagcagcagcgctgtgctggtggcctgggagaggcctgagatgcacagcgagcagatcatcggcttcagcctgcactaccagaaggcccggggcatggacaacgtggagtaccagtttgctgtgaacaatgacaccacagagctgcaggtgcgggacctggagcccaacacagattatgagttctacgtggtggcctacagccagctgggcgccagcaggaccagcaccccagccctggtgcacaccctggatgatgtgcccagcgctgccccccagctgagcctgagcagccccaaccccagcgacatccgggtggcctggctgcccctgccccccagcctgagcaatggccaggtggtgaagtacaagattgaatatggcctgggcaaggaggaccagatcttcagcacagaggtgagaggaaatgagacccagctgatgctgaacagcctgcagcccaacaaggtgtacagagtgcgcatctctgctggaacagctgctggctttggagcccccagccagtggatgcaccacaggacccccagcatgcacaaccagagccacgtgccctttgccccagctgagctgaaggtgcaggccaagatggagagcctggtggtgtcctggcagcccccaccccaccccacccagatcagcggctacaagctgtactggagggaggtgggcgctgaggaggaggccaacggggaccggctgcccggcggccgcggggaccaggcctgggatgtgggccctgtgcggctgaagaagaaggtgaagcagtatgagctgacccagctggtgcccggccgcctgtatgaggtgaagctggtggccttcaacaagcatgaagatggctatgctgctgtgtggaagggcaagacagagaaggccccagccccagacatgcccatccagaggggcccccccctgcccccagcccacgtgcatgctgagagcaacagcagcaccagcatctggctgcgctggaagaagccagacttcaccaccgtgaagatcgtgaactacacagtgcgcttcagcccctggggcctgagaaatgccagcctggtgacctactacaccagcagtggagaggacatcctgattggaggcctgaagcccttcaccaagtatgaatttgctgtgcagagccatggagtggacatggatggcccctttggatctgtggtggagaggagcaccctgcctgaccggcccagcaccccacccagcgacctgcggctgagccccctgacccccagcacagtgcggctgcactggtgccccccaacagagcccaacggggagatcgtggagtacctgatcctgtacagcagcaaccacacccagcctgagcaccagtggaccctgctgaccacccagggcaacatcttctctgctgaggtgcacggcctggagagtgacacccgctacttcttcaagatgggcgccaggacagaggtgggccctggccccttcagccggctgcaggacgtcatcaccctgcaggagaagctgagtgacagcctggacatgcacagcgtgacaggcatcatcgtgggcgtgtgcctgggcctgctgtgcctgctggcctgcatgtgtgccggcctgcggcgcagcccccaccgggagagcctgcccggcctgagcagcacagccaccccaggcaacccagccctgtacagccgggcccggctgggcccccccagccccccagctgcccacgagctggagagcctggtgcacccccacccccaggactggagccccccacccagtgatgtggaggacagagctgaggtgcacagcctgatgggcggcggcgtgtctgagggccgcagccacagcaagaggaagatctcctgggcccagcccagcggcctgtcctgggccggctcctgggccggctgtgagctgccccaggccggccccaggcctgccctgacccgggccctgctgcccccagctggcaccggccagaccctgctgctgcaggccctggtgtatgatgccatcaagggaaatggaaggaagaagagccccccagcctgcaggaaccaggtggaggccgaggtgattgtgcacagcgacttcagcgccagcaatggaaatccagacctgcacctgcaggacctggagcctgaggaccccctgcccccagaggccccagacctgatctctggagtgggggaccccggccagggcgccgcctggctggaccgggagctgggcggctgtgagctggccgcccctggccctgaccggctgacctgcctgcctgaggccgccagcgccagctgcagctacccagacctgcagcccggggaggtgctggaggagacccctggggacagctgccagctgaagagcccctgccccctgggcgccagccctggcctgcccaggagccctgtgagcagcagcgcctag

SEQ ID NO: 34788 - DNA, 1293 bp, Artificial Sequence
  Description of Artificial Sequence: Synthetic coding sequence
atgagcctggtggagctgctgctgtggtggaactgcttcagcaggactggagtggccgccagcctggaggtgtctgagagccctggcagcatccaggtggcccggggccagcctgctgtgctgccctgcaccttcaccaccagcgctgccctgatcaacctgaatgtcatctggatggtgacccccctgagcaatgccaaccagcctgagcaggtgatcctgtaccagggcggccagatgtttgatggagccccccgcttccacggccgggtgggcttcaccggcaccatgcctgccaccaacgtgtccatcttcatcaacaacacccagctgagtgacaccggcacctaccagtgcctggtgaacaacctgcctgacattggaggcaggaacatcggcgtgacaggcctgactgtgctggtgccccccagcgccccccactgccagatccagggcagccaggacatcggcagtgatgtgatcctgctgtgcagcagcgaggagggcatcccccggcccacctacctgtgggagaagctggacaacaccctgaagctgcccccaacagccacccaggaccaggtgcagggcaccgtgaccatccggaacatcagcgccctgagcagcggcctgtaccagtgtgtggccagcaatgccatcggcaccagcacctgcctgctggacctgcaggtgatcagcccccagcccagaaatattggcctgattgctggggccatcggcaccggggccgtcatcatcatcttctgcatcgccctgatcctgggcgccttcttctactggaggagcaagaacaaggaggaggaggaggaggagatccccaatgagatcagagaagatgacctgccccccaagtgcagcagcgccaaggccttccacacagagatcagcagcagtgacaacaacaccctgaccagcagcaatgcctacaacagccgctactggagcaacaaccccaaggtgcacaggaacacagaatctgtgagccacttcagtgacctgggccagagcttctccttccacagcggaaatgccaacatccccagcatctatgccaacggcacccacctggtgcccggccagcacaagaccctggtggtgacagccaacagaggcagcagcccccaggtgatgagccgcagcaatggatctgtgtccaggaagcccaggcctccccacacccacagctacaccatcagccacgccaccctggagagaattggagctgtgcctgtgatggtgcctgcccagagccgggccggcagcctggtgtag

SEQ ID NO: 34789 - DNA, 1296 bp, Artificial Sequence
  Description of Artificial Sequence: Synthetic coding sequence
atgaccagccagaggagccccctggcccccctgctgctgctgagcctgcatggagtggccgccagcctggaggtgtctgagagccctggcagcatccaggtggcccggggccagcctgctgtgctgccctgcaccttcaccaccagcgctgccctgatcaacctgaatgtcatctggatggtgacccccctgagcaatgccaaccagcctgagcaggtgatcctgtaccagggcggccagatgtttgatggagccccccgcttccacggccgggtgggcttcaccggcaccatgcctgccaccaacgtgtccatcttcatcaacaacacccagctgagtgacaccggcacctaccagtgcctggtgaacaacctgcctgacatcggcggcagaaatattggagtgacaggcctgactgtgctggtgcccccatctgccccccactgccagatccagggcagccaggacattggaagtgatgtgatcctgctgtgcagcagcgaggagggcatcccccggcccacctacctgtgggagaagctggacaacaccctgaagctgcccccaacagccacccaggaccaggtgcagggcaccgtgaccatccggaacatcagcgccctgagcagcggcctgtaccagtgtgtggccagcaatgccatcggcaccagcacctgcctgctggacctgcaggtgatcagcccccagcccaggaacatcggcctgattgctggggccatcggcactggagctgtgatcatcatcttctgcatcgccctgatcctgggcgccttcttctactggaggagcaagaacaaggaggaggaggaggaggagatccccaatgagatccgggaggatgacctgccccccaagtgcagcagcgccaaggccttccacacagagatcagcagcagtgacaacaacaccctgaccagcagcaatgcctacaacagccgctactggagcaacaaccccaaggtgcacaggaacacagagagcgtgagccacttcagtgacctgggccagagcttctccttccacagcggaaatgccaacatccccagcatctatgccaacggcacccacctggtgcccggccagcacaagaccctggtggtgacagccaacagaggcagcagcccccaggtgatgagccgcagcaatggatctgtgtccaggaagccccggcccccccacacccacagctacaccatcagccacgccaccctggagcgcatcggggctgtgcctgtgatggtgcctgcccagagcagagctggcagcctggtgtag

SEQ ID NO: 34790 - DNA, 1293 bp, Artificial Sequence; identical to SEQ ID NO: 34788
  Description of Artificial Sequence: Synthetic coding sequence

SEQ ID NO: 34791 - DNA, 579 bp, Artificial Sequence
  Description of Artificial Sequence: Synthetic coding sequence
atgagggccaagccccagagccccctgcccagaaatcctgtgcctgcctggagcccccccaccaccaccacagaccccatgctggagaaggatgctgctggaggagacttccctgccaacctggtgctgcagctgatgcccctgaagaccttccctgctgccatccggggcgtcatccagagcgagctgaactacagcgtcatcctgcagtgggtggtgaccatggaccctgagcctgtgctgtcctggaccttcagcggcgtgccctgtggcatgggagagaagctgttcatccggcggctgagctgtgagcagctgggcacctacatgtgcatcgccaccaacagcaagaagcagctggtgtctgagcctgtgaccatcagcctgcccaagcccatcatgcagcccacagaagctgagcccatggagccagaccccaccctgagcctgagcggcggcagcgccatcggcctgctggccgccggcatcctgggcgctggggccctgattgctggcatgtgcttcatcatcatccagagcctgaggacagaccggcagagaattggcatctgcagctag

SEQ ID NO: 34792 - DNA, 1224 bp, Artificial Sequence
  Description of Artificial Sequence: Synthetic coding sequence
atgggccagaaggagaggagcacagctgacaccctgcctgacctggaggagtggaagtctgctgctggcctgcgctggtggcagacagctgtggtggatggcagcggcagcggaaatgaagtcatcgagggcccccagaatgcccgggtgctgaagggcagccaggcccgcttcaactgcaccgtgtcccagggctggaagctgatcatgtgggccctgagtgacatggtggtgctgtctgtgcggcccatggagcccatcatcaccaatgaccgcttcaccagccagagatatgaccagggcggcaacttcaccagcgagatgatcatccacaacgtggagcccagcgacagcggcaacatccgctgcagcctgcagaacagccggctgcacggcagcgcctacctgactgtgcaggtgatgggagagctgttcatccccagcgtgaacctggtggtggctgaaaatgagccctgtgaggtgacctgcctgcccagccactggacccggctgcctgacatctcctgggagctgggcctgctggtgagccacagcagctactactttgtgcctgagcccagcgacctgcagagcgctgtgtccatcctggccctgaccccccagagcaatggcaccctgacctgtgtggccacctggaagagcctgaaggccaggaagagcgccaccgtgaacctgaccgtcatccgctgcccccaggacacaggaggcggcatcaacatccctggggtgctgagcagcctgcccagcctgggcttcagcctgcccacctggggcaaggtgggcctgggcctggccggcaccatgctgctgacccccacctgcaccctgaccatccgctgctgctgctgcagaagacgctgctgcggctgcaactgctgctgccgctgctgcttctgctgcaggaggaagaggggcttccgcatccagttccagaagaagtctgagaaggagaagaccaacaaggagacagaaacagagagcggaaatgaaaattctggctacaacagtgatgagcagaagaccacagacacagccagcctgccccccaagagctgtgagagcagtgaccctgagcagaggaacagcagctgtggccccccccaccagagagctgaccagaggcctcccaggcctgccagccacccccaggccagcttcaacctggccagccctgagaaggtgagcaacaccaccgtggtgtag

SEQ ID NO: 34793 - DNA, 1920 bp, Artificial Sequence
  Description of Artificial Sequence: Synthetic coding sequence
atggacagagtgctgctgcgctggatcagcctcttctggctgacagccatggtggagggcctgcaggtgacagtgcctgacaagaagaaggtggccatgctgttccagcccaccgtgctgcgctgccacttcagcaccagcagccaccagcctgctgtggtgcagtggaagttcaagagctactgccaggacaggatgggagagagcctgggcatgagcagcacccgggcccagagcctgagcaagaggaacctggagtgggacccctacctggactgcctggacagcagaagaacagtgcgggtggtggccagcaagcagggcagcacagtgaccctgggggacttctaccggggccgggagatcaccatcgtgcatgatgctgacctgcagatcggcaagctgatgtggggagacagcggcctgtactactgcatcatcaccaccccagatgacctggagggcaagaatgaagacagcgtggagctgctggtgctgggccgcacaggcctgctggccgacctgctgcccagctttgctgtggagatcatgcctgagtgggtgtttgtgggcctggtgctgctgggcgtcttcctgttctttgtgctggtgggcatctgctggtgccagtgctgcccccacagctgctgctgctacgtgcgctgcccctgctgcccagacagctgctgctgcccccaggccctgtatgaggccggcaaggccgccaaggccggctacccaccttctgtgtctggagtgcccggcccctacagcatccccagcgtgcccctgggcggggcccccagcagcggcatgctgatggacaagccccaccccccacccctggcccccagcgacagcactggaggcagccacagcgtgaggaagggctaccgcatccaggccgacaaggagcgggacagcatgaaggtgctgtactacgtggagaaggagctggcccagtttgatcctgcccggaggatgaggggccgctacaacaacaccatcagcgagctgagcagcctgcacgaggaggacagcaacttccggcagagcttccaccagatgaggagcaagcagtttcctgtgtctggggacctggagagcaacccagactactggagcggcgtgatgggcggcagcagcggggccagccggggccccagcgccatggagtacaacaaggaggaccgggagagcttccgccacagccagcccaggagcaagtctgagatgctgagcaggaagaactttgccaccggggtgcctgctgtgtccatggatgagctggccgcctttgctgacagctatggccagaggccccggcgggcagatggcaacagccatgaggcccggggcggcagcagatttgagaggtctgagagccgggcccacagcggcttctaccaggatgacagcctggaggagtactacggccagaggagccgcagccgggagcccctgacagatgctgaccggggctgggccttctccccagcccggcggcggccagcagaagatgcccacctgccccggctggtgtccaggaccccaggcacagcccccaagtatgaccacagctacctgggcagcgcccgggagcggcaggcccggcctgagggcgccagcagaggaggcagcctggagacccccagcaagaggtctgcccagctgggccccaggtctgccagctactatgcctggagccccccaggcacctacaaggccggcagcagccaggatgaccaggaggatgccagtgatgatgccctgcccccctacagcgagctggagctgacccggggccccagctaccggggccgggacctgccctaccacagcaacagcgagaagaagaggaagaaggagcccgccaagaagaccaatgacttccccaccaggatgagcctggtggtgtag

SEQ ID NO: 34794 - DNA, 1644 bp, Artificial Sequence
  Description of Artificial Sequence: Synthetic coding sequence
atggccatgggcctcttccgggtgtgcctggtggtggtgacagccatcatcaaccaccccctgctcttcccccgggagaatgccaccgtgcctgaaaatgaggaggagatcatcaggaagatgcaggcccaccaggagaagctgcagctggagcagctgcggctggaggaggaggtggcccggctggccgctgagaaggaggccctggagcaggtggccgaggagggccggcagcagaatgagaccagggtggcctgggacctgtggagcaccctgtgcatgatcctcttcctgatgattgaggtgtggaggcaggaccaccaggagggccccagccctgagtgcctgggcggggaggaggatgagctgcccggcctgggcggggcccccctgcagggcctgaccctgcccaacaaggccaccctgggccacttctatgagcgctgcatccggggggccacagcagatgctgcccggacccgggagttcctggagggctttgtggatgacctgctggaggccctgcggagcctgtgcaacagagacacagacatggaggtggaggacttcatcggcgtggacagcatgtatgagaactggcaggtggaccggcccctgctgtgccacctgtttgtgcccttcaccccacctgagccctaccgcttccaccctgagctgtggtgcagcggccgctctgtgcccctggaccggcagggctacggccagatcaaggtggtgcgggcagatggagacaccctgagctgcatctgtgggaagaccaagctgggggaggacatgctgtgcctgctgcatggaagaaattccatggccccaccctgtggggacatggagaacctgctgtgtgccacagacagcctgtacctggacaccatgcaggtgatgaagtggttccagacagccctgacccgggcctggaagggcatcgcccacaagtatgaatttgacctggccttcggccagctggacagccctggcagcctgaagatcaagttccgcagcggcaagttcatgcccttcaacctgatccctgtgatccagtgtgatgacagcgacctgtactttgtgagccacctgccccgggagcccagcgagggcaccccagccagcagcacagactggctgctgagctttgctgtgtatgagcggcacttcctgcggaccaccctgaaggccctgcctgagggcgcctgccacctgagctgcctgcagatcgccagcttcctgctgagcaagcagagccggctgaccggccccagcggcctgagcagctaccacctgaagacagccctgctgcacctgctgctgctgcggcaggccgctgactggaaggccggccagctggatgcccggctgcacgagctgctgtgcttcctggagaagagcctgctgcagaagaagctgcaccacttcttcatcggcaacaggaaggtgcctgaggccatgggcctgcctgaggccgtgctgcgggcagagcccctgaacctcttccggccctttgtgctgcagaggagcctgtacaggaagaccctggacagcttctatgagatgctgaagaatgccccagccctgatcagcgagtacagcctgcacgtgcccagcgaccagcccacccccaagagctag

SEQ ID NO: 34795 - DNA, 1644 bp, Artificial Sequence; identical to SEQ ID NO: 34794
  Description of Artificial Sequence: Synthetic coding sequence

SEQ ID NO: 34796 - DNA, 1644 bp, Artificial Sequence; identical to SEQ ID NO: 34794
  Description of Artificial Sequence: Synthetic coding sequence

SEQ ID NO: 34797 - DNA, 345 bp, Artificial Sequence
  Description of Artificial Sequence: Synthetic coding sequence
atggccatgggcctcttccgggtgtgcctggtggtggtgacagccatcatcaaccaccccctgctcttcccccgggagaatgccaccgtgcctgaaaatgaggaggagatcatcaggaagatgcaggcccaccaggagaagctgcagctggagcagctgcggctggaggaggaggtggcccggctggccgctgagaaggaggccctggagcaggtggccgaggagggccggcagcagaatgagaccagggtggcctgggacctgtggagcaccctgtgcatgatcctcttcctgatgattgaggtgtggaggcaggaccaccaggagggccccagccctgagtag

SEQ ID NO: 34798 - DNA, 1692 bp, Artificial Sequence
  Description of Artificial Sequence: Synthetic coding sequence
atgaccacagacagctacagccccaccagcccagatgctgaggcctccatggccgtcatcagcctgctcttcctggccgtgatgtatgtggtgcaccaccccctgatggtgtctgacaggatggacctggacaccctggcccggagccggcagctggagaagaggatgtctgaggagatgaggctgctggagatggagtttgaggagaggaagagagctgctgagcagaggcagaaggccgagaacttctggacaggagacaccagcagtgaccagctggtgctgggcaagaaggacatgggctggcccttccaggctgatggccaggagggccccctgggctggatgctgggcaacctgtggaacacaggcctcttctgcctcttcctggtgtttgagctgctgcggcagaacatgcagcacgagcccgcctttgacagcagcagcgaggaggaggaggaggaggtgcgggtggtgcctgtgaccagctacaactggctgacagacttccccagccaggaggccctggacagcttctacaagcactacgtgcagaatgccatccgggacctgccctgcacctgtgaatttgtggagagctttgtggatgacctgattgaggcctgccgggtgctgagccggcaggaggcccacccccagctggaggactgcctgggcattggagctgcctttgagaagtggggcaccctgcacgagacccagaagtttgacatcctggtgcccatcgtgcccccccagggcaccatgtttgtgctggagatgagggaccctgccctgggccgccgctgtggctgtgtgctggtggagagtgaatgtgtgtgcaagcgggagaagctgctgggagatgtgctgtgcctggtgcaccaccaccgggaccccagcgctgtgctgggcaagtgcagcagcagcatcaaggccgccctgtgcaccggcttccacctggatgtgtgcaagacagtgcagtggttcaggaacatgatgggaaatgcctgggccctggtggcccacaagtatgacttcaagctgagcctgccccccagcaccaccagctgcaagctgcggctggactaccgcagcggccgcttcctgagcatccacctggtgctgggcgtgcagcgggaggacaccctggtgtacctggtgtcccaggccccagaccaggagcagctgacctctgtggactggccagagagctttgtggcctgtgagcacctgttcctgaagctggtgggccgctttgcccctgagaacacctgccacctgaagtgcctgcagatcatcctgagcctgcggcagcaccagagcctgccccatggagccagccggcccatcctgaccagctaccacttcaagacagccctgatgcacctgctgctgcggctgcccctgacagactgggcccacaacatgctgagccagaggctgcaggacatcctgtggttcctgggccggggcctgcagcagaggagcctgcaccacttcctgattggcaacaacttcctgcccctgaccatccccatccccaagaccttcagaaatgctgagcctgtgaacctcttccagcacctggtgctgaaccccaaggcccacagccaggccgtggaggagttccagaacctgctgacccaggtgaagaccctgccccacgcccccctggccgccgccccctag

SEQ ID NO: 34799 - DNA, 1668 bp, Artificial Sequence
  Description of Artificial Sequence: Synthetic coding sequence
atgaatgtggatgctgaggcctccatggccgtcatcagcctgctcttcctggccgtgatgtatgtggtgcaccaccccctgatggtgtctgacaggatggacctggacaccctggcccggagccggcagctggagaagaggatgtctgaggagatgaggctgctggagatggagtttgaggagaggaagagagctgctgagcagaggcagaaggccgagaacttctggacaggagacaccagcagtgaccagctggtgctgggcaagaaggacatgggctggcccttccaggctgatggccaggagggccccctgggctggatgctgggcaacctgtggaacacaggcctcttctgcctcttcctggtgtttgagctgctgcggcagaacatgcagcacgagcccgcctttgacagcagcagcgaggaggaggaggaggaggtgcgggtggtgcctgtgaccagctacaactggctgacagacttccccagccaggaggccctggacagcttctacaagcactacgtgcagaatgccatccgggacctgccctgcacctgtgaatttgtggagagctttgtggatgacctgattgaggcctgccgggtgctgagccggcaggaggcccacccccagctggaggactgcctgggcattggagctgcctttgagaagtggggcaccctgcacgagacccagaagtttgacatcctggtgcccatcgtgcccccccagggcaccatgtttgtgctggagatgagggaccctgccctgggccgccgctgtggctgtgtgctggtggagagtgaatgtgtgtgcaagcgggagaagctgctgggagatgtgctgtgcctggtgcaccaccaccgggaccccagcgctgtgctgggcaagtgcagcagcagcatcaaggccgccctgtgcaccggcttccacctggatgtgtgcaagacagtgcagtggttcaggaacatgatgggaaatgcctgggccctggtggcccacaagtatgacttcaagctgagcctgccccccagcaccaccagctgcaagctgcggctggactaccgcagcggccgcttcctgagcatccacctggtgctgggcgtgcagcgggaggacaccctggtgtacctggtgtcccaggccccagaccaggagcagctgacctctgtggactggccagagagctttgtggcctgtgagcacctgttcctgaagctggtgggccgctttgcccctgagaacacctgccacctgaagtgcctgcagatcatcctgagcctgcggcagcaccagagcctgccccatggagccagccggcccatcctgaccagctaccacttcaagacagccctgatgcacctgctgctgcggctgcccctgacagactgggcccacaacatgctgagccagaggctgcaggacatcctgtggttcctgggccggggcctgcagcagaggagcctgcaccacttcctgattggcaacaacttcctgcccctgaccatccccatccccaagaccttcagaaatgctgagcctgtgaacctcttccagcacctggtgctgaaccccaaggcccacagccaggccgtggaggagttccagaacctgctgacccaggtgaagaccctgccccacgcccccctggccgccgccccctag

SEQ ID NO: 34800 - DNA, 1644 bp, Artificial Sequence
  Description of Artificial Sequence: Synthetic coding sequence
atggccgtcatcagcctgctcttcctggccgtgatgtatgtggtgcaccaccccctgatggtgtctgacaggatggacctggacaccctggcccggagccggcagctggagaagaggatgtctgaggagatgaggctgctggagatggagtttgaggagaggaagagagctgctgagcagaggcagaaggccgagaacttctggacaggagacaccagcagtgaccagctggtgctgggcaagaaggacatgggctggcccttccaggctgatggccaggagggccccctgggctggatgctgggcaacctgtggaacacaggcctcttctgcctcttcctggtgtttgagctgctgcggcagaacatgcagcacgagcccgcctttgacagcagcagcgaggaggaggaggaggaggtgcgggtggtgcctgtgaccagctacaactggctgacagacttccccagccaggaggccctggacagcttctacaagcactacgtgcagaatgccatccgggacctgccctgcacctgtgaatttgtggagagctttgtggatgacctgattgaggcctgccgggtgctgagccggcaggaggcccacccccagctggaggactgcctgggcattggagctgcctttgagaagtggggcaccctgcacgagacccagaagtttgacatcctggtgcccatcgtgcccccccagggcaccatgtttgtgctggagatgagggaccctgccctgggccgccgctgtggctgtgtgctggtggagagtgaatgtgtgtgcaagcgggagaagctgctgggagatgtgctgtgcctggtgcaccaccaccgggaccccagcgctgtgctgggcaagtgcagcagcagcatcaaggccgccctgtgcaccggcttccacctggatgtgtgcaagacagtgcagtggttcaggaacatgatgggaaatgcctgggccctggtggcccacaagtatgacttcaagctgagcctgccccccagcaccaccagctgcaagctgcggctggactaccgcagcggccgcttcctgagcatccacctggtgctgggcgtgcagcgggaggacaccctggtgtacctggtgtcccaggccccagaccaggagcagctgacctctgtggactggccagagagctttgtggcctgtgagcacctgttcctgaagctggtgggccgctttgcccctgagaacacctgccacctgaagtgcctgcagatcatcctgagcctgcggcagcaccagagcctgccccatggagccagccggcccatcctgaccagctaccacttcaagacagccctgatgcacctgctgctgcggctgcccctgacagactgggcccacaacatgctgagccagaggctgcaggacatcctgtggttcctgggccggggcctgcagcagaggagcctgcaccacttcctgattggcaacaacttcctgcccctgaccatccccatccccaagaccttcagaaatgctgagcctgtgaacctcttccagcacctggtgctgaaccccaaggcccacagccaggccgtggaggagttccagaacctgctgacccaggtgaagaccctgccccacgcccccctggccgccgccccctag

SEQ ID NO: 34801 - DNA, 1644 bp, Artificial Sequence; identical to SEQ ID NO: 34800
  Description of Artificial Sequence: Synthetic coding sequence

SEQ ID NO: 34802 - DNA, 1608 bp, Artificial Sequence
  Description of Artificial Sequence: Synthetic coding sequence
atgtctgtgcactacaccctgaacctgcgggtcttctggcccctggtgacaggcctgtgcacagccctggtgtgcctgtaccacgtgctgcggggcagcggcggggcccgggcagagccagcagatggagtggatggcggcttccccctgctgaaggtggccgtgctgctgctgctgtcctatgtgctgctgcgctgcagacatgctgtgcggcagcgcttcctgcccggcagcccccggctggagggccatgctgccttcagcagccgccacttccgggagcccggcctgagcatcctgctggagagctactatgaacatgaggtgcggctgagcccccacgtgctgggccacagcaaggcccacgtgagccgcatcgtgggggagctggtgcgggccggccgggcccggggcagccctggcctcatccctgggggcgccctggccctggccttccggggggacttcatccaggtgggcagcgcctatgagcagcacaagatcagaagaccagacagctttgatgtgctggtgcccctgcggctgccccccctggtggccctggagcccaggagcctgggggaggagcccgccctggccccagccttccggggctgcttcctgtgtgccctgaaggccccacccagccccagcggggccagcggcggccactggctgcgggactgcaagccctttgctgatgccttctgtgtggatgtgcggggcagaagacacctgagcgccaccctggtgctgcgctggttccagagccacctgcagaggagcctggccaccgtgcgctacagcctggagggccgctgccgggtgaccctgacccctgggggcctggagcagccccccaccctgcacatcctgccctgcaggacagattatggctgctgccgcctgtccatggctgtgcggctcatcccagctgtgcacctgggagatggagtcttcctggtggcccctcctcctccacccctgcccagcgcccccctgctggagctgcctgagggcctgcgggcagaggccctgtggggcgtgaacacagcccggcaggagcagaagctgctgtcctggctgcaggagcgggccgcccctggggcctgctacctgaagtgcctgcagctgctgaaggccctgcgggacctgggcgcccggggcctggacagcgctgctgccacccagtggggccgcatcctgagcagctatgtgctgaagacagtgctgctggccgtgctgctgaggaagggggcccctggccagggctgggatgaggagcacctgggccgctgcctggaggagctggtgcagttcctgcgggactgcctgctgcggcggcacaccctcttccactgtgtgctgggccctgggggcgctgctgctgaggtgggccccctgcccaaggccctgcgggaggccgcccctgtggacctgctggccgcctttgatggccacgcccgggagctggccgccgcccggctgctgagcacctggcagaggctgccccagctgctgcgggcctacggcggcccccgctacctggcccgctgccccccacccaggagccagaggacccagggcttcctggagggggagccctag

SEQ ID NO: 34803 - DNA, 3774 bp, Artificial Sequence
  Description of Artificial Sequence: Synthetic coding sequence
atggccagctgcagcttcacccgggaccaggccacccggcggctgcggggagctgctgctgctgctgctgctgccctggccgctgtggtgaccacccccctgctgagcagcggcacccccacagccctgattggcaccggcagcagctgccctggggccatgtggctgagcacagccaccggcagcagaagtgacagcgagagcgaggaggaggacctgcctgtgggggaggaggtgtgcaagaggggctacctgaggaagcagaagcacggccaccggcgctactttgtgctgaagctggagacagcagatgccccagcccggctggagtactatgaaaatgccaggaagttccgccacagcgtgcgggctgctgctgctgctgctgctgctgctgccagcggggccgccatccccccactcatccccccaagaagagtcatcaccctgtaccagtgcttctctgtgtcccagagagcagatgcccgctaccgccacctgattgccctcttcacccaggatgagtactttgccatggtggccgagaatgaaagtgagcaggagagctggtacctgctgctgagccgcctcatcctggagagcaagagaagaagatgtggcaccctgggcgcccagccagatggagagcctgctgccctggccgctgctgctgctgctgagccccccttctacaaggatgtgtggcaggtgattgtgaagccccggggcctgggccacaggaaggagctgtctggagtcttccggctgtgcctgacagatgaggaggtggtgtttgtgcggctgaacacagaggtggcctctgtggtggtgcagctgctgagcatcagaagatgtggccacagcgagcagtacttcttcctggaggtgggccgcagcaccgtcatcggccctggagagctgtggatgcaggtggatgactgtgtggtggcccagaacatgcatgagctgttcctggagaagatgagggccctgtgtgctgatgagtaccgggcccgctgccgcagctacagcatcagcattggagcccacctgctgaccctgctgagcgcccggcggcacctgggcctggtgcccctggagcccggcggctggctgcggcgcagcagatttgagcagttctgccacctgcgggccatcggagatggagaagatgagatgctgttcaccaggagatttgtgaccccatctgagcctgtggcccacagccggcggggccgcctgcacctgccccggggccgccgcagcagaagagctgtgtctgtgcctgccagcttcttccggcggctggcccccagccctgcccggcccaggcaccctgctgaggcccccaacaacggggcccggctgagcagcgaggtgtctggcagcggcagcggcaactttggagaggagggcaacccccagggcaaggaggaccaggagggcagcggcggggactacatgcccatgaacaactggggcagcggaaatggccggggcagcggcggcggccagggcagcaatggccagggcagcagcagccacagcagcggcggcaaccagtgcagcggggagggccagggcagcagaggaggccagggcagcaatggccagggcagcggcggcaaccagtgcagcagagatggccagggcacagctgggggccacggcagcggcggcggccagaggcctgggggcggccacggcagcggcggcggccagggccctggagatggccacggcagcggcggcggcaagaacagcggcggcggcaagggcagcggcagcggcaagggcagtgatggagatggagagcggggcaagagcctgaagaagaggagctactttgggaagctgacccagagcaagcagcagcagatgcctcctcctcctcctcctcctcctcctcctcctcctgctgggggcactggaggcaagggcaagagcggcggccgcttccggctgtacttctgtgtggacagaggagccaccaaggagtgcaaggaggccaaggaggtgaaggatgctgagatccctgagggcgccgcccggggcccccaccgggcccgggcctttgatgaagatgaagatgacccctacgtgcccatgaggcctggggtggccacccccctggtgagcagcagtgactacatgcccatggccccccagaatgtgtctgccagcaagaagaggcacagccgcagcccctttgaggacagccggggctacatgatgatgttcccccgggtgagccccccaccagcccccagcccccccaaggccccagacaccaacaaggaggatgacagcaaggacaatgattctgagagtgactacatgttcatggcccctggggccggggccatccccaagaaccccaggaacccccagggcggcagcagcagcaagtcctggagcagctacttcagcctgcccaaccccttccgcagcagccccctgggccagaatgacaacagtgaatatgtgcccatgctgcccgggaagttcctgggccggggcctggacaaggaggtgtcctacaactgggaccccaaggatgctgccagcaagcccagcggggagggcagcttcagcaagccaggagatggcggcagccccagcaagcccagcgaccacgagccccccaagaacaaggccaagaggcccaaccggctgtccttcatcaccaagggctacaagatcaagcccaagccccagaagcccacccatgagcagcgggaggccgacagcagcagtgactatgtgaacatggacttcaccaagcgggagagcaacaccccagcccccagcacccagggcctgcctgacagctggggcatcatcgccgagccccggcagagcgccttcagcaactacgtgaatgtggagtttggagtgcccttccccaacccagccaatgacctgagtgacctgctgcgggccatcccccgggccaaccccctgagcctggacagcgcccgctggcccctgccccccctgcccctgagcgccaccggcagcaatgccatcgaggaggagggggactacattgaagtcatcttcaacagcgccatgaccccagccatggccctggccgacagcgccatccgctatgatgctgagaccggccgcatctacgtggtggaccccttcagcgagtgctgcatggacatcagcctgagccccagccgctgcagcgagcccccacctgtggcccggctgctgcaggaggaggagcaggagaggagaagaccccagagccgcagccagagcttctttgctgctgcccgggctgctgtgtctgccttccccacagacagcctggagcgggacctgagccccagcagcgccccagctgtggccagcgctgctgagcccaccctggccctgagccaggtggtggccgccgccagcgccctggccgccgcccctggcatcggggctgctgctgctgctgctggctttgattctgccagcgcccgctggttccagcctgtggccaatgctgctgatgctgaggccgtgcggggggcccaggatgtggccggcggcagcaaccctggggcccacaaccccagcgccaacctggcccggggggacaaccaggccggcggcgctgctgctgctgctgctgcccctgagcccccacccaggagccggcgggtgcccaggcctcctgagagagaagattctgacaatgatgatgacacccacgtgaggatggactttgcccggcgggacaaccagtttgacagccccaagagaggaagatag

SEQ ID NO: 34804 - DNA, 7185 bp, Artificial Sequence
  Description of Artificial Sequence: Synthetic coding sequence
atgtggctgagcggcaagagccaggtgcagaagagaggagctgtgcgctacctgcaggcccctcctgtgaatggagaggccagcgcctgcccagccccacccacccacctggacaggaccacctgtgccaggagaagacctgcccggctgcccccaccctggggcgctgctggcatccggcctgccccccgggccagccgggccagcttctgggcccgcttccccccccactgcttccccagcggctgcagcggcagccgggtgctggagggcggggagatcggcttccgcttccggggcggccgggtggccgccgccgccctgcggagccgctgggcccggggagatgctgctgctgctggcagccgggagggccggggccgcatgaacagagccaagcccaccaccgtgcggcggcccagcgctgctgccaagcccagcggccaccccccacctggggacttcatcgccctgggcagcaagggccaggccaatgaaagcaagacagccagcaccctgctgaagccagcccccagcggcctgcccagcgagaggaagagagatgctgctgctgccctgagcagcgccagcgccctgaccggcctgaccaagaggcccaagctgagcagcaccccacccctgagcgccctgggccgcctggccgaggccgctgtggccgagaagagggccatcagccccagcatcaaggagcccagcgtggtgcccatcgaggtgctgcccaccgtgctgctggatgaaattgaggccgctgagctggagggcaatgatgaccgcatcgagggcgtgctgtgtggggctgtgaagcagctgaaggtgacccgggccaagccagacagcaccctgtacctgagcctgatgtacctggccaagatcaagcccaacatctttgccacagaaggagtgattgaggccctgtgcagcctgctgcggagagatgccagcatcaacttcaaggccaagggcaacagcctggtgtctgtgctggcctgcaacctgctgatggccgcctatgaggaggatgagaactggccagagatctttgtgaaggtgtacatcgaggacagcctgggggagcgcatctgggtggacagcccccactgcaagacctttgtggacaacatccagacagccttcaacaccaggatgccacccaggtctgtgctgctgcagggcgaggccggccgggtggccggggacctgggcgccggcagcagcccccaccccagcctgacagaggaggaggacagccagacagagctgctgattgctgaggagaagctgagccctgagcaggagggccagctgatgcccaggtatgaggagctggccgagagcgtggaggagtatgtgctggacatgctgcgggaccagctgaacagacggcagcccatcgacaacgtgtccaggaacctgctgcggctgctgaccagcacctgtggctacaaggaggtgcggctgctggccgtgcagaagctggagatgtggctgcagaaccccaagctgaccaggcctgcccaggacctgctgatgtctgtgtgcatgaactgcaacacccacggcagcgaggacatggatgtgatcagccacctgatcaagatccggctgaagcccaaggtgctgctgaaccacttcatgctgtgcatccgggagctgctgagcgcccacaaggacaacctgggcaccaccatcaagctggtgatcttcaatgagctgagcagcgccaggaaccccaacaacatgcaggtgctgtacacagccctgcagcacagcagcgagctggcccccaagttcctggccatggtgttccaggacctgctgaccaacaaggatgactacctgcgggccagccgggccctgctgcgggagatcatcaagcagaccaagcatgagatcaacttccaggccttctgcctgggcctgatgcaggagaggaaggagccccagtacctggagatggagttcaaggagagatttgtggtgcacatcacagatgtgctggccgtgtccatgatgctgggcatcacagcccaggtgaaggaggccggcatcgcctgggacaagggggagaagaggaacctggaggtgctgcgctccttccagaaccagattgctgccatccagagagatgctgtgtggtggctgcacacagtggtgcccagcatcagcaagctggcccccaaggactatgtgcactgcctgcacaaggtgctcttcacagagcagcctgagacctactacaagtgggacaactggcccccagagagtgacaggaacttcttcctgcggctgtgcagcgaggtgcccatcctggaggacaccctgatgaggatcctggtgattggcctgagccgggagctgcccctgggccctgcagatgccatggagctggccgaccacctggtgaagagagctgctgctgtgcaggctgatgatgtggaggtgctgaaggtgggccgcacccagctgattgatgctgtgctgaacctgtgcacctaccaccaccctgagaacatccagctgcccccaggctaccagccccccaacctggccatcagcaccctgtactggaaggcctggcccctgctgctggtggtggccgccttcaaccctgagaacatcggcctggccgcctgggaggagtaccccaccctgaagatgctgatggagatggtgatgaccaacaactacagctacccaccctgcaccctgacagatgaggagaccaggacagagatgctgaaccgggagctgcagacagcccagcgggagaagcaggagatcctggcctttgagggccacctggccgccgccagcaccaagcagaccatcacagagagcagcagcctgctgctgagccagctgaccagcctggacccccagtatgctgcccacacagccccaccctgtgcctgcagaagagacctgggccccccccggcggcccccaccccacatcctggaccaggtgaagagcctgaaccagagcctgcggctgggccacctgctgtgccgcagcagaaatccagacttcctgctgcacatcatccagaggcaggccagcagccagagcatgccctggctggccgacctggtgcagagcagcgagggcagcctggatgtgctgcctgtgcagtgcctgtgtgagttcctgctgcatgatgctgtggatgatgctgccagcggggaggaggatgatgaaggagagagcaaggagcagaaggccaagaagaggcagaggcagcagaagcagaggcagctgctgggccgcctgcaggacctgctgctgggccccaaggcagatgagcagaccacctgtgaggtgctggactacttcctgcggcggctgggcagcagccaggtggccagccgggtgctggccatgaagggggagaccctgcctgccctgcccaaggccggccctgcccacgagtgcctgccccagggcctgagcctggtgctgtctgagggcagcctgagagatggagaggagaaggagccccccatggaggaggatgtgggggacacagatgtgctgcagggctaccagtggctgctgcgggacctgccccggctgcccctgtttgattctgtgcgcagcaccacagccctggccctgcagcaggccatccacatggagacagacccccagaccatcagcgcctacctgatctacctgagccagcacacccctgtggaggagcaggcccagcacagcgacctggccctggatgtggcccggctggtggtggagaggagcaccatcatgagccacctgttcagcaagctgagccccagcgctgccagtgatgctgtgctgagcgccctgctgagcatcttcagccgctacgtgcggaggatgaggcagagcaaggagggggaggaggtgtacagctggagcgagagccaggaccaggtgttcctgcgctggagcagcggggagacagccaccatgcacatcctggtggtgcacgccatggtgatcctgctgaccctgggcccccccagggcagatgacagcgagttccaggccctgctggacatctggttccctgaggagaagcccctgcccacagccttcctggtggacaccagcgaggaggccctgctgctgcctgactggctgaagctgaggatgatccgctctgaggtgctgcggctggtggatgctgccctgcaggacctggagccccagcagctgctgctgtttgtgcagagctttggcatccctgtgtcctccatgagcaagctgctgcagttcctggaccaggccgtggcccatgacccccagaccctggagcagaacatcatggacaagagcaagatgcctggcacctgtggggtgggcagccacaccctgacagagccccagcccggccaggccttcggggcctgggtgcgggccggcgtgaccctgctgcgctttgctgactacatggcccacctggtggaggtgcagcacgagcggggggccagcggcggccagaccttccacagcctgctgacagccagcctgcccccccggcgggacagcacagaggcccccaagcccaagagcagccctgagcagcccatcggccagggccgcatccgggtgggcacccagctgcgggtgctgggcccagaagatgacctggccggcatgttcctgcagatcttccccctgagcccagacccccgctggcagagcagcagccccaggcctgtggccctggccctgcagcaggccctgggccaggagctggcccgggtggtgcagggcagccctgaggtgcccggcatcaccgtgcgggtgctgcaggccctggccaccctgctgagcagcccccacggcggggccctggtgatgtccatgcacaggagccacttcctggcctgccccctgctgcggcagctgtgccagtaccagagatgtgtgccccaggacaccggcttcagcagcctcttcctgaaggtgctgctgcagatgctgcagtggctggacagccctggggtggagggcggccccctgcgggcccagctgaggatgctggccagccaggccagcgctggaagaaggctgagtgatgtgcggggcggcctgctgcggctggccgaggccctggccttccggcaggacctggaggtggtgagcagcacagtgcgggccgtcatcgccaccctgcggtctggagagcagtgcagcgtggagccagacctgatcagcaaggtgctgcagggcctcatcgaggtgcgcagcccccacctggaggagctgctgacagccttcttcagcgccacagcagatgctgccagccccttccctgcctgcaagcctgtggtggtggtgagcagcctgctgctgcaggaggaggagcccctggccggcggcaagccaggagcagatggcggcagcctggaggccgtgcggctgggccccagcagcggcctgctggtggactggctggagatgctggaccctgaggtggtgagcagctgcccagacctgcagctgcggctgctcttcagcaggaggaagggcaagggccaggcccaggtgcccagcttccggccctacctgctgaccctcttcacccaccagagctcctggcccaccctgcaccagtgcatccgggtgctgctgggcaagagccgggagcagagatttgaccccagcgccagcctggacttcctgtgggcctgcatccacgtgccccgcatctggcagggccgggaccagaggaccccccaggccggcctgggcaggaagagaagagaggagctggtgctgcgggtgcagggccctgagctgatcagcctggtggagctgatcctggccgaggccgagaccaggagccaggatggagacacagctgcctgcagcctcatccaggcccggctgcccctgctgctgagctgctgctgcggagatgatgaatctgtgaggaaggtgacagagcacctgagcggctgcatccagcagtggggagacagcgtgctgggccgccgctgccgggacctgctgctgcagctgtacctgcagaggcctgagctgcgggtgcctgtgcctgaggtgctgctgcacagcgagggcgccgccagcagctctgtgtgcaagctggatggcctcatccaccgcttcatcaccctgctggccgacaccagtgacagccgggccctggagaacagaggagcagatgcctccatggcctgcaggaagctggccgtggcccaccccctgctgctgctgcggcacctgcccatgattgctgccctgctgcacggccgcacccacctgaacttccaggagttccggcagcagaaccacctgagctgcttcctgcacgtgctgggcctgctggagctgctgcagccccacgtgttccgctctgagcaccagggcgccctgtgggactgcctgctgtccttcatccggctgctgctgaactacaggaagagcagccgccacctggccgccttcatcaacaagtttgtgcagttcatccacaagtacatcacctacaatgccccagctgccatctccttcctgcagaagcacgccgaccccctgcatgacctgagctttgacaacagcgacctggtgatgctgaagagcctgctggccggcctgagcctgcccagcagagatgacagaacagaccggggcctggatgaggagggggaggaggagagcagcgctggcagcctgcccctggtgtctgtgtccctcttcacccccctgacagctgctgagatggccccctacatgaagaggctgagccggggccagacagtggaggacctgctggaggtgctgagtgacattgatgagatgagcagaagaagacctgagatcctgtccttcttcagcaccaacctgcagaggctgatgagcagcgctgaggagtgctgcaggaacctggccttcagcctggccctgcgctccatgcagaacagccccagcattgctgctgccttcctgcccaccttcatgtactgcctgggcagccaggactttgaggtggtgcagacagccctgaggaacctgcctgaatatgccctgctgtgccaggagcacgccgctgtgctgctgcaccgggccttcctggtgggcatgtatggccagatggaccccagcgcccagatcagcgaggccctgcgcatcctgcacatggaggccgtgatgtag

SEQ ID NO: 34805 - DNA, 6573 bp, Artificial Sequence
  Description of Artificial Sequence: Synthetic coding sequence
atgaacagagccaagcccaccaccgtgcggcggcccagcgctgctgccaagcccagcggccaccccccacctggggacttcatcgccctgggcagcaagggccaggccaatgaaagcaagacagccagcaccctgctgaagccagcccccagcggcctgcccagcgagaggaagagagatgctgctgctgccctgagcagcgccagcgccctgaccggcctgaccaagaggcccaagctgagcagcaccccacccctgagcgccctgggccgcctggccgaggccgctgtggccgagaagagggccatcagccccagcatcaaggagcccagcgtggtgcccatcgaggtgctgcccaccgtgctgctggatgaaattgaggccgctgagctggagggcaatgatgaccgcatcgagggcgtgctgtgtggggctgtgaagcagctgaaggtgacccgggccaagccagacagcaccctgtacctgagcctgatgtacctggccaagatcaagcccaacatctttgccacagaaggagtgattgaggccctgtgcagcctgctgcggagagatgccagcatcaacttcaaggccaagggcaacagcctggtgtctgtgctggcctgcaacctgctgatggccgcctatgaggaggatgagaactggccagagatctttgtgaaggtgtacatcgaggacagcctgggggagcgcatctgggtggacagcccccactgcaagacctttgtggacaacatccagacagccttcaacaccaggatgccacccaggtctgtgctgctgcagggcgaggccggccgggtggccggggacctgggcgccggcagcagcccccaccccagcctgacagaggaggaggacagccagacagagctgctgattgctgaggagaagctgagccctgagcaggagggccagctgatgcccaggtatgaggagctggccgagagcgtggaggagtatgtgctggacatgctgcgggaccagctgaacagacggcagcccatcgacaacgtgtccaggaacctgctgcggctgctgaccagcacctgtggctacaaggaggtgcggctgctggccgtgcagaagctggagatgtggctgcagaaccccaagctgaccaggcctgcccaggacctgctgatgtctgtgtgcatgaactgcaacacccacggcagcgaggacatggatgtgatcagccacctgatcaagatccggctgaagcccaaggtgctgctgaaccacttcatgctgtgcatccgggagctgctgagcgcccacaaggacaacctgggcaccaccatcaagctggtgatcttcaatgagctgagcagcgccaggaaccccaacaacatgcaggtgctgtacacagccctgcagcacagcagcgagctggcccccaagttcctggccatggtgttccaggacctgctgaccaacaaggatgactacctgcgggccagccgggccctgctgcgggagatcatcaagcagaccaagcatgagatcaacttccaggccttctgcctgggcctgatgcaggagaggaaggagccccagtacctggagatggagttcaaggagagatttgtggtgcacatcacagatgtgctggccgtgtccatgatgctgggcatcacagcccaggtgaaggaggccggcatcgcctgggacaagggggagaagaggaacctggaggtgctgcgctccttccagaaccagattgctgccatccagagagatgctgtgtggtggctgcacacagtggtgcccagcatcagcaagctggcccccaaggactatgtgcactgcctgcacaaggtgctcttcacagagcagcctgagacctactacaagtgggacaactggcccccagagagtgacaggaacttcttcctgcggctgtgcagcgaggtgcccatcctggaggacaccctgatgaggatcctggtgattggcctgagccgggagctgcccctgggccctgcagatgccatggagctggccgaccacctggtgaagagagctgctgctgtgcaggctgatgatgtggaggtgctgaaggtgggccgcacccagctgattgatgctgtgctgaacctgtgcacctaccaccaccctgagaacatccagctgcccccaggctaccagccccccaacctggccatcagcaccctgtactggaaggcctggcccctgctgctggtggtggccgccttcaaccctgagaacatcggcctggccgcctgggaggagtaccccaccctgaagatgctgatggagatggtgatgaccaacaactacagctacccaccctgcaccctgacagatgaggagaccaggacagagatgctgaaccgggagctgcagacagcccagcgggagaagcaggagatcctggcctttgagggccacctggccgccgccagcaccaagcagaccatcacagagagcagcagcctgctgctgagccagctgaccagcctggacccccagggccccccaagaagacctccaccccacatcctggaccaggtgaagagcctgaaccagagcctgcggctgggccacctgctgtgccgcagcaggaacccagacttcctgctgcacatcatccagaggcaggccagcagccagagcatgccctggctggccgacctggtgcagagcagcgagggcagcctggatgtgctgcctgtgcagtgcctgtgtgagttcctgctgcatgatgctgtggatgatgctgccagcggggaggaggatgatgaaggagagagcaaggagcagaaggccaagaagaggcagaggcagcagaagcagaggcagctgctgggccgcctgcaggacctgctgctgggccccaaggcagatgagcagaccacctgtgaggtgctggactacttcctgcggcggctgggcagcagccaggtggccagccgggtgctggccatgaagggcctgagcctggtgctgtctgagggcagcctgagagatggagaggagaaggagccccccatggaggaggatgtgggggacacagatgtgctgcagggctaccagtggctgctgcgggacctgccccggctgcccctgtttgattctgtgcgcagcaccacagccctggccctgcagcaggccatccacatggagacagacccccagaccatcagcgcctacctgatctacctgagccagcacacccctgtggaggagcaggcccagcacagcgacctggccctggatgtggcccggctggtggtggagaggagcaccatcatgagccacctgttcagcaagctgagccccagcgctgccagtgatgctgtgctgagcgccctgctgagcatcttcagccgctacgtgcggaggatgaggcagagcaaggagggggaggaggtgtacagctggagcgagagccaggaccaggtgttcctgcgctggagcagcggggagacagccaccatgcacatcctggtggtgcacgccatggtgatcctgctgaccctgggcccccccagggcagatgacagcgagttccaggccctgctggacatctggttccctgaggagaagcccctgcccacagccttcctggtggacaccagcgaggaggccctgctgctgcctgactggctgaagctgaggatgatccgctctgaggtgctgcggctggtggatgctgccctgcaggacctggagccccagcagctgctgctgtttgtgcagagctttggcatccctgtgtcctccatgagcaagctgctgcagttcctggaccaggccgtggcccatgacccccagaccctggagcagaacatcatggacaagaactacatggcccacctggtggaggtgcagcacgagcggggggccagcggcggccagaccttccacagcctgctgacagccagcctgcccccaagaagagacagcacagaggcccccaagcccaagagcagccctgagcagcccatcggccagggccgcatccgggtgggcacccagctgcgggtgctgggcccagaagatgacctggccggcatgttcctgcagatcttccccctgagcccagacccccgctggcagagcagcagccccaggcctgtggccctggccctgcagcaggccctgggccaggagctggcccgggtggtgcagggcagccctgaggtgcccggcatcaccgtgcgggtgctgcaggccctggccaccctgctgagcagcccccatggaggagccctggtgatgtccatgcacaggagccacttcctggcctgccccctgctgcggcagctgtgccagtaccagagatgtgtgccccaggacaccggcttcagcagcctcttcctgaaggtgctgctgcagatgctgcagtggctggacagccctggggtggagggcggccccctgcgggcccagctgaggatgctggccagccaggccagcgctggccggcggctgagtgatgtgcggggcggcctgctgcggctggccgaggccctggccttccggcaggacctggaggtggtgagcagcacagtgcgggctgtgattgccaccctgcggagcggggagcagtgcagcgtggagccagacctgatcagcaaggtgctgcagggcctgattgaggtgcgcagcccccacctggaggagctgctgacagccttcttcagcgccacagcagatgctgccagccccttccctgcctgcaagcctgtggtggtggtgagcagcctgctgctgcaggaggaggagcccctggccggcggcaagccaggagcagatggcggcagcctggaggccgtgcggctgggccccagcagcggcctgctggtggactggctggagatgctggaccctgaggtggtgagcagctgcccagacctgcagctgcggctgctcttcagcaggaggaagggcaagggccaggcccaggtgcccagcttccggccctacctgctgaccctcttcacccaccagagctcctggcccaccctgcaccagtgcatccgggtgctgctgggcaagagccgggagcagagatttgaccccagcgccagcctggacttcctgtgggcctgcatccacgtgccccgcatctggcagggccgggaccagaggaccccccagaagagaagagaggagctggtgctgcgggtgcagggccctgagctgatcagcctggtggagctgatcctggccgaggccgagaccaggagccaggatggagacacagctgcctgcagcctcatccaggcccggctgcccctgctgctgagctgctgctgcggagatgatgaatctgtgaggaaggtgacagagcacctgagcggctgcatccagcagtggggagacagcgtgctgggccgccgctgccgggacctgctgctgcagctgtacctgcagaggcctgagctgcgggtgcctgtgcctgaggtgctgctgcacagcgagggcgccgccagcagctctgtgtgcaagctggatggcctcatccaccgcttcatcaccctgctggccgacaccagtgacagccgggccctggagaacagaggagcagatgcctccatggcctgcaggaagctggccgtggcccaccccctgctgctgctgcggcacctgcccatgattgctgccctgctgcacggccgcacccacctgaacttccaggagttccggcagcagaaccacctgagctgcttcctgcacgtgctgggcctgctggagctgctgcagccccacgtgttccgctctgagcaccagggcgccctgtgggactgcctgctgtccttcatccggctgctgctgaactacaggaagagcagccgccacctggccgccttcatcaacaagtttgtgcagttcatccacaagtacatcacctacaatgccccagctgccatctccttcctgcagaagcacgccgaccccctgcatgacctgagctttgacaacagcgacctggtgatgctgaagagcctgctggccggcctgagcctgcccagcagagatgacagaacagaccggggcctggatgaggagggggaggaggagagcagcgctggcagcctgcccctggtgtctgtgtccctcttcacccccctgacagctgctgagatggccccctacatgaagaggctgagccggggccagacagtggaggacctgctggaggtgctgagtgacattgatgagatgagcagaagaagacctgagatcctgtccttcttcagcaccaacctgcagaggctgatgagcagcgctgaggagtgctgcaggaacctggccttcagcctggccctgcgctccatgcagaacagccccagcattgctgctgccttcctgcccaccttcatgtactgcctgggcagccaggactttgaggtggtgcagacagccctgaggaacctgcctgaatatgccctgctgtgccaggagcacgccgctgtgctgctgcaccgggccttcctggtgggcatgtatggccagatggaccccagcgcccagatcagcgaggccctgcgcatcctgcacatggaggccgtgatgtag

SEQ ID NO: 34806 - DNA, 3612 bp, Artificial Sequence
  Description of Artificial Sequence: Synthetic coding sequence
aaggaccagcagaccgtcatcatgacagagtgcaccagcctgcagtttgtgagcccctttgcctttgaggccatgcagaaggtggatgtggtgtgcctggccagcctgagtgaccctgagctgcggctgctgctgccctgcctggtgaggatggccctgtgtgccccagctgaccagagccagagctgggcccaggacaagaagctgatcctgcggctgctgtctggagtggaggccgtgaacagcatcgtggccctgctgtctgtggacttccacgccctggagcaggatgccagcaaggagcagcagctgcggcacaagctgggcggcggcagcggggagagcatcctggtgtcccagctgcagcacggcctgaccctggagtttgagcacagcgacagcccccggcggctgcggctggtgctgtctgagctgctggccatcatgaacaaggtgtctgagagcaatggagagttcttcttcaagagcagcgagctgtttgagagccctgtgtacctggaggaggccgcagatgtgctgtgcatcctgcaggccgagctgcccagcctgctgcccatcgtggatgtggccgaggccctgctgcacgtgagaaatggagcctggttcctgtgcctgctggtggccaacgtgcctgacagcttcaatgaggtgtgccggggcctcatcaagaatggagagcggcaggatgaggagagcctgggcggcagaagaagaacagatgccctgcgcttcctgtgcaagatgaaccccagccaggccctgaaggtgcggggcatggtggtggaggagtgccacctgcccggcctgggcgtggccctgaccctggaccacaccaagaatgaggcctgtgaagatggagtgtctgacctggtgtgctttgtgtctggcctgctgctgggcaccaatgccaaggtgaggacctggtttggcaccttcatcagaaatggccagcagaggaagcgggagaccagcagctctgtgctgtggcagatgaggcggcagctgctgctggagctgatgggcatcctgcccaccgtgcgcagcacccgcatcgtggaggaggctgatgtggacatggagcccaacgtgtctgtgtacagcggcctgaaggaggagcacgtggtgaaggccagcgccctgctgcggctgtactgtgccctgatgggcattgctggcctgaagcccacagaggaggaggccgagcagctgctgcagctgatgaccagccggcccccagccaccccagctggggtgcgctttgtgtccctgtccttctgcatgctgctggccttcagcaccctggtgtccaccccagagcaggagcagctgatggtggtgtggctgtcctggatgatcaaggaggaggcctactttgagagcaccagcggcgtgtctgccagctttggagagatgctgctgctggtggccatgtacttccacagcaaccagctgagcgccatcatcgacctggtgtgcagcaccctgggcatgaagatcgtcatcaagcccagcagcctgagcaggatgaagaccatcttcacccaggagatcttcacagagcaggtggtgacagcccatgctgtgcgggtgcctgtgaccagcaacctgagcgccaacatcaccggcttcctgcccatccactgcatctaccagctgctgcggagccgctccttcaccaagcacaaggtgtccatcaaggactggatctaccggcagctgtgtgagaccagcacccccctgcacccccagctgctgcccctgattgatgtgtacatcaacagcatcctgaccccagccagcaagagcaaccctgaggccaccaaccagcctgtgacagagcaggagatcctgaacatcttccagggcgtgattggaggagacaacatccggctgaaccagcgcttcagcatcacagcccagctgctggtgctgtactacatcctgtcctatgaggaggccctgctggccaacaccaagaccctggccgccatgcagaggaagcccaagagctacagcagcagcctgatggaccagatccccatcaagttcctgatccggcaggcccagggcctgcagcaggagctgggcggcctgcacagcgccctgctgcggctgctggccaccaactacccccacctgtgcatcgtggatgactggatctgtgaggaggagatcactggaacagatgccctgctgcggaggatgctgctgaccaacaatgccaagaaccacagccccaagcagctgcaggaggccttctctgctgtgcctgtgaacaacacccaggtgatgcagatcatcgagcacctgaccctgctgagcgccagcgagctgatcccctatgcagaggtgctgaccagcaacatgagccagctgctgaacagcggcgtgccccggcgcatcctgcagacagtgaacaagctgtggatggtgctgaacacagtgatgccccggcggctgtgggtgatgacagtgaatgccctgcagcccagcatcaagtttgtgcggcagcagaagtacacccagaatgacctgatgattgaccccctcatcgtgctgcgctgtgaccagagggtgcaccgctgcccccccctgatggacatcaccctgcacatgctgaatggctacctgctggccagcaaggcctacctgagcgcccacctgaaggagacagagcaggaccggcccagccagaacaacaccatcggcctggtgggccagacagatgcccctgaggtgacccgggaggagctgaagaatgccctgctggccgcccaggacagcgctgctgtgcagatcctgctggagatctgcctgcccacagaggaggagaaggccaacggggtgaacccagacagcctgctgagaaatgtgcagagcgtcatcaccaccagcgcccccaacaagggcatggaggagggggaggacaacctgctgtgcaacctgcgggaggtgcagtgcctgatctgctgcctgctgcaccagatgtacatcgctgaccccaacatcgccaagctggtgcacttccagggctacccctgtgagctgctgcccctgactgtggccggcatccccagcatgcacatctgcctggacttcatccctgagctgattgcccagcctgagctggagaagcagatctttgccatccagctgctgagccacctgtgcatccagtatgccctgcccaagagcctgtctgtggcccggctggccgtgaatgtgatgggcaccctgctgactgtgctgacccaggccaagagatatgccttcttcatgcccaccctgcccagcctggtgtccttctgccgggccttcccccccctgtatgaggacatcatgagcctgctgatccagatcggccaggtgtgtgccagtgatgtggccacccagacccgggacatcgaccccatcatcacccggctgcagcagatcaaggagaagcccagcggctggagccagatctgcaaggacagcagctacaagaatggcagccgggacaccggctccatggaccctgatgtgcagctgtgccactgcatcgagaggacagtgattgagatcatcaacatgtctgtgtctggcatctag

SEQ ID NO: 34807 - DNA, 3615 bp, Artificial Sequence
  Description of Artificial Sequence: Synthetic coding sequence
atgaaggaccagcagaccgtcatcatgacagaatgtaccagcctgcagtttgtgagcccctttgcctttgaggccatgcagaaggtggatgtggtgtgcctggccagcctgagtgaccctgagctgcggctgctgctgccctgcctggtgaggatggccctgtgtgccccagctgaccagagccagagctgggcccaggacaagaagctgatcctgcggctgctgagcggcgtggaggccgtgaacagcatcgtggccctgctgtctgtggacttccacgccctggagcaggatgccagcaaggagcagcagctgcggcacaagctgggcggcggcagcggggagagcatcctggtgtcccagctgcagcacggcctgaccctggagtttgagcacagcgacagcccccggcggctgcggctggtgctgtctgagctgctggccatcatgaacaaggtgtctgagagcaatggagagttcttcttcaagagcagcgagctgtttgagagccctgtgtacctggaggaggccgcagatgtgctgtgcatcctgcaggccgagctgcccagcctgctgcccatcgtggatgtggccgaggccctgctgcacgtgagaaatggagcctggttcctgtgcctgctggtggccaacgtgcctgacagcttcaatgaggtgtgccggggcctcatcaagaatggagagcggcaggatgaggagagcctgggcggcagaagaagaacagatgccctgcgcttcctgtgcaagatgaaccccagccaggccctgaaggtgcggggcatggtggtggaggagtgccacctgcccggcctgggcgtggccctgaccctggaccacaccaagaatgaggcctgtgaagatggagtgtctgacctggtgtgctttgtgtctggcctgctgctgggcaccaatgccaaggtgaggacctggtttggcaccttcatcagaaatggccagcagaggaagcgggagaccagcagctctgtgctgtggcagatgaggcggcagctgctgctggagctgatgggcatcctgcccaccgtgcgcagcaccagaattgtggaggaggctgatgtggacatggagcccaacgtgtctgtgtacagcggcctgaaggaggagcacgtggtgaaggccagcgccctgctgcggctgtactgtgccctgatgggcattgctggcctgaagcccacagaggaggaggccgagcagctgctgcagctgatgaccagccggcccccagccaccccagctggggtgcgctttgtgtccctgtccttctgcatgctgctggccttcagcaccctggtgtccaccccagagcaggagcagctgatggtggtgtggctgtcctggatgatcaaggaggaggcctactttgagagcaccagcggcgtgtctgccagctttggagagatgctgctgctggtggccatgtacttccacagcaaccagctgagcgccatcatcgacctggtgtgcagcaccctgggcatgaagatcgtcatcaagcccagcagcctgagcaggatgaagaccatcttcacccaggagatcttcacagagcaggtggtgacagcccatgctgtgcgggtgcctgtgaccagcaacctgagcgccaacatcaccggcttcctgcccatccactgcatctaccagctgctgcggagccgctccttcaccaagcacaaggtgtccatcaaggactggatctaccggcagctgtgtgagaccagcacccccctgcacccccagctgctgcccctgattgatgtgtacatcaacagcatcctgaccccagccagcaagagcaaccctgaggccaccaaccagcctgtgacagagcaggagatcctgaacatcttccagggcgtcatcggcggggacaacatccggctgaaccagcgcttcagcatcacagcccagctgctggtgctgtactacatcctgtcctatgaggaggccctgctggccaacaccaagaccctggccgccatgcagaggaagcccaagagctacagcagcagcctgatggaccagatccccatcaagttcctgatccggcaggcccagggcctgcagcaggagctgggcggcctgcacagcgccctgctgcggctgctggccaccaactacccccacctgtgcatcgtggatgactggatctgtgaggaggagatcaccggcacagatgccctgctgcggaggatgctgctgaccaacaatgccaagaaccacagccccaagcagctgcaggaggccttctctgctgtgcctgtgaacaacacccaggtgatgcagatcatcgagcacctgaccctgctgagcgccagcgagctgatcccctatgcagaggtgctgaccagcaacatgagccagctgctgaacagcggcgtgccccggcgcatcctgcagacagtgaacaagctgtggatggtgctgaacacagtgatgccccggcggctgtgggtgatgacagtgaatgccctgcagcccagcatcaagtttgtgcggcagcagaagtacacccagaatgacctgatgattgaccccctgattgtgctgcgctgtgaccagagggtgcaccgctgcccccccctgatggacatcaccctgcacatgctgaatggctacctgctggccagcaaggcctacctgagcgcccacctgaaggagacagagcaggaccggcccagccagaacaacaccatcggcctggtgggccagacagatgcccctgaggtgacccgggaggagctgaagaatgccctgctggccgcccaggacagcgctgctgtgcagatcctgctggagatctgcctgcccacagaggaggagaaggccaatggagtgaacccagacagcctgctgagaaatgtgcagagcgtcatcaccaccagcgcccccaacaagggcatggaggagggggaggacaacctgctgtgcaacctgcgggaggtgcagtgcctgatctgctgcctgctgcaccagatgtacatcgctgaccccaacatcgccaagctggtgcacttccagggctacccctgtgagctgctgcccctgactgtggccggcatccccagcatgcacatctgcctggacttcatccctgagctgattgcccagcctgagctggagaagcagatctttgccatccagctgctgagccacctgtgcatccagtatgccctgcccaagagcctgtctgtggcccggctggccgtgaatgtgatgggcaccctgctgactgtgctgacccaggccaagagatatgccttcttcatgcccaccctgcccagcctggtgtccttctgccgggccttcccccccctgtatgaggacatcatgagcctgctgatccagatcggccaggtgtgtgccagtgatgtggccacccagacccgggacatcgaccccatcatcacccggctgcagcagatcaaggagaagcccagcggctggagccagatctgcaaggacagcagctacaagaatggcagccgggacaccggctccatggaccctgatgtgcagctgtgccactgcattgaaagaactgtcatcgagatcatcaacatgtctgtgtctggcatctag

SEQ ID NO: 34808 - DNA, 3060 bp, Artificial Sequence
  Description of Artificial Sequence: Synthetic coding sequence
atgtctgccctgtgtgaccccccaggggcccctggccccccaggccctgccccagccacccacggccctgcccccctgagcgcccaggagctgagccaggagatcaaggccttcctgactggagtggaccccatcctgggccaccagctgagcgcccgggagcacgcccgctgtggcctgctgctgctgcggagcctgcccccagcccgggctgctgtgctggaccacctgcggggcgtgtttgatgagagcgtgcgggcccacctggccgccctggatgagacccctgtggccggccccccccacctgcggcccccaccacccagccacgtgcctgctgggggccctggcctggaggatgtggtgcaggaggtgcagcaggtgctgtctgagttcatccgggccaaccccaaggcctgggcccctgtgatcagcgcctggagcattgacctgatgggccagctgagcagcacctacagcggccagcaccagagggtgccccacgccaccggggccctgaatgagctgctgcagctgtggatgggctgccgggccaccaggaccctgatggacatctacgtgcagtgcctgagcgccctgattggcagctgcccagatgcctgtgtggatgccctgctggacacctctgtgcagcacagcccccactttgactgggtggtggcccacatcggcagcagcttccctggcaccatcatcagccgggtgctgagctgtggcctgaaggacttctgtgtgcatggaggagctgggggcggggccggcagcagcggcggcagcagcagccagacccccagcacagaccccttccctggcagccctgccatcccagctgagaagagggtgcccaagatcgcctctgtggtgggcatcctgggccacctggccagcagacatggagacagcatccggcgggagctgctgaggatgtttcatgacagcctggccggcggcagcggcggccgcagcggggaccccagcctgcaggccaccgtgcccttcctgctgcagctggccgtgatgagccctgccctgctgggcaccgtgtctggagagctggtggactgcctgaagcccccagctgtgctgagccagctgcagcagcacctgcagggcttcccccgggaggagctggacaacatgctgaacctggccgtgcacctggtgtcccaggccagcggggccggggcctaccgcctgctgcagttcctggtggacacagccatgcctgccagcgtcatcaccacccagggcctggccgtgcctgacacagtgcgggaggcctgtgacaggctcatccagctgctgctgctgcacctgcagaagctggtgcaccaccggggcggcagccctggagagggcgtgctgggccccccacctccaccccggctggtgcccttcctggatgccctgaagaaccacgtgggggagctgtgtggggagaccctgcggctggagaggaagcgcttcctgtggcagcaccagctgctgggcctgctgtctgtgtacacccggcccagctgtggccctgaggccctgggccacctgctgagccgggcccggagccctgaggagctgagcctggccacccagctgtatgccggcctggtggtgtccctgagcggcctgctgcccctggccttccgcagctgcctggcccgggtgcatgctggcaccctgcagccccccttcaccgcccgcttcctgaggaacctggccctgctggtgggctgggagcagcagggcggggagggccctgctgccctgggcgcccactttggagagagcgccagcgcccacctgagtgacctggcccccctgctgctgcaccctgaggaggaggtggccgaggccgccgccagcctgctggccatctgccccttccccagcgaggccctgagccccagccagctgctgggcctggtgcgggccggcgtgcaccgcttctttgccagcctgcggctgcacggccccccaggagtggccagcgcctgccagctgctgacccggctgagccagaccagccctgctggcctgaaggctgtgctgcagctgctggtggagggcgccctgcaccggggcaacacagagctgtttggaggccaggtggatggagacaatgagaccctgtctgtggtgtctgccagcctggccagcgccagcctgctggacaccaacagaagacacacagctgctgtgcccggccctgggggcatctggagcgtcttccacgccggggtcatcggccggggcctgaagccacccaagtttgtgcagagcaggaaccagcaggaggtgatctacaacacccagagcctgctgagcctgctggtgcactgctgcagcgcccctgggggcacagaatgtggggagtgctggggcgcccccatcctgagccctgaggccgccaaggctgtggccgtgaccctggtggagagcgtgtgcccagatgctgctggagctgagctggcctggcccccagaggagcacgcccgggccaccgtggagcgggacctgagaattggaagacgcttccgggagcagcccctgctgtttgagctgctgaagctggtggccgccgcccccccagccctgtgctactgcagcgtgctgctgcggggcctgctggccgccctgctgggccactgggaggccagccgccacccagacaccacccacagcccctggcacctggaggccagctgcaccctggtggccgtgatggccgagggcagcctgctgcccccagccctgggcaacatgcatgaggtgttcagccagctggccccctttgaggtgcggctgctgctgctgtctgtgtggggcttcctgcgggagcacggccccctgccccagaagttcatcttccagagcgagcggggccgcttcatccgggacttcagccgggagggcggcggggagggcggcccccacctggccgtgctgcacagcgtgctgcacaggaacatcgaccggctgggcctcttcagcggccgcttccaggcccccagccccagcaccctgctgcggcagggcacctag

SEQ ID NO: 34809 - DNA, 1659 bp, Artificial Sequence
  Description of Artificial Sequence: Synthetic coding sequence
atgctggaccacaaggacctggaggccgagatccaccccctgaagaatgaggagaggaagagccaggagaacctgggcaaccccagcaagaatgaagacaacgtgaagagcgccccaccccagagccggctgagccgctgcagagctgctgccttcttcctgagcctcttcctgtgcctgtttgtggtgtttgtggtgtcctttgtgatcccctgcccagacaggcctgccagccagaggatgtggagaattgactacagcgctgctgtgatctatgacttcctggccgtggatgacatcaatggagaccgcatccaggatgtgctcttcctgtacaagaacaccaacagcagcaacaacttcagccgcagctgtgtggatgagggcttcagcagcccctgcacctttgctgctgctgtgtctggggccaacggcagcaccctgtgggagaggcctgtggcccaggatgtggccctggtggagtgtgctgtgccccagccccggggcagcgaggcccccagcgcctgcatcctggtgggccggcccagcagcttcatcgctgtgaacctcttcaccggggagaccctgtggaaccacagcagcagcttctctggaaatgccagcatcctgagccccctgctgcaggtgcctgatgtggatggagatggagccccagacctgctggtgctgacccaggagcgggaggaggtgtctggccacctgtacagcggcagcacaggccaccagatcggcctgcggggcagcctgggcgtggatggagagagcggcttcctgctgcacgtgaccaggactggagcccactacatcctcttcccctgtgccagcagcctgtgtggctgcagcgtgaagggcctgtatgagaaggtgactggaagtggcggccccttcaagagtgacccccactgggagagcatgctgaatgccaccaccaggaggatgctgagccacagcagtggagctgtgcgctacctgatgcacgtgcctggaaatgctggagcagatgtgctgctggtgggcagcgaggcctttgtgctgctggatggccaggagctgaccccccgctggacccccaaggccgcccacgtgctgaggaagcccatcttcggccgctacaagccagacaccctggccgtggccgtggagaatggaactggaacagaccggcagatcctcttcctggacctgggcaccggggctgtgctgtgcagcctggccctgcccagcctgcccggcggccccctgagcgccagcctgcccacagctgaccacaggtctgccttcttcttctggggcctgcacgagctgggcagcaccagcgagacagagaccggggaggcccggcacagcctgtacatgttccaccccaccctgccccgggtgctgctggagctggccaacgtgtccacccacatcgtggcctttgatgctgtgctgtttgagcccagcagacatgctgcctacatcctgctgaccggccctgctgacagcgaggcccctggcctggtgtctgtcatcaagcacaaggtgcgggacctggtgcccagcagccgggtggtgcggctgggggagggcggccctgacagcgaccaggccatccgggaccgcttcagccggctgcgctaccagagcgaggcctag

SEQ ID NO: 34810 - DNA, 1659 bp, Artificial Sequence; identical to SEQ ID NO: 34809
  Description of Artificial Sequence: Synthetic coding sequence

SEQ ID NO: 34811 - DNA, 210 bp, Artificial Sequence
  Description of Artificial Sequence: Synthetic coding sequence
atgctggaccacaaggacctggaggccgagatccaccccctgaagaatgaggagaggaagagccaggagaacctgggcaaccccagcaagaatgaagacaacgtgaagagcgccccaccccagagccggctgagccgctgcagagctgctgccttcttcctgagcctcttcctgtgcctgtttgtggtgtttgtggtgtcctttgtgtag

SEQ ID NO: 34812 - DNA, 309 bp, Artificial Sequence
  Description of Artificial Sequence: Synthetic coding sequence
atgctggaccacaaggacctggaggccgagatccaccccctgaagaatgaggagaggaagagccaggagaacctgggcaaccccagcaagaatgaagacaacgtgaagagcgccccaccccagagccggctgagccgctgcagagctgctgccttcttcctgagcctcttcctgtgcctgtttgtggtgtttgtggtgtcctttgtgatcccctgcccagacaggcctgccagccagaggatgtggagaattgactacagcgctgctgtgatctatgacttcctggccgtggatgacatcaatggatag

SEQ ID NO: 34813 - DNA, 702 bp, Artificial Sequence
  Description of Artificial Sequence: Synthetic coding sequence
atgctggaccacaaggacctggaggccgagatccaccccctgaagaatgaggagaggaagagccaggagaacctgggcaaccccagcaagaatgaagacaacgtgaagagcgccccaccccagagccggctgagccgctgcagagctgctgccttcttcctgagcctcttcctgtgcctgtttgtggtgtttgtggtgtcctttgtgatcccctgcccagacaggcctgccagccagaggatgtggagaattgactacagcgctgctgtgatctatgacttcctggccgtggatgacatcaatggagaccgcatccaggatgtgctcttcctgtacaagaacaccaacagcagcaacaacttcagccgcagctgtgtggatgagggcttcagcagcccctgcacctttgctgctgctgtgtctggggccaacggcagcaccctgtgggagaggcctgtggcccaggatgtggccctggtggagtgtgctgtgccccagccccggggcagcgaggcccccagcgcctgcatcctggtgggccggcccagcagcttcatcgctgtgaacctcttcaccggggagaccctgtggaaccacagcagcagcttctctggaaatgccagcatcctgagccccctgctgcaggtgcctgatgtggatggagatggagccccagacctgctggtgctgacccaggagtag

SEQ ID NO: 34814 - DNA, 156 bp, Artificial Sequence
  Description of Artificial Sequence: Synthetic coding sequence
atgctggaccacaaggacctggaggccgagatccaccccctgaagaatgaggagaggaagagccaggagaacctgggcaaccccagcaagaatgaagacaacgtgaagagcgccccaccccagagccggctgagccgctgcagagctgctgcctag

SEQ ID NO: 34815 - DNA, 1596 bp, Artificial Sequence
  Description of Artificial Sequence: Synthetic coding sequence
atgctggaccacaaggacctggaggccgagatccaccccctgaagaatgaggagaggaagagccaggagaacctgggcaaccccagcaagaatgaagacaacgtgaagagcgccccaccccagagccggctgagccgctgcagagctgctgccttcttcctgagcctcttcctgtgcctgtttgtggtgtttgtggtgtcctttgtgatcccctgcccagacaggcctgccagccagaggatgtggagaattgactacagcgctgctgtgatctatgacttcctggccgtggatgacatcaatggagaccgcatccaggatgtgctcttcctgtacaagaacaccaacagcagcaacaacttcagccgcagctgtgtggatgagggcttcagcagcccctgcacctttgctgctgctgtgtctggggccaacggcagcaccctgtgggagaggcctgtggcccaggatgtggccctggtggagtgtgctgtgccccagccccggggcagcgaggcccccagcgcctgcatcctggtgggccggcccagcagcttcatcgctgtgaacctcttcaccggggagaccctgtggaaccacagcagcagcttctctggaaatgccagcatcctgagccccctgctgcaggtgcctgatgtggatggagatggagccccagacctgctggtgctgacccaggagcgggaggaggtgtctggccacctgtacagcggcagcacaggccaccagatcggcctgcggggcagcctgggcgtggatggagagagcggcttcctgctgcacgtgaccaggactggagcccactacatcctcttcccctgtgccagcagcctgtgtggctgcagcgtgaagggcctgtatgagaaggtgactggaagtggcggccccttcaagagtgacccccactgggagagcatgctgaatgccaccaccaggaggatgctgagccacagcagtggagctgtgcgctacctgatgcacgtgcctggaaatgctggagcagatgtgctgctggtgggcagcgaggcctttgtgctgctggatggccaggagctgaccccccgctggacccccaaggccgcccacgtgctgaggaagcccatcttcggccgctacaagccagacaccctggccgtggccgtggagaatggaactggaacagaccggcagatcctcttcctggacctgggcaccggggctgtgctgtgcagcctggccctgcccagcctgcccggcggccccctgagcgccagcctgcccacagctgaccacaggtctgccttcttcttctggggcctgcacgagctgggcagcaccagcgagacagagaccggggaggcccggcacagcctgtacatgttccaccccaccctgccccgggtgctgctggagctggccaacgtgtccacccacatcgtggcctttgatggcagccactgggccacagctgagcggctgctggatggagctgagctggcccccaggcctgcctgcccccggctggtgactggagtgtgggaggccgcccggctgtgcatcctgctgcccggcatccgctggctgatctactggttctag

SEQ ID NO: 34816 - DNA, 264 bp, Artificial Sequence
  Description of Artificial Sequence: Synthetic coding sequence
atgctggaccacaaggacctggaggccgagatccaccccctgaagaatgaggagaggaagagccaggagaacctgggcaaccccagcaagaatgaagacaacgtgaagagcgccccaccccagagccggctgagccgctgcagagctgctgccttcttcctgagcctcttcctgtgcctgtttgtggtgtttgtggtgtcctttgtgatcccctgcccagacaggcctgccagccagaggatgtggagaattgactacagctag

SEQ ID NO: 34817 - DNA, 1623 bp, Artificial Sequence
  Description of Artificial Sequence: Synthetic coding sequence
atgctggaccacaaggacctggaggccgagatccaccccctgaagaatgaggagaggaagagccaggagaacctgggcaaccccagcaagaatgaagacaacgtgaagagcgccccaccccagagccggctgagccgctgcagagctgctgccttcttcctgagcctcttcctgtgcctgtttgtggtgtttgtggtgtcctttgtgatcccctgcccagacaggcctgccagccagaggatgtggagaattgactacagcgctgctgtgatctatgacttcctggccgtggatgacatcaatggagaccgcatccaggatgtgctcttcctgtacaagaacaccaacagcagcaacaacttcagccgcagctgtgtggatgagggcttcagcagcccctgcacctttgctgctgctgtgtctggggccaacggcagcaccctgtgggagaggcctgtggcccaggatgtggccctggtggagtgtgctgtgccccagccccggggcagcgaggcccccagcgcctgcatcctggtgggccggcccagcagcttcatcgctgtgaacctcttcaccggggagaccctgtggaaccacagcagcagcttctctggaaatgccagcatcctgagccccctgctgcaggtgcctgatgtggatggagatggagccccagacctgctggtgctgacccaggagcgggaggaggtgtctggccacctgtacagcggcagcacaggccaccagatcggcctgcggggcagcctgggcgtggatggagagagcggcttcctgctgcacgtgaccaggactggagcccactacatcctcttcccctgtgccagcagcctgtgtggctgcagcgtgaagggcctgtatgagaaggtgactggaagtggcggccccttcaagagtgacccccactgggagagcatgctgaatgccaccaccaggaggatgctgagccacagcagtggagctgtgcgctacctgatgcacgtgcctggaaatgctggagcagatgtgctgctggtgggcagcgaggcctttgtgctgctggatggccaggagctgaccccccgctggacccccaaggccgcccacgtgctgaggaagcccatcttcggccgctacaagccagacaccctggccgtggccgtggagaatggaactggaacagaccggcagatcctcttcctggacctgggcaccggggctgtgctgtgcagcctggccctgcccagcctgcccggcggccccctgagcgccagcctgcccacagctgaccacaggtctgccttcttcttctggggcctgcacgagctgggcagcaccagcgagacagagaccggggaggcccggcacagcctgtacatgttccaccccaccctgccccgggtgctgctggagctggccaacgtgtccacccacatcgtggcctttgatgctgtgctgtttgagcccagcagacatgctgcctacatcctgctgaccggccctgctgacagcgaggcccctggcctggtgtctgtcatcaagcacaaggcccacacaggccggcagaggcggggctcctggacaggccagagcagccggcgggacctgcacgtgcgggtgctgtag

SEQ ID NO: 34818 - DNA, 711 bp, Artificial Sequence
  Description of Artificial Sequence: Synthetic coding sequence
atgctggaccacaaggacctggaggccgagatccaccccctgaagaatgaggagaggaagagccaggagaacctgggcaaccccagcaagaatgaagacaacgtgaagagcgccccaccccagagccggctgagccgctgcagagctgctgccttcttcctgagcctcttcctgtgcctgtttgtggtgtttgtggtgtcctttgtgatcccctgcccagacaggcctgccagccagaggatgtggagaattgactacagcgctgctgtgatctatgacttcctggccgtggatgacatcaatggagaccgcatccaggatgtgctcttcctgtacaagaacaccaacagcagcaacaacttcagccgcagctgtgtggatgagggcttcagcagcccctgcacctttgctgctgctgtgtctggggccaacggcagcaccctgtgggagaggcctgtggcccaggatgtggccctggtggagtgtgctgtgccccagccccggggcagcgaggcccccagcgcctgcatcctggtgggccggcccagcagcttcatcgctgtgaacctcttcaccggggagaccctgtggaaccacagcagcagcttctctggaaatgccagcatcctgagccccctgctgcaggtgcctgatgtggatggagatggagccccagacctgctggtgctgacccaggagcgggaggagtag

SEQ ID NO: 34819 - DNA, 3504 bp, Artificial Sequence
  Description of Artificial Sequence: Synthetic coding sequence
atggagctgccctttgtgacccacctgttcctgcccctggtgttcctgaccggcctgtgcagccccttcaacctggatgagcaccaccccaggctcttccctggccccccagaggccgagtttggctacagcgtgctgcagcacgtgggcggcggccagcgctggatgctggtgggcgccccctgggatggccccagcggggacagaagaggagatgtgtaccgctgccctgtgggcggggcccacaatgccccctgtgccaagggccacctgggggactaccagctgggcaacagcagccaccctgctgtgaacatgcacctgggcatgagcctgctggagacagatggagatggcggcttcatggcctgtgcccccctgtggagccgggcctgtggcagctctgtgttcagcagcggcatctgtgcccgggtggatgccagcttccagccccagggcagcctggcccccacagcccagcgctgccccacctacatggatgtggtgattgtgctggatggcagcaacagcatctacccctggagcgaggtgcagaccttcctgcggcggctggtgggcaagctgttcattgatcctgagcagatccaggtgggcctggtgcagtatggagagagccctgtgcatgagtggagcctgggggacttccgcaccaaggaggaggtggtgcgggccgccaagaacctgagcagaagagagggccgggagaccaagacagcccaggccatcatggtggcctgcacagagggcttcagccagagccatggaggccggcctgaggccgcccggctgctggtggtggtgacagatggagagagccatgatggagaggagctgcctgctgccctgaaggcctgtgaggccggccgggtgaccaggtatggaattgctgtgctgggccactacctgcggcggcagagggaccccagcagcttcctgcgggagatccgcaccatcgccagtgaccctgatgagcgcttcttcttcaacgtgacagatgaagctgccctgacagacatcgtggatgccctgggggaccgcatcttcggcctggagggcagccatgctgaaaatgaaagcagctttggcctggagatgagccagatcggcttcagcacccaccggctgaaggatggcatcctgtttggcatggtgggcgcctatgactggggcggctctgtgctgtggctggagggcggccacaggctcttcccccccaggatggccctggaggatgagttccccccagccctgcagaaccacgccgcctacctgggctacagcgtgtcctccatgctgctgcggggcggccggcggctcttcctgagcggggccccccgcttccgccaccggggcaaggtgattgccttccagctgaagaaggatggagctgtgcgggtggcccagagcctgcagggcgagcagatcggcagctacttcggcagcgagctgtgccccctggacacagacagagatggcaccacagatgtgctgctggtggccgcccccatgttcctgggcccccagaacaaggagaccggccgggtgtatgtgtacctggtgggccagcagagcctgctgaccctgcagggcaccctgcagcctgagcccccccaggatgccaggtttggatttgccatgggcgccctgcctgacctgaaccaggacggctttgctgatgtggccgtgggcgcccccctggaggatggccaccagggcgccctgtacctgtaccacggcacccagagcggcgtgcggccccacccagcccagagaattgctgctgcctccatgccccacgccctgagctacttcggccgctctgtggatggccgcctggacctggatggagatgacctggtggatgtggccgtgggcgcccagggcgccgccatcctgctgagcagccggcccatcgtgcacctgacccccagcctggaggtgaccccccaggccatctctgtggtgcagagggactgcagaagaagaggccaggaggccgtgtgcctgacagctgccctgtgcttccaggtgaccagcaggaccccaggccgctgggaccaccagttctacatgaggttcaccgccagcctggatgagtggacagctggggcccgggccgcctttgatggcagcggccagaggctgagcccccggcggctgcggctgtctgtgggcaatgtgacctgtgagcagctgcacttccacgtgctggacaccagtgactacctgcggcctgtggccctgactgtgacctttgccctggacaacaccaccaagccaggccctgtgctgaatgaaggcagccccaccagcatccagaagctggtgcccttcagcaaggactgtggccctgacaatgaatgtgtgacagacctggtgctgcaggtgaacatggacatccggggcagcaggaaggccccctttgtggtgcggggcggccgcaggaaggtgctggtgtccaccaccctggagaacagaaaagaaaatgcctacaacaccagcctgagcctcatcttcagcaggaacctgcacctggccagcctgaccccccagcgggagagccccatcaaggtggagtgtgccgcccccagcgcccacgcccggctgtgcagcgtgggccaccctgtgttccagacaggagccaaggtgaccttcctgctggagtttgagttcagctgcagcagcctgctgagccaggtgtttgtgaagctgacagccagcagtgacagcctggagagaaatggcaccctgcaggacaacacagcccagaccagcgcctacatccagtatgagccccacctgctcttcagcagcgagagcaccctgcacagatatgaggtgcacccctacggcaccctgcctgtgggccctggccctgagttcaagaccaccctgcgggtgcagaacctgggctgctacgtggtgtctggcctcatcatcagcgccctgctgcctgctgtggcccacggcggcaactacttcctgagcctgagccaggtgatcaccaacaatgccagctgcatcgtgcagaacctgacagagcccccaggcccccctgtgcaccctgaggagctgcagcacaccaaccggctgaatggcagcaacacccagtgccaggtggtgcgctgccacctgggccagctggccaagggcacagaggtgtctgtgggcctgctgcggctggtgcacaatgagttcttcagaagagccaagttcaagagcctgactgtggtgtccacctttgagctgggcacagaggagggctctgtgctgcagctgacagaggccagccgctggagcgagagcctgctggaggtggtgcagacccggcccatcctgatcagcctgtggatcctgattggctctgtgctgggcggcctgctgctgctggccctgctggtgttctgcctgtggaagctgggcttctttgcccacaagaagatccctgaggaggagaagcgggaggagaagctggagcagtag

SEQ ID NO: 34820 - DNA, 3111 bp, Artificial Sequence
  Description of Artificial Sequence: Synthetic coding sequence
atgaacatcacccacgcctacagccagggccaccagaagctgaacctggacacagtgtcctacaacatgctgggcgtggacagtgatggctgccccacctacatggatgtggtgattgtgctggatggcagcaacagcatctacccctggagcgaggtgcagaccttcctgcggcggctggtgggcaagctgttcatcgaccctgagcagatccaggtgggcctggtgcagtacggggagagccctgtgcatgagtggagcctgggggacttccgcaccaaggaggaggtggtgcgggccgccaagaacctgagccggcgggagggccgggagaccaagacagcccaggccatcatggtggcctgcacagagggcttcagccagagccacggcggccggcctgaggccgcccggctgctggtggtggtgacagatggagagagccatgatggagaggagctgcctgctgccctgaaggcctgtgaggccggccgggtgaccaggtatggaattgctgtgctgggccactacctgcggcggcagagggaccccagcagcttcctgcgggagatccgcaccatcgccagtgaccctgatgagcgcttcttcttcaacgtgacagatgaggccgccctgacagacatcgtggatgccctgggggaccgcatcttcggcctggagggcagccatgctgaaaatgaaagcagctttggcctggagatgagccagatcggcttcagcacccaccggctgaaggatggcatcctgtttggcatggtgggcgcctatgactggggcggctctgtgctgtggctggagggcggccacaggctcttcccccccaggatggccctggaggatgagttccccccagccctgcagaaccacgccgcctacctgggctacagcgtgtcctccatgctgctgcggggcggcagaagactcttcctgagcggggccccccgcttccgccaccggggcaaggtgattgccttccagctgaagaaggatggagctgtgcgggtggcccagagcctgcagggcgagcagatcggcagctactttggaagtgagctgtgccccctggacacagacagagatggcaccacagatgtgctgctggtggccgcccccatgttcctgggcccccagaacaaggagaccggccgggtgtatgtgtacctggtgggccagcagagcctgctgaccctgcagggcaccctgcagcctgagcccccccaggatgcccgcttcggctttgccatgggcgccctgcctgacctgaaccaggacggctttgctgatgtggccgtgggcgcccccctggaggatggccaccagggcgccctgtacctgtaccacggcacccagagcggcgtgcggccccacccagcccagagaattgctgctgcctccatgcctcatgccctgagctacttcggccgctctgtggatggccgcctggacctggatggagatgacctggtggatgtggccgtgggcgcccagggcgccgccatcctgctgagcagccggcccatcgtgcacctgacccccagcctggaggtgaccccccaggccatctctgtggtgcagagggactgcagaagaagaggccaggaggccgtgtgcctgacagctgccctgtgcttccaggtgaccagcaggaccccaggccgctgggaccaccagttctacatgaggttcaccgccagcctggatgagtggacagctggggcccgggccgcctttgatggcagcggccagaggctgagcccccggcggctgcggctgtctgtgggcaatgtgacctgtgagcagctgcacttccacgtgctggacaccagtgactacctgcggcctgtggccctgactgtgacctttgccctggacaacaccaccaagccaggccctgtgctgaatgaaggcagccccaccagcatccagaagctggtgcccttcagcaaggactgtggccctgacaatgaatgtgtgacagacctggtgctgcaggtgaacatggacatccggggcagcaggaaggccccctttgtggtgcggggcggccgcaggaaggtgctggtgtccaccaccctggagaacagaaaagaaaatgcctacaacaccagcctgagcctcatcttcagcaggaacctgcacctggccagcctgaccccccagcgggagagccccatcaaggtggagtgtgccgcccccagcgcccacgcccggctgtgcagcgtgggccaccctgtgttccagacaggagccaaggtgaccttcctgctggagtttgagttcagctgcagcagcctgctgagccaggtgtttgtgaagctgacagccagcagtgacagcctggagagaaatggcaccctgcaggacaacacagcccagaccagcgcctacatccagtatgagccccacctgctcttcagcagcgagagcaccctgcacagatatgaggtgcacccctacggcaccctgcctgtgggccctggccctgagttcaagaccaccctgcgggtgcagaacctgggctgctacgtggtgtctggcctcatcatcagcgccctgctgcctgctgtggcccatggaggcaactacttcctgagcctgagccaggtgatcaccaacaatgccagctgcatcgtgcagaacctgacagagcccccaggcccccctgtgcaccctgaggagctgcagcacaccaaccggctgaatggcagcaacacccagtgccaggtggtgcgctgccacctgggccagctggccaagggcacagaggtgtctgtgggcctgctgcggctggtgcacaatgagttcttccggcgggccaagttcaagagcctgactgtggtgtccacctttgagctgggcacagaggagggctctgtgctgcagctgacagaggccagccgctggagcgagagcctgctggaggtggtgcagacccggcccatcctgatcagcctgtggatcctgattggctctgtgctgggcggcctgctgctgctggccctgctggtgttctgcctgtggaagctgggcttctttgcccacaagaagatccctgaggaggagaagcgggaggagaagctggagcagtag

SEQ ID NO: 34821 - DNA, 3075 bp, Artificial Sequence
  Description of Artificial Sequence: Synthetic coding sequence
atggagctgccctttgtgacccacctgttcctgcccctggtgttcctgaccggctgccccacctacatggatgtggtgattgtgctggatggcagcaacagcatctacccctggagcgaggtgcagaccttcctgcggcggctggtgggcaagctgttcatcgaccctgagcagatccaggtgggcctggtgcagtacggggagagccctgtgcatgagtggagcctgggggacttccgcaccaaggaggaggtggtgcgggccgccaagaacctgagccggcgggagggccgggagaccaagacagcccaggccatcatggtggcctgcacagagggcttcagccagagccacggcggccggcctgaggccgcccggctgctggtggtggtgacagatggagagagccatgatggagaggagctgcctgctgccctgaaggcctgtgaggccggccgggtgaccaggtatggaattgctgtgctgggccactacctgcggcggcagagggaccccagcagcttcctgcgggagatccgcaccatcgccagtgaccctgatgagcgcttcttcttcaacgtgacagatgaggccgccctgacagacatcgtggatgccctgggggaccgcatcttcggcctggagggcagccatgctgaaaatgaaagcagctttggcctggagatgagccagatcggcttcagcacccaccggctgaaggatggcatcctgtttggcatggtgggcgcctatgactggggcggctctgtgctgtggctggagggcggccacaggctcttcccccccaggatggccctggaggatgagttccccccagccctgcagaaccacgccgcctacctgggctacagcgtgtcctccatgctgctgcggggcggcagaagactcttcctgagcggggccccccgcttccgccaccggggcaaggtgattgccttccagctgaagaaggatggagctgtgcgggtggcccagagcctgcagggcgagcagatcggcagctactttggaagtgagctgtgccccctggacacagacagagatggcaccacagatgtgctgctggtggccgcccccatgttcctgggcccccagaacaaggagaccggccgggtgtatgtgtacctggtgggccagcagagcctgctgaccctgcagggcaccctgcagcctgagcccccccaggatgcccgcttcggctttgccatgggcgccctgcctgacctgaaccaggacggctttgctgatgtggccgtgggcgcccccctggaggatggccaccagggcgccctgtacctgtaccacggcacccagagcggcgtgcggccccacccagcccagagaattgctgctgcctccatgcctcatgccctgagctacttcggccgctctgtggatggccgcctggacctggatggagatgacctggtggatgtggccgtgggcgcccagggcgccgccatcctgctgagcagccggcccatcgtgcacctgacccccagcctggaggtgaccccccaggccatctctgtggtgcagagggactgcagaagaagaggccaggaggccgtgtgcctgacagctgccctgtgcttccaggtgaccagcaggaccccaggccgctgggaccaccagttctacatgaggttcaccgccagcctggatgagtggacagctggggcccgggccgcctttgatggcagcggccagaggctgagcccccggcggctgcggctgtctgtgggcaatgtgacctgtgagcagctgcacttccacgtgctggacaccagtgactacctgcggcctgtggccctgactgtgacctttgccctggacaacaccaccaagccaggccctgtgctgaatgaaggcagccccaccagcatccagaagctggtgcccttcagcaaggactgtggccctgacaatgaatgtgtgacagacctggtgctgcaggtgaacatggacatccggggcagcaggaaggccccctttgtggtgcggggcggccgcaggaaggtgctggtgtccaccaccctggagaacagaaaagaaaatgcctacaacaccagcctgagcctcatcttcagcaggaacctgcacctggccagcctgaccccccagcgggagagccccatcaaggtggagtgtgccgcccccagcgcccacgcccggctgtgcagcgtgggccaccctgtgttccagacaggagccaaggtgaccttcctgctggagtttgagttcagctgcagcagcctgctgagccaggtgtttgtgaagctgacagccagcagtgacagcctggagagaaatggcaccctgcaggacaacacagcccagaccagcgcctacatccagtatgagccccacctgctcttcagcagcgagagcaccctgcacagatatgaggtgcacccctacggcaccctgcctgtgggccctggccctgagttcaagaccaccctgcgggtgcagaacctgggctgctacgtggtgtctggcctcatcatcagcgccctgctgcctgctgtggcccatggaggcaactacttcctgagcctgagccaggtgatcaccaacaatgccagctgcatcgtgcagaacctgacagagcccccaggcccccctgtgcaccctgaggagctgcagcacaccaaccggctgaatggcagcaacacccagtgccaggtggtgcgctgccacctgggccagctggccaagggcacagaggtgtctgtgggcctgctgcggctggtgcacaatgagttcttccggcgggccaagttcaagagcctgactgtggtgtccacctttgagctgggcacagaggagggctctgtgctgcagctgacagaggccagccgctggagcgagagcctgctggaggtggtgcagacccggcccatcctgatcagcctgtggatcctgattggctctgtgctgggcggcctgctgctgctggccctgctggtgttctgcctgtggaagctgggcttctttgcccacaagaagatccctgaggaggagaagcgggaggagaagctggagcagtag

SEQ ID NO: 34822 - DNA, 3288 bp, Artificial Sequence
  Description of Artificial Sequence: Synthetic coding sequence
atgaacatcacccacgcctacagccagggccaccagaagctgaacctggacacagtgtcctacaacatgctgggcgtggacagtgatggctgctggtgggcccctcctggcatgggcctgcaggccactggaggaggagcccacaatgccccctgtgccaagggccacctgggggactaccagctgggcaacagcagccaccctgctgtgaacatgcacctgggcatgagcctgctggagacagatggagatggcggcttcatggcctgtgcccccctgtggagccgggcctgtggcagctctgtgttcagcagcggcatctgtgcccgggtggatgccagcttccagccccagggcagcctggcccccacagcccagcgctgccccacctacatggatgtggtgattgtgctggatggcagcaacagcatctacccctggagcgaggtgcagaccttcctgcggcggctggtgggcaagctgttcattgatcctgagcagatccaggtgggcctggtgcagtatggagagagccctgtgcatgagtggagcctgggggacttccgcaccaaggaggaggtggtgcgggccgccaagaacctgagcagaagagagggccgggagaccaagacagcccaggccatcatggtggcctgcacagagggcttcagccagagccatggaggccggcctgaggccgcccggctgctggtggtggtgacagatggagagagccatgatggagaggagctgcctgctgccctgaaggcctgtgaggccggccgggtgaccaggtatggaattgctgtgctgggccactacctgcggcggcagagggaccccagcagcttcctgcgggagatccgcaccatcgccagtgaccctgatgagcgcttcttcttcaacgtgacagatgaagctgccctgacagacatcgtggatgccctgggggaccgcatcttcggcctggagggcagccatgctgaaaatgaaagcagctttggcctggagatgagccagatcggcttcagcacccaccggctgaaggatggcatcctgtttggcatggtgggcgcctatgactggggcggctctgtgctgtggctggagggcggccacaggctcttcccccccaggatggccctggaggatgagttccccccagccctgcagaaccacgccgcctacctgggctacagcgtgtcctccatgctgctgcggggcggccggcggctcttcctgagcggggccccccgcttccgccaccggggcaaggtgattgccttccagctgaagaaggatggagctgtgcgggtggcccagagcctgcagggcgagcagatcggcagctacttcggcagcgagctgtgccccctggacacagacagagatggcaccacagatgtgctgctggtggccgcccccatgttcctgggcccccagaacaaggagaccggccgggtgtatgtgtacctggtgggccagcagagcctgctgaccctgcagggcaccctgcagcctgagcccccccaggatgccaggtttggatttgccatgggcgccctgcctgacctgaaccaggacggctttgctgatgtggccgtgggcgcccccctggaggatggccaccagggcgccctgtacctgtaccacggcacccagagcggcgtgcggccccacccagcccagagaattgctgctgcctccatgccccacgccctgagctacttcggccgctctgtggatggccgcctggacctggatggagatgacctggtggatgtggccgtgggcgcccagggcgccgccatcctgctgagcagccggcccatcgtgcacctgacccccagcctggaggtgaccccccaggccatctctgtggtgcagagggactgcagaagaagaggccaggaggccgtgtgcctgacagctgccctgtgcttccaggtgaccagcaggaccccaggccgctgggaccaccagttctacatgaggttcaccgccagcctggatgagtggacagctggggcccgggccgcctttgatggcagcggccagaggctgagcccccggcggctgcggctgtctgtgggcaatgtgacctgtgagcagctgcacttccacgtgctggacaccagtgactacctgcggcctgtggccctgactgtgacctttgccctggacaacaccaccaagccaggccctgtgctgaatgaaggcagccccaccagcatccagaagctggtgcccttcagcaaggactgtggccctgacaatgaatgtgtgacagacctggtgctgcaggtgaacatggacatccggggcagcaggaaggccccctttgtggtgcggggcggccgcaggaaggtgctggtgtccaccaccctggagaacagaaaagaaaatgcctacaacaccagcctgagcctcatcttcagcaggaacctgcacctggccagcctgaccccccagcgggagagccccatcaaggtggagtgtgccgcccccagcgcccacgcccggctgtgcagcgtgggccaccctgtgttccagacaggagccaaggtgaccttcctgctggagtttgagttcagctgcagcagcctgctgagccaggtgtttgtgaagctgacagccagcagtgacagcctggagagaaatggcaccctgcaggacaacacagcccagaccagcgcctacatccagtatgagccccacctgctcttcagcagcgagagcaccctgcacagatatgaggtgcacccctacggcaccctgcctgtgggccctggccctgagttcaagaccaccctgcgggtgcagaacctgggctgctacgtggtgtctggcctcatcatcagcgccctgctgcctgctgtggcccacggcggcaactacttcctgagcctgagccaggtgatcaccaacaatgccagctgcatcgtgcagaacctgacagagcccccaggcccccctgtgcaccctgaggagctgcagcacaccaaccggctggccaagttcaagagcctgactgtggtgtccacctttgagctgggcacagaggagggctctgtgctgcagctgacagaggccagccgctggagcgagagcctgctggaggtggtgcagacccggcccatcctgatcagcctgtggatcctgattggctctgtgctgggcggcctgctgctgctggccctgctggtgttctgcctgtggaagctgggcttctttgcccacaagaagatccctgaggaggagaagcgggaggagaagctggagcagtag

SEQ ID NO: 34823 - DNA, 3192 bp, Artificial Sequence
  Description of Artificial Sequence: Synthetic coding sequence
atgagccctggggccagccggggcccccggggcagccaggcccccctgattgcccccctgtgctgtgccgctgctgccctgggcatgctgctgtggagccctgcctgccaggccttcaacctggatgtggagaagctgactgtgtacagcggccccaagggcagctacttcggctatgctgtggacttccacatcccagatgccaggacagcctctgtgctggtgggcgcccccaaggccaacaccagccagcctgacatcgtggagggcggcgctgtgtactactgcccctggccagctgagggcagcgcccagtgccggcagatcccctttgacaccaccaacaacaggaagatccgggtgaatggcaccaaggagcccatcgagttcaagagcaaccagtggtttggagccaccgtgaaggcccacaagggcaaggtggtggcctgtgcccccctgtaccactggaggaccctgaagcccaccccagagaaggaccctgtgggcacctgctacgtggccatccagaacttcagcgcctatgcagagttcagcccctgcaggaacagcaatgctgaccctgagggccagggctactgccaggccggcttcagcctggacttctacaagaatggagacctgattgtgggcggccctggcagcttctactggcagggccaggtgatcacagcctctgtggccgacatcatcgccaactacagcttcaaggacatcctgaggaagctggccggggagaagcagacagaggtggccccagccagctatgatgacagctacctgggctacagcgtggccgccggggagttcaccggggacagccagcaggagctggtggccggcatccccaggggggcccagaactttggctacgtgtccatcatcaacagcacagacatgaccttcatccagaacttcaccggggagcagatggccagctacttcggctacacagtggtggtgtctgatgtgaacagtgatggcctggatgatgtgctggtgggcgcccccctcttcatggagcgggagtttgagagcaacccccgggaggtgggccagatctacctgtacctgcaggtgagcagcctgctcttccgggacccccagatcctgaccggcacagagaccttcggccgcttcggcagcgccatggcccacctgggggacctgaaccaggacggctacaatgacatcgccatcggcgtgccctttgctgggaaggaccagaggggcaaggtgctgatctacaatggaaacaaggatggcctgaacaccaagcccagccaggtgctgcagggcgtgtgggccagccatgctgtgcccagcggcttcggcttcaccctgcggggggacagcgacatcgacaagaatgactacccagacctgattgtgggcgcctttggaacaggcaaggtggccgtgtaccgggcccggcctgtggtgacagtggatgcccagctgctgctgcaccccatgatcatcaacctggagaacaagacctgccaggtgcctgacagcatgaccagcgctgcctgcttcagcctgcgggtgtgtgcctctgtgacaggccagagcatcgccaacaccatcgtgctgatggccgaggtgcagctggacagcctgaagcagaagggggccatcaagaggaccctcttcctggacaaccaccaggcccacagggtcttccccctggtgatcaagaggcagaagagccaccagtgccaggacttcatcgtgtacctgagagatgaaacagagttccgggacaagctgagccccatcaacatcagcctgaactacagcctggatgagagcaccttcaaggagggcctggaggtgaagcccatcctgaactactaccgggagaacatcgtgtctgagcaggcccacatcctggtggactgtggggaggacaacctgtgtgtgcctgacctgaagctgagcgcccggccagacaagcaccaggtgatcattggagatgagaaccacctgatgctgatcatcaatgccagaaatgaaggagagggcgcctatgaggccgagctgtttgtgatgatccctgaggaggccgactatgtgggcattgaaagaaacaacaagggcttccggcccctgagctgtgagtacaagatggagaatgtgaccaggatggtggtgtgtgacctgggcaaccccatggtgtctggcaccaactacagcctgggcctgcgctttgctgtgccccggctggagaagaccaacatgagcatcaactttgacctgcagatccgcagcagcaacaaggacaacccagacagcaactttgtgtccctgcagatcaacatcacagctgtggcccaggtggagatccggggcgtgagccaccccccccagatcgtgctgcccatccacaactgggagcctgaggaggagccccacaaggaggaggaggtgggccccctggtggagcacatctatgagctgcacaacatcggccccagcaccatcagtgacaccatcctggaggtgggctggcccttcagcgccagagatgagttcctgctgtacatcttccacatccagaccctgggccccctgcagtgccagcccaaccccaacatcaacccccaggacatcaagccagctgccagccctgaggacaccccagagctgagcgccttcctgaggaacagcaccatcccccacctggtgaggaagagagatgtgcacgtggtggagttccaccggcagagccctgccaagatcctgaactgcaccaacatcgagtgcctgcagatcagctgtgctgtgggccgcctggagggcggggagagcgctgtgctgaaggtgcgcagccggctgtgggcccacaccttcctgcagaggaagaatgacccctatgccctggccagcctggtgtcctttgaggtgaagaagatgccctacacagaccagcctgccaagctgcctgagggcagcatcgtcatcaagaccagcgtcatctgggccaccccaaatgtgtccttcagcatccccctgtgggtgatcatcctggccatcctgctgggcctgctggtgctggccatcctgaccctggccctgtggaagtgtggcttctttgaccgggcccggcccccccaggaggacatgacagaccgggagcagctgaccaatgacaagaccccagaggcctag

SEQ ID NO: 34824 - DNA, 3147 bp, Artificial Sequence
  Description of Artificial Sequence: Synthetic coding sequence
atgagccctggggccagccggggcccccggggcagccaggcccccctgattgcccccctgtgctgtgccgctgctgccctgggcatgctgctgtggagccctgcctgccaggccttcaacctggatgtggagaagctgactgtgtacagcggccccaagggcagctacttcggctatgctgtggacttccacatcccagatgccaggacagcctctgtgctggtgggcgcccccaaggccaacaccagccagcctgacatcgtggagggcggcgctgtgtactactgcccctggccagctgagggcagcgcccagtgccggcagatcccctttgacaccaccaacaacaggaagatccgggtgaatggcaccaaggagcccatcgagttcaagagcaaccagtggtttggagccaccgtgaaggcccacaagggcaaggtggtggcctgtgcccccctgtaccactggaggaccctgaagcccaccccagagaaggaccctgtgggcacctgctacgtggccatccagaacttcagcgcctatgcagagttcagcccctgcaggaacagcaatgctgaccctgagggccagggctactgccaggccggcttcagcctggacttctacaagaatggagacctgattgtgggcggccctggcagcttctactggcagggccaggtgatcacagcctctgtggccgacatcatcgccaactacagcttcaaggacatcctgaggaagctggccggggagaagcagacagaggtggccccagccagctatgatgacagctacctggagctggtggccggcatccccaggggggcccagaactttggctacgtgtccatcatcaacagcacagacatgaccttcatccagaacttcaccggggagcagatggccagctacttcggctacacagtggtggtgtctgatgtgaacagtgatggcctggatgatgtgctggtgggcgcccccctcttcatggagcgggagtttgagagcaacccccgggaggtgggccagatctacctgtacctgcaggtgagcagcctgctcttccgggacccccagatcctgactggaacagagaccttcggccgctttggaagtgccatggcccacctgggggacctgaaccaggacggctacaatgacatcgccatcggcgtgccctttgctgggaaggaccagaggggcaaggtgctgatctacaacggcaacaaggatggcctgaacaccaagcccagccaggtgctgcagggcgtgtgggccagccatgctgtgcccagcggcttcggcttcaccctgcggggggacagcgacatcgacaagaatgactacccagacctgattgtgggcgccttcggcaccgggaaggtggccgtgtaccgggcccggcctgtggtgacagtggatgcccagctgctgctgcaccccatgatcatcaacctggagaacaagacctgccaggtgcctgacagcatgaccagcgctgcctgcttcagcctgcgggtgtgtgcctctgtgacaggccagagcatcgccaacaccatcgtgctgatggccgaggtgcagctggacagcctgaagcagaagggggccatcaagaggaccctcttcctggacaaccaccaggcccacagggtcttccccctggtgatcaagaggcagaagagccaccagtgccaggacttcatcgtgtacctgagagatgaaacagagttccgggacaagctgagccccatcaacatcagcctgaactacagcctggatgagagcaccttcaaggagggcctggaggtgaagcccatcctgaactactacagagaaaatattgtgtctgagcaggcccacatcctggtggactgtggggaggacaacctgtgtgtgcctgacctgaagctgagcgcccggccagacaagcaccaggtgatcattggagatgagaaccacctgatgctgatcatcaatgccagaaatgaaggagagggcgcctatgaagctgagctgtttgtgatgatccctgaggaggccgactatgtgggcatcgagaggaacaacaagggcttccggcccctgagctgtgagtacaagatggagaatgtgaccaggatggtggtgtgtgacctgggcaaccccatggtgtctggcaccaactacagcctgggcctgcgctttgctgtgccccggctggagaagaccaacatgagcatcaactttgacctgcagatccgcagcagcaacaaggacaacccagacagcaactttgtgtccctgcagatcaacatcacagctgtggcccaggtggagatccggggcgtgagccaccccccccagatcgtgctgcccatccacaactgggagcctgaggaggagccccacaaggaggaggaggtgggccccctggtggagcacatctatgagctgcacaacatcggccccagcaccatcagtgacaccatcctggaggtgggctggcccttcagcgccagagatgagttcctgctgtacatcttccacatccagaccctgggccccctgcagtgccagcccaaccccaacatcaacccccaggacatcaagccagctgccagccctgaggacaccccagagctgagcgccttcctgaggaacagcaccatcccccacctggtgaggaagagagatgtgcacgtggtggagttccaccggcagagccctgccaagatcctgaactgcaccaacattgaatgtctgcagatcagctgtgctgtgggccgcctggagggcggggagagcgctgtgctgaaggtgcgcagccggctgtgggcccacaccttcctgcagaggaagaatgacccctatgccctggccagcctggtgtcctttgaggtgaagaagatgccctacacagaccagcctgccaagctgcctgagggcagcatcgtcatcaagaccagcgtcatctgggccacccccaacgtgtccttcagcatccccctgtgggtgatcatcctggccatcctgctgggcctgctggtgctggccatcctgaccctggccctgtggaagtgtggcttctttgaccgggcccggcccccccaggaggacatgacagaccgggagcagctgaccaatgacaagaccccagaggcctag

SEQ ID NO: 34825 - DNA, 3540 bp, Artificial Sequence
  Description of Artificial Sequence: Synthetic coding sequence
atgtggctgttccacaccctgctgtgcatcgccagcctggccctgctggccgccttcaacgtggatgtggcccggccctggctgacccccaagggcggggccccctttgtgctgagcagcctgctgcaccaggaccccagcaccaaccagacctggctgctggtgaccagccccaggaccaagaggaccccaggccccctgcaccgctgcagcctggtgcaggatgagatcctgtgccaccctgtggagcacgtgcccatccccaagggccgccaccggggcgtgacagtggtgcgcagccaccacggcgtgctgatctgcatccaggtgctggtgagaagaccccacagcctgagcagcgagctgaccggcacctgcagcctgctgggccctgacctgcggccccaggcccaggccaacttctttgacctggagaacctgctggaccctgatgcccgggtggacaccggggactgctacagcaacaaggagggcggcggggaggatgatgtgaacacagcccggcagaggcgggccctggagaaggaggaggaggaggacaaggaggaggaggaggatgaggaggaggaggaggccggcacagaaattgccatcatcctggatggcagcggcagcattgatcctccagacttccagagggccaaggacttcatcagcaacatgatgaggaacttctatgaaaaatgttttgagtgcaactttgccctggtgcagtatggaggagtcatccagacagaatttgacctgcgggacagccaggatgtgatggccagcctggcccgggtgcagaacatcacccaggtgggctctgtgaccaagacagccagcgccatgcagcacgtgctggacagcatcttcaccagcagccacggcagcaggaggaaggccagcaaggtgatggtggtgctgacagatggcggcatctttgaggaccccctgaacctgaccaccgtcatcaacagccccaagatgcagggcgtggagagatttgccatcggcgtgggggaggagttcaagagcgccaggacagcccgggagctgaacctgattgccagtgaccctgatgagacccacgccttcaaggtgaccaactacatggccctggatggcctgctgagcaagctgcgctacaacatcatctccatggagggcaccgtgggagatgccctgcactaccagctggcccagatcggcttcagcgcccagatcctggatgagcggcaggtgctgctgggcgctgtgggcgcctttgactggagcggcggggccctgctgtatgacaccaggagccggcggggccgcttcctgaaccagacagctgctgctgctgctgatgctgaggccgcccagtacagctacctgggctatgctgtggccgtgctgcacaagacctgcagcctgagctacatcgccggggccccccgctacaagcaccacggggctgtgtttgagctgcagaaggagggccgggaggccagcttcctgcctgtgctggagggggagcagatgggcagctacttcggcagcgagctgtgccctgtggacatcgacatggatggcagcacagacttcctgctggtggccgcccccttctaccacgtgcacggggaggagggccgggtgtatgtgtaccgcctgtctgagcaggacggcagcttcagcctggcccgcatcctgagcggccaccctggcttcaccaatgccaggtttggatttgccatggccgccatgggagacctgagccaggacaagctgacagatgtggccatcggggcccccctggagggctttggagcagatgatggagccagctttggatctgtgtacatctacaacggccactgggatggcctgagcgccagccccagccagaggatccgggccagcacagtggcccctggcctgcagtacttcggcatgtccatggccggcggctttgacatctctggagatggcctggccgacatcaccgtgggcaccctgggccaggccgtggtgttccgcagcaggcctgtggtgcggctgaaggtgtccatggccttcaccccatctgccctgcccatcggcttcaacggggtggtgaatgtgcggctgtgctttgagatcagctctgtgaccacagccagcgagagcggcctgcgggaggccctgctgaacttcaccctggatgtggatgtgggcaagcagaggcggcggctgcagtgcagtgatgtgcgcagctgcctgggctgcctgcgggagtggagcagcggcagccagctgtgtgaggacctgctgctgatgcccacagaaggagagctgtgtgaggaggactgcttcagcaatgcctctgtgaaggtgtcctaccagctgcagaccccagagggccagacagaccacccccagcccatcctggaccgctacacagagccctttgccatcttccagctgccctatgagaaggcctgcaagaacaagctgttctgtgtggccgagctgcagctggccaccaccgtgtcccagcaggagctggtggtgggcctgaccaaggagctgaccctgaacatcaacctgaccaacagcggagaagattcctacatgacctccatggccctgaactaccccaggaacctgcagctgaagaggatgcagaagccacccagccccaacatccagtgtgatgacccccagcctgtggcctctgtgctgatcatgaactgcagaattggccaccctgtgctgaagaggagcagcgcccacgtgtctgtggtgtggcagctggaggagaatgccttccccaacagaacagctgacatcaccgtgacagtgaccaacagcaatgaaagaagaagcctggccaatgagacccacaccctgcagttcagacatggctttgtggccgtgctgagcaagcccagcatcatgtatgtgaacacaggccagggcctgagccaccacaaggagttcctgttccacgtgcacggggagaacctgtttggagctgagtaccagctgcagatctgtgtgcccaccaagctgcggggcctgcaggtggtggccgtgaagaagctgaccaggacccaggccagcacagtgtgcacctggagccaggagcgggcctgtgcctacagctctgtgcagcacgtggaggagtggcacagcgtgtcctgtgtgattgccagtgacaaggaaaatgtgacagtggccgctgagatctcctgggaccacagcgaggagctgctgaaggatgtgacagagctgcagatcctgggggagatctccttcaacaagagcctgtatgagggcctgaatgctgagaaccacaggaccaagatcaccgtggtgttcctgaaggatgagaagtaccacagcctgcccatcatcatcaagggctctgtgggcggcctgctggtgctgattgtcatcctggtgatcctcttcaagtgtggcttcttcaagaggaagtaccagcagctgaacctggagagcatcaggaaggcccagctgaagtctgagaacctgctggaggaggagaactag

SEQ ID NO: 34826 - DNA, 2400 bp, Artificial Sequence
  Description of Artificial Sequence: Synthetic coding sequence
atgccccgggccccagcccccctgtatgcctgcctgctgggcctgtgtgccctgctgccccggctggccggcctgaacatctgcaccagcggcagcgccaccagctgtgaggagtgcctgctgatccaccccaagtgtgcctggtgcagcaaggaggactttggcagccccaggagcatcaccagccgctgtgacctgcgggccaacctggtgaagaatggctgcggcggggagattgagagccctgccagcagcttccacgtgctgcggagcctgcccctgagcagcaaaggaagtggcagcgctggctgggatgtgatccagatgaccccccaggagattgctgtgaacctgcggcctggggacaagaccaccttccagctgcaggtgcggcaggtggaggactaccctgtggacctgtactacctgatggacctgagcctgtccatgaaggatgacctggacaacatccgcagcctgggcaccaagctggccgaggagatgaggaagctgaccagcaacttccggctgggcttcggcagctttgtggacaaggacatcagccccttctcctacacagccccccgctaccagaccaacccctgcatcggctacaagctgttccccaactgtgtgcccagctttggcttccgccacctgctgcccctgacagacagagtggacagcttcaatgaggaggtgaggaagcagagggtgtccaggaacagagatgcccctgagggcggctttgatgctgtgctgcaggccgctgtgtgcaaggagaagattggctggaggaaggatgccctgcacctgctggtgttcaccacagatgatgtgccccacatcgccctggatggcaagctgggcggcctggtgcagccccatgatggccagtgccacctgaatgaggccaatgagtacacagccagcaaccagatggactaccccagcctggccctgctgggggagaagctggccgagaacaacatcaacctgatctttgctgtgaccaagaaccactacatgctgtacaagaacttcaccgccctgatccctggcaccaccgtggagatcctggatggagacagcaagaacatcatccagctgatcatcaatgcctacaacagcatccgcagcaaggtggagctgtctgtgtgggaccagcctgaggacctgaacctcttcttcaccgccacctgccaggatggagtgtcctacccaggccagaggaaatgtgagggcctgaagatcggggacacagccagctttgaggtgtccctggaggcccggagctgccccagccgccacacagagcacgtgtttgccctgcggcctgtgggcttccgggacagcctggaggtgggcgtgacctacaactgcacctgtggctgcagcgtgggcctggagcccaacagcgcccgctgcaatggaagtggcacctacgtgtgtggcctgtgtgagtgcagccctggctacctgggcacccgctgtgagtgccaggatggagagaaccagagcgtgtaccagaacctgtgccgggaggccgagggcaagcccctgtgcagcggccgcggggactgcagctgcaaccagtgcagctgctttgagagcgagtttgggaagatctacggccccttctgtgaatgtgacaacttcagctgtgccagaaataaaggagtgctgtgcagcggccacggggagtgccactgtggagaatgtaaatgtcatgctggctacatcggggacaactgcaactgcagcacagacatcagcacctgccggggcagagatggccagatctgcagcgagcggggccactgcctgtgtggccagtgccagtgcacagagcccggggcctttggagagatgtgtgagaagtgccccacctgcccagatgcctgcagcaccaagagggactgtgtggagtgcctgctgctgcacagcggcaagccagacaaccagacctgccacagcctgtgcagagatgaagtcatcacctgggtggacaccatcgtgaaggatgaccaggaggccgtgctgtgcttctacaagacagccaaggactgtgtgatgatgttcacctacgtggagctgcccagcggcaagagcaacctgactgtgctgcgggagccagaatgtggcaacaccccaaatgccatgaccatcctgctggccgtggtgggcagcatcctgctggtgggcctggccctgctggccatctggaagctgctggtgaccatccatgacagaagagaatttgccaagttccagagcgagaggagccgggcccgctatgagatggccagcaaccccctgtacaggaagcccatcagcacccacacagtggacttcaccttcaacaagttcaacaagagctacaatggaacagtggactag

SEQ ID NO: 34827 - DNA, 1065 bp, Artificial Sequence
  Description of Artificial Sequence: Synthetic coding sequence
atgggccgcctggtggccgtgggcctgctgggcatcgccctggccctgctgggggagcggctgctggccctgaggaaccggctgaaggccagccgggaggtggagagcgtggacctgccccactgccacctgatcaagggcatcgaggccggctctgaagatattgacatcctgcccaacggcctggccttcttctctgtgggcctgaagtttcctggcctgcacagctttgccccagacaagccaggcggcatcctgatgatggacctgaaggaggagaagccccgggcccgggagctgcgcatcagccggggctttgacctggccagcttcaacccccacggcatcagcaccttcatcgacaatgatgacacagtgtacctgtttgtggtgaaccaccctgagttcaagaacacagtggagatcttcaagtttgaggaggccgagaacagcctgctgcacctgaagacagtgaagcatgagctgctgcccagcgtgaatgacatcacagctgtgggccctgcccacttctacgccaccaatgaccactacttcagtgaccccttcctgaagtacctggagacctacctgaacctgcactgggccaacgtggtgtactacagccccaatgaggtgaaggtggtggccgagggctttgattctgccaacggcatcaacatcagcccagatgacaagtacatctacgtggccgacatcctggcccacgagatccacgtgctggagaagcacaccaacatgaacctgacccagctgaaggtgctggagctggacaccctggtggacaacctgagcattgaccccagcagcggggacatctgggtgggctgccaccccaacggccagaagctgtttgtgtatgaccccaacaacccccccagcagcgaggtgctgcgcatccagaacatcctgtctgagaagcccaccgtgaccaccgtgtatgccaacaatggatctgtgctgcagggcagctctgtggcctctgtgtatgatggcaagctgctgattggcaccctgtaccaccgggccctgtactgtgagctgtag

SEQ ID NO: 34828 - DNA, 1905 bp, Artificial Sequence
  Description of Artificial Sequence: Synthetic coding sequence
atgctgaaggtgcaccccctgaagaagtaccctgtggacctgtactacctggtggatgtgtctgcctccatgcacaacaacatcgagaagctgaacagcgtgggcaatgacctgagcaggaagatggccttcttcagccgggacttccggctgggcttcggcagctatgtggacaagacagtgagcccctacatcagcatccaccctgagcgcatccacaaccagtgcagcgactacaacctggactgcatgcctcctcatggctacatccacgtgctgagcctgacagagaacatcacagaatttgagaaggctgtgcaccggcagaagatcagcggcaacatcgacaccccagagggcggctttgatgccatgctgcaggccgctgtgtgtgagagccacatcggctggaggaaggaggccaagaggctgctgctggtgatgacagaccagaccagccacctggccctggacagcaagctggccggcatcgtggtgcccaatgatggcaactgccacctgaagaacaacgtgtatgtgaagagcaccaccatggagcaccccagcctgggccagctgtctgagaagctgattgacaacaacatcaacgtcatctttgctgtgcagggcaagcagttccactggtacaaggacctgctgcccctgctgcccggcaccatcgccggggagattgagagcaaggccgccaacctgaacaacctggtggtggaggcctaccagaagctgatcagcgaggtgaaggtgcaggtggagaaccaggtgcagggcatctacttcaacatcacagccatctgcccagatggcagcaggaagccaggcatggagggctgcagaaatgtgaccagcaatgatgaggtgctcttcaacgtgacagtgaccatgaagaagtgtgatgtgactggaggcaagaactatgccatcatcaagcccatcggcttcaatgaaacagccaagatccacatccacaggaactgcagctgccagtgtgaggacaacagaggccccaagggcaaatgtgtggatgagaccttcctggacagcaagtgcttccagtgtgatgagaacaagtgccactttgatgaggaccagttcagcagcgagagctgcaagagccacaaggaccagcctgtgtgcagcggccggggcgtgtgtgtgtgtgggaagtgcagctgccacaagatcaagctgggcaaggtgtatggcaagtactgtgagaaggatgacttcagctgcccctaccaccacggcaacctgtgtgccggccatggagaatgtgaggccggccgctgccagtgcttcagcggctgggagggggaccgctgccagtgccccagcgctgctgcccagcactgtgtgaacagcaagggccaggtgtgcagcggccggggcacctgtgtgtgtggccgctgtgagtgcacagaccccaggagcatcggccgcttctgtgagcactgccccacctgctacacagcctgcaaggagaactggaactgcatgcagtgcctgcacccccacaacctgagccaggccatcctggaccagtgcaagaccagctgtgccctgatggagcagcagcactacgtggaccagaccagcgagtgcttcagcagccccagctacctgcgcatcttcttcatcatcttcatcgtgaccttcctgattggcctgctgaaggtgctgatcatccggcaggtgatcctgcagtggaacagcaacaagatcaagagcagcagtgactacagagtgtctgccagcaagaaggacaagctgatcctgcagagcgtgtgcaccagggctgtgacctaccgccgggagaagccagaggagatcaagatggacatcagcaagctgaatgcccacgagaccttccgctgcaacttctag

SEQ ID NO: 34829 - DNA, 1314 bp, Artificial Sequence
  Description of Artificial Sequence: Synthetic coding sequence
atgaccagctacatggccattgatggcagcgccctggtgcccctgcggcagaagcccaggaggaagacccagggcttcctgaccatgagcagaagacgcatcagctgcaaggacctgggccacgccgactgccagggctggctgtacaagaagaaggagaagggcagcttcctgagcaacaagtggaagaagttctgggtgatcctgaagggcagcagcctgtactggtacagcaaccagatggccgagaaggcagatggctttgtgaacctgcctgacttcaccgtggagcgggccagcgagtgcaagaagaagcacgccttcaagatcagccacccccagatcaagaccttctactttgctgctgaaaatgtgcaggagatgaatgtgtggctgaacaagctgggcagcgctgtgatccaccaggagagcaccaccaaggatgaggagtgctacagcgagagcgagcaggaggaccctgagattgctgctgagaccccacctcctcctcatgccagccagacccagagcctgacagcccagcaggccagcagcagcagccccagcctgagcggcaccagctacagcttcagcagcctggagaacacagtgaagacccccagcagcttccccagcagcctgagcaaggagcggcagagcctgcctgacacagtgaacagcctgtctgctgctgaagatgagggccagcccatcacctttgctgtgcaggtgcacagccctgtgcccagcgaggccggcatccacaaggccctggagaacagctttgtgaccagcgagagcggcttcctgaacagcctgagcagtgatgacaccagcagcctgagcagcaaccacgaccacctgactgtgcctgacaagccagctggcagcaagatcatggacaaggaggagaccaaggtgtctgaagatgatgagatggagaagctgtacaagagcctggagcaggccagcctgagccccctgggggacagaagacccagcaccaagaaggagctgaggaagagctttgtgaagcgctgcaagaaccccagcatcaatgagaagctgcacaagatccgcaccctgaacagcaccctgaagtgcaaggagcatgacctggccatgatcaaccagctgctggatgaccccaagctgacagccaggaagtaccgggagtggaaggtgatgaacaccctgctgatccaggacatctaccagcagcagagggccagccctgccccagatgacacagatgacaccccccaggagctgaagaagagccccagcagccccagcgtggagaacagcatctag

SEQ ID NO: 34830 - DNA, 1317 bp, Artificial Sequence
  Description of Artificial Sequence: Synthetic coding sequence
atgaccagctacatggccattgatggcagcgccctgcaggtgcccctgcggcagaagcccaggaggaagacccagggcttcctgaccatgagcagaagacgcatcagctgcaaggacctgggccatgctgactgccagggctggctgtacaagaagaaggagaagggcagcttcctgagcaacaagtggaagaagttctgggtgatcctgaagggcagcagcctgtactggtacagcaaccagatggccgagaaggcagatggctttgtgaacctgcctgacttcaccgtggagcgggccagcgagtgcaagaagaagcacgccttcaagatcagccacccccagatcaagaccttctactttgctgctgaaaatgtgcaggagatgaatgtgtggctgaacaagctgggcagcgctgtgatccaccaggagagcaccaccaaggatgaggagtgctacagcgagagcgagcaggaggaccctgagattgctgctgagaccccacctccaccccacgccagccagacccagagcctgacagcccagcaggccagcagcagcagccccagcctgagcggcaccagctacagcttcagcagcctggagaacacagtgaagacccccagcagcttccccagcagcctgagcaaggagcggcagagcctgcctgacacagtgaacagcctgtctgctgctgaagatgagggccagcccatcacctttgctgtgcaggtgcacagccctgtgcccagcgaggccggcatccacaaggccctggagaacagctttgtgaccagcgagagcggcttcctgaacagcctgagcagtgatgacaccagcagcctgagcagcaaccacgaccacctgactgtgcctgacaagccagctggcagcaagatcatggacaaggaggagaccaaggtgtctgaagatgatgagatggagaagctgtacaagagcctggagcaggccagcctgagccccctgggggaccggcggcccagcaccaagaaggagctgaggaagagctttgtgaagcgctgcaagaaccccagcatcaatgagaagctgcacaagatccgcaccctgaacagcaccctgaagtgcaaggagcatgacctggccatgatcaaccagctgctggatgaccccaagctgacagccaggaagtaccgggagtggaaggtgatgaacaccctgctgatccaggacatctaccagcagcagagggccagccctgccccagatgacacagatgacaccccccaggagctgaagaagagccccagcagccccagcgtggagaacagcatctag

SEQ ID NO: 34831 - DNA, 1317 bp, Artificial Sequence; identical to SEQ ID NO: 34830
  Description of Artificial Sequence: Synthetic coding sequence

SEQ ID NO: 34832 - DNA, 237 bp, Artificial Sequence
  Description of Artificial Sequence: Synthetic coding sequence
atgaccagctacatggccattgatggcagcgccctggtgcccctgcggcagaagcccaggaggaagacccagggcttcctgaccatgagcagaagacgcatcagctgcaaggacctgggccacgccgactgccagggctggctgtacaagaagaaggagaagggcagcttcctgagcaacaagtggaagaagttctgggtgatcctgaagggcagcagcctgtactggtacagctag

SEQ ID NO: 34833 - DNA, 396 bp, Artificial Sequence
  Description of Artificial Sequence: Synthetic coding sequence
atgttcagtgacaacagccactgcccagactgtggccagcagtggttccccagcctggagctgggccactggctgtaccagacagagctggtggagaatgaatgctaccaggtgttcctggaccgcatcaacagagctgactactgcccagagtgctacccagacaacccagccaacagaagcctggtgctgccctggagcttccccctggagtgggccccccagaacctgacccgctggacctttgagaaggcctgccaccccttcctgctgggcccccccctggtgaggaagagaattcatgacagccgggtggccggcttcaacccagccctgcagctgatcctgaccaggacagacaagaccctgaacaagaagctgggccagaacaagtag

SEQ ID NO: 34834 - DNA, 687 bp, Artificial Sequence
  Description of Artificial Sequence: Synthetic coding sequence
atgagggagggcaagaggggccccccctgcatcctgtccttccggggcaccctggagcgggtggaggcccagtgggagctggaggcccagggccctggccagtgcccagcccccctgggggaccctgccagcaccacagatggagcccaggaggcccgggtgcccctggatggagccttctggatccccaggcctcctgctggcagccccaagggctgctttgcctgtgtgtccaagcccccagccctgcaggccccagctgccccagcccctgagcccagcgccagcccccccatggcccccaccctcttccccatggagagcaagagcagcaagacagattctgtgcgggctgctggggcccccccagcctgcaagcacctggccgagaagaagaccatgaccaaccccaccaccgtgattgaggtgtacccagacaccacagaggtgaatgactactacctgtggagcatcttcaactttgtgtacctgaacttctgctgcctgggcttcatcgccctggcctacagcctgaaggtgcgggacaagaagctgctgaatgacctgaatggagctgtggaggatgccaagacagcccggctcttcaacatcaccagcagcgccctggccgccagctgcatcatcctggtgttcatcttcctgcgctaccccctgacagactactag

SEQ ID NO: 34835 - DNA, 399 bp, Artificial Sequence
  Description of Artificial Sequence: Synthetic coding sequence
atggacacagcctacccccgggaggacacccgggcccccacccccagcaaggccggggcccacacagccctgaccctgggcgccccccaccccccaccccgggaccacctgatctggagcgtcttcagcaccctgtacctgaacctgtgctgcctgggcttcctggccctggcctacagcatcaaggcccgggaccagaaggtggtgggggacctggaggccgcccggcgcttcggcagcaaggccaagtgctacaacatcctggccgccatgtggaccctggtgccccccctgctgctgctgggcctggtggtgactggagccctgcacctggcccggctggccaaggacagcgctgccttcttcagcaccaagtttgatgatgctgactatgactag

SEQ ID NO: 34836 - DNA, 1551 bp, Artificial Sequence
  Description of Artificial Sequence: Synthetic coding sequence
atgcctgtgcctgagaggcctgctgctggccctgacagcccccggcccggcaccaggagagctgccccccgggtgctgtttggagagtggctgctgggggagatcagcagcggctgctatgagggcctgcagtggctggatgaggcccggacctgcttccgggtgccctggaagcactttgccaggaaggacctgtctgaggctgatgcccgcatcttcaaggcctgggccgtggcccggggccgctggccacccagcagcagaggaggcggccccccacctgaggccgagacagctgagcgggccggctggaagaccaacttccgctgtgccctgcggagcaccaggagatttgtgatgctgcgggacaacagcggggaccctgctgacccccacaaggtgtatgccctgagccgggagctgtgctggagggagggccctggaacagaccagacagaggccgaggccccagctgctgtgcccccaccccagggcggccccccaggccccttcctggcccacacccatgctggcctgcaggcccctggccccctgcctgccccagctggggacaagggggacctgctgctgcaggccgtgcagcagagctgcctggccgaccacctgctgacagcctcctggggcgctgaccctgtgcccaccaaggcccctggagagggccaggagggcctgcccctgaccggggcctgtgccggcggccctggcctgcctgctggggagctgtatggctgggccgtggagaccacccccagccctggcccccagcctgctgccctgaccaccggggaggccgccgcccctgagagcccccaccaggccgagccctacctgagccccagccccagcgcctgcacagctgtgcaggagcccagccctggggccctggatgtgaccatcatgtacaagggccgcacagtgctgcagaaggtggtgggccaccccagctgcaccttcctgtatggccccccagaccctgctgtgcgggccacagacccccagcaggtggccttccccagccctgctgagctgcctgaccagaagcagctgcgctacacagaggagctgctgcggcacgtggcccctggcctgcacctggagctgcggggcccccagctgtgggcccggaggatgggcaagtgcaaggtgtactgggaggtgggcggccccccaggcagcgccagccccagcaccccagcctgcctgctgcccaggaactgtgacacccccatctttgacttccgggtcttcttccaggagctggtggagttccgggcccggcagaggcggggcagcccccgctacaccatctacctgggcttcggccaggacctgtctgctggccggcccaaggagaagagcctggtgctggtgaagctggagccctggctgtgccgggtgcacctggagggcacccagcgggagggcgtgagcagcctggacagcagcagcctgagcctgtgcctgagcagcgccaacagcctgtatgatgacatcgagtgcttcctgatggagctggagcagcctgcctag

SEQ ID NO: 34837 - DNA, 1425 bp, Artificial Sequence
  Description of Artificial Sequence: Synthetic coding sequence
atggccctggcccctgagcgggccgccccccgggtgctgtttggagagtggctgctgggggagatcagcagcggctgctatgagggcctgcagtggctggatgaggcccggacctgcttccgggtgccctggaagcactttgccaggaaggacctgtctgaggctgatgcccgcatcttcaaggcctgggccgtggcccggggccgctggccacccagcagccggggcggcggccccccacctgaggccgagacagctgagagagctggctggaagaccaacttccgctgtgccctgcggagcaccaggagatttgtgatgctgcgggacaacagcggggaccctgctgacccccacaaggtgtatgccctgagccgggagctgtgctggagggagggccctggaacagaccagacagaagctgaggccccagctgctgtgcccccaccccagggcggccccccaggccccttcctggcccacacccacgccggcctgcaggcccctggccccctgcctgccccagctggggacaagggggacctgctgctgcaggccgtgcagcagagctgcctggccgaccacctgctgacagcctcctggggcgctgaccctgtgcccaccaaggcccctggagagggccaggagggcctgcccctgactggagcctgtgccggcggggaggccgccgcccctgagagcccccaccaggccgagccctacctgagccccagccccagcgcctgcacagctgtgcaggagcccagccctggggccctggatgtgaccatcatgtacaagggccgcacagtgctgcagaaggtggtgggccaccccagctgcaccttcctgtatggccccccagaccctgctgtgcgggccacagacccccagcaggtggccttccccagccctgctgagctgcctgaccagaagcagctgcgctacacagaggagctgctgcggcacgtggcccctggcctgcacctggagctgcggggcccccagctgtgggcccggaggatgggcaagtgcaaggtgtactgggaggtgggcggccccccaggcagcgccagccccagcaccccagcctgcctgctgcccaggaactgtgacacccccatctttgacttccgggtcttcttccaggagctggtggagttccgggcccggcagaggcggggcagcccccgctacaccatctacctgggcttcggccaggacctgtctgctggccggcccaaggagaagagcctggtgctggtgaagctggagccctggctgtgccgggtgcacctggagggcacccagcgggagggcgtgagcagcctggacagcagcagcctgagcctgtgcctgagcagcgccaacagcctgtatgatgacatcgagtgcttcctgatggagctggagcagcctgcctag

SEQ ID NO: 34838 - DNA, 633 bp, Artificial Sequence
  Description of Artificial Sequence: Synthetic coding sequence
atgtacaagggccgcacagtgctgcagaaggtggtgggccaccccagctgcaccttcctgtatggccccccagaccctgctgtgcgggccacagacccccagcaggtggccttccccagccctgctgagctgcctgaccagaagcagctgcgctacacagaggagctgctgcggcacgtggcccctggcctgcacctggagctgcggggcccccagctgtgggcccggaggatgggcaagtgcaaggtgtactgggaggtgggcggccccccaggcagcgccagccccagcaccccagcctgcctgctgcccaggaactgtgacacccccatctttgacttccgggtcttcttccaggagctggtggagttccgggcccggcagaggcggggcagcccccgctacaccatctacctgggcttcggccaggacctgtctgctggccggcccaaggagaagagcctggtgctggtgaagctggagccctggctgtgccgggtgcacctggagggcacccagcgggagggcgtgagcagcctggacagcagcagcctgagcctgtgcctgagcagcgccaacagcctgtatgatgacatcgagtgcttcctgatggagctggagcagcctgcctag

SEQ ID NO: 34839 - DNA, 1551 bp, Artificial Sequence; identical to SEQ ID NO: 34836
  Description of Artificial Sequence: Synthetic coding sequence

SEQ ID NO: 34840 - DNA, 1425 bp, Artificial Sequence; identical to SEQ ID NO: 34837
  Description of Artificial Sequence: Synthetic coding sequence

SEQ ID NO: 34841 - DNA, 1512 bp, Artificial Sequence
  Description of Artificial Sequence: Synthetic coding sequence
atggccctggcccctgagcgggccgccccccgggtgctgtttggagagtggctgctgggggagatcagcagcggctgctatgagggcctgcagtggctggatgaggcccggacctgcttccgggtgccctggaagcactttgccaggaaggacctgtctgaggctgatgcccgcatcttcaaggcctgggccgtggcccggggccgctggccacccagcagccggggcggcggccccccacctgaggccgagacagctgagagagctggctggaagaccaacttccgctgtgccctgcggagcaccaggagatttgtgatgctgcgggacaacagcggggaccctgctgacccccacaaggtgtatgccctgagccgggagctgtgctggagggagggccctggaacagaccagacagaagctgaggccccagctgctgtgcccccaccccagggcggccccccaggccccttcctggcccacacccacgccggcctgcaggcccctggccccctgcctgccccagctggggacaagggggacctgctgctgcaggccgtgcagcagagctgcctggccgaccacctgctgacagcctcctggggcgctgaccctgtgcccaccaaggcccctggagagggccaggagggcctgcccctgactggagcctgtgccggcggccctggcctgcctgctggggagctgtatggctgggccgtggagaccacccccagccctggcccccagcctgctgccctgaccactggagaggccgccgcccctgagagcccccaccaggccgagccctacctgagccccagccccagcgcctgcacagctgtgcaggagcccagccctggggccctggatgtgaccatcatgtacaagggccgcacagtgctgcagaaggtggtgggccaccccagctgcaccttcctgtatggccccccagaccctgctgtgcgggccacagacccccagcaggtggccttccccagccctgctgagctgcctgaccagaagcagctgcgctacacagaggagctgctgcggcacgtggcccctggcctgcacctggagctgcggggcccccagctgtgggcccggaggatgggcaagtgcaaggtgtactgggaggtgggcggccccccaggcagcgccagccccagcaccccagcctgcctgctgcccaggaactgtgacacccccatctttgacttccgggtcttcttccaggagctggtggagttccgggcccggcagaggcggggcagcccccgctacaccatctacctgggcttcggccaggacctgtctgctggccggcccaaggagaagagcctggtgctggtgaagctggagccctggctgtgccgggtgcacctggagggcacccagcgggagggcgtgagcagcctggacagcagcagcctgagcctgtgcctgagcagcgccaacagcctgtatgatgacatcgagtgcttcctgatggagctggagcagcctgcctag

SEQ ID NO: 34842 - DNA, 315 bp, Artificial Sequence
  Description of Artificial Sequence: Synthetic coding sequence
atgggcaaggagagcggctgggacagcggccgggctgctgtggccgctgtggtgggcggcgtggtggccgtgggcaccgtgctggtggccctgagcgccatgggcttcacctctgtgggcattgctgccagcagcattgctgccaagatgatgagcacagctgccatcgccaacggcggcggcgtggccgccggcagcctggtggccatcctgcagagcgtgggcgctgctggcctgtctgtgaccagcaaggtgattggaggctttgctggaacagccctgggcgcctggctgggcagcccccccagcagctag

SEQ ID NO: 34843 - DNA, 315 bp, Artificial Sequence; identical to SEQ ID NO: 34842
  Description of Artificial Sequence: Synthetic coding sequence

SEQ ID NO: 34844 - DNA, 393 bp, Artificial Sequence
  Description of Artificial Sequence: Synthetic coding sequence
atgatgaagagagctgctgctgctgctgtgggcggggccctggccgtgggcgctgtgcctgtggtgctgagcgccatgggcttcaccggggccggcattgctgccagcagcattgctgccaagatgatgtctgctgctgccatcgccaacggcggcggcgtgtctgctggcagcctggtggccaccctgcagagcgtgggcgctgctggcctgagcaccagcagcaacatcctgctggcctctgtgggctctgtgctgggcgcctgcctgggcaacagccccagcagcagcctgcctgctgagcctgaggccaaggaggatgaggccagagaaaatgtgccccagggcgagccccccaagccacccctgaagtctgagaagcatgaggagtag

SEQ ID NO: 34845 - DNA, 417 bp, Artificial Sequence
  Description of Artificial Sequence: Synthetic coding sequence
atgaggcagaaggctgtgtccctcttcctgtgctacctgctgctcttcacctgcagcggcgtggaggccggagaaaatgccggcaaggatgctgggaagaagaagtgcagcgagagcagtgacagcggcagcggcttctggaaggccctgaccttcatggctgtgggcggcggcctggccgtggccggcctgcctgccctgggcttcaccggggccggcattgctgccaacagcgtggccgccagcctgatgtcctggagcgccatcctgaatggaggcggcgtgcctgctgggggcctggtggccaccctgcagagcctgggcgccggcggcagctctgtggtgattggcaacattggagccctgatgggctacgccacccacaagtacctggacagtgaagaagatgaggagtag

SEQ ID NO: 34846 - DNA, 393 bp, Artificial Sequence
  Description of Artificial Sequence: Synthetic coding sequence
atgaggcagaaggctgtgtccctcttcctgtgctacctgctgctcttcacctgcagcggcgtggaggccggcaagaagaagtgcagcgagagcagtgacagcggcagcggcttctggaaggccctgaccttcatggctgtgggcggcggcctggccgtggccggcctgcctgccctgggcttcaccggggccggcattgctgccaacagcgtggccgccagcctgatgtcctggagcgccatcctgaatggaggcggcgtgcctgctgggggcctggtggccaccctgcagagcctgggcgccggcggcagctctgtggtgattggcaacattggagccctgatgggctacgccacccacaagtacctggacagtgaagaagatgaggagtag

SEQ ID NO: 34847 - DNA, 405 bp, Artificial Sequence
  Description of Artificial Sequence: Synthetic coding sequence
atgaggcagaaggctgtgtccctcttcctgtgctacctgctgctcttcacctgcagcggcgtggaggccggagaaaatgccggcaagaagaagtgcagcgagagcagtgacagcggcagcggcttctggaaggccctgaccttcatggctgtgggcggcggcctggccgtggccggcctgcctgccctgggcttcaccggggccggcattgctgccaacagcgtggccgccagcctgatgtcctggagcgccatcctgaatggaggcggcgtgcctgctgggggcctggtggccaccctgcagagcctgggcgccggcggcagctctgtggtgattggcaacattggagccctgatgggctacgccacccacaagtacctggacagtgaagaagatgaggagtag

SEQ ID NO: 34848 - DNA, 978 bp, Artificial Sequence
  Description of Artificial Sequence: Synthetic coding sequence
atggcctggagcctgggctcctggctgggcggctgcctgctggtgtctgccctgggcatggtgcccccaccagaaaatgtgaggatgaacagcgtgaacttcaagaacatcctgcagtgggagagccctgcctttgccaagggcaacctgaccttcaccgcccagtacctgagctaccgcatcttccaggacaagtgcatgaacaccaccctgacagaatgtgacttcagcagcctgagcaagtacggggaccacaccctgcgggtgcgggcagagtttgctgatgagcacagcgactgggtgaacatcaccttctgccctgtggatgacaccatcatcggccccccaggcatgcaggtggaggtgctggccgacagcctgcacatgaggttcctggcccccaagattgaaaatgaatatgagacctggaccatgaagaatgtgtacaacagctggacctacaacgtgcagtactggaagaatggaacagatgagaagttccagatcaccccccagtatgactttgaggtgctgaggaacctggagccctggaccacctactgtgtgcaggtgcggggcttcctgcctgacaggaacaaggccggggagtggagcgagcctgtgtgtgagcagaccacccatgatgaaacagtgcccagctggatggtggccgtcatcctgatggccagcgtcttcatggtgtgcctggccctgctgggctgctttgccctgctgtggtgtgtgtacaagaagaccaagtatgccttcagccccaggaacagcctgccccagcacctgaaggagttcctgggccacccccaccacaacaccctgctcttcttctccttccccctgagtgatgaaaatgatgtgtttgacaagctgtctgtgattgctgaggacagcgagagcggcaagcagaaccctggggacagctgcagcctgggcaccccacctggccagggcccccagagctag

SEQ ID NO: 34849 - DNA, 969 bp, Artificial Sequence
  Description of Artificial Sequence: Synthetic coding sequence
atggcctggagcctgggctcctggctgggcggctgcctgctggtgtctgccctgggcatggtgcccccaccagaaaatgtgaggatgaacagcgtgaacttcaagaacatcctgcagtgggagagccctgcctttgccaagggcaacctgaccttcaccgcccagtacctgagctaccgcatcttccaggacaagtgcatgaacaccaccctgacagaatgtgacttcagcagcctgagcaagtacggggaccacaccctgcgggtgcgggcagagtttgctgatgagcacagcgactgggtgaacatcaccttctgccctgtggatgacaccatcatcggccccccaggcatgcaggtggaggtgctggccgacagcctgcacatgaggttcctggcccccaagattgaaaatgaatatgagacctggaccatgaagaatgtgtacaacagctggacctacaacgtgcagtactggaagaatggaacagatgagaagttccagatcaccccccagtatgactttgaggtgctgaggaacctggagccctggaccacctactgtgtgcaggtgcggggcttcctgcctgacaggaacaaggccggggagtggagcgagcctgtgtgtgagcagaccacccatgatgaaacagtgcccagctggatggtggccgtcatcctgatggccagcgtcttcatggtgtgcctggccctgctgggctgctttgccctgctgtggtgtgtgtacaagaagaccaagtatgccttcagccccaggaacagcctgccccagcacctgaaggagttcctgggccacccccaccacaacaccctgctcttcttctccttccccctgagtgatgaaaatgatgtgtttgacaagctgtctgtgattgctgaggacagcgagagcggcaagcagaaccctggggacagccccaccagcaggaccccccggccctggacctag

SEQ ID NO: 34850 - DNA, 444 bp, Artificial Sequence
  Description of Artificial Sequence: Synthetic coding sequence
atgaagcacctgctgatgtggagccctgtgattgcccctggagagaccgtgtactacagcgtggagtaccagggcgagtatgagagcctgtacaccagccacatctggatccccagctcctggtgcagcctgacagagggcccagaatgtgatgtgacagatgacatcacagccaccgtgccctacaacctgcgggtgcgggccaccctgggcagccagaccagcgcctggagcatcctgaagcaccccttcaacagaaacagcaccatcctgacccggcccggcatggagatcaccaaggatggcttccacctggtgattgagctggaggacctgggcccccagtttgagttcctggtggcctactggaggcgggagcctggagctgaggagcggcccttcccctggtactggccctgcctgcccctgctggccagctgctag

SEQ ID NO: 34851 - DNA, 936 bp, Artificial Sequence
  Description of Artificial Sequence: Synthetic coding sequence
atgcagaccttcaccatggtgctggaggagatctggaccagcctcttcatgtggttcttctacgccctgatcccctgcctgctgacagatgaggtggccatcctgcctgccccccagaacctgtctgtgctgagcaccaacatgaagcacctgctgatgtggagccctgtgattgcccctggagaaacagtgtactacagcgtggagtaccagggcgagtatgagagcctgtacaccagccacatctggatccccagctcctggtgcagcctgacagagggcccagaatgtgatgtgacagatgacatcacagccaccgtgccctacaacctgcgggtgcgggccaccctgggcagccagaccagcgcctggagcatcctgaagcaccccttcaacagaaacagcaccatcctgaccaggcctggcatggagatcaccaaggatggcttccacctggtgattgagctggaggacctgggcccccagtttgagttcctggtggcctactggaggcgggagcccggggctgaggagcacgtgaagatggtgcgcagcggcggcatccctgtgcacctggagaccatggagcctggagctgcctactgtgtgaaggcccagacctttgtgaaggccatcggccgctacagcgccttcagccagacagaatgtgtggaggtgcagggcgaggccatccccctggtgctggccctgtttgcctttgtgggcttcatgctgatcctggtggtggtgcccctgtttgtgtggaagatgggccgcctgctgcagtacagctgctgccctgtggtggtgctgcctgacaccctgaagatcaccaacagcccccagaagctgatcagctgccggcgggaggaggtggatgcctgtgccacagctgtgatgagccctgaggagctgctgcgggcctggatctcctag

SEQ ID NO: 34852 - DNA, 1725 bp, Artificial Sequence
  Description of Artificial Sequence: Synthetic coding sequence
atgaggaccctgctgaccatcctgactgtgggcagcctggccgcccacgcccctgaggaccccagcgacctgctgcagcacgtgaagttccagagcagcaactttgagaacatcctgacctgggacagcggccctgagggcaccccagacacagtgtacagcattgagtacaagacctacggggagcgggactgggtggccaagaagggctgccagaggatcaccaggaagagctgcaacctgactgtggagactggaaacctgacagagctgtactatgcccgggtgacagctgtgtctgctgggggccgcagcgccaccaagatgacagaccgcttcagcagcctgcagcacaccaccctgaagcccccagatgtgacctgcatcagcaaggtgcgcagcatccagatgattgtgcaccccacccccacccccatccgggctggagatggccaccggctgaccctggaggacatcttccatgacctcttctaccacctggagctgcaggtgaacagaacctaccagatgcacctgggcggcaagcagcgggagtatgagttcttcggcctgaccccagacacagagttcctgggcaccatcatgatctgtgtgcccacctgggccaaggagagcgccccctacatgtgccgggtgaagaccctgcctgacaggacctggacctacagcttcagcggggccttcctgttctccatgggcttcctggtggccgtgctgtgctacctgagctaccgctacgtgaccaagcccccagccccacccaacagcctgaatgtgcagagggtgctgaccttccagcccctgcgcttcatccaggagcacgtgctgatccctgtgtttgacctgagcggccccagcagcctggcccagcctgtgcagtacagccagatccgggtgtctggcccccgggagcctgctggggccccccagaggcacagcctgtctgagatcacctacctgggccagcctgacatcagcatcctgcagcccagcaatgtgcccccaccccagatcctgagccccctgtcctatgccccaaatgctgcccctgaggtgggccccccatcctatgccccccaggtgaccccagaggcccagttccccttctacgccccccaggccatcagcaaggtgcagcccagcagctatgccccccaggccaccccagacagctggccacccagctatggagtgtgcatggagggcagcggcaaggacagccccaccggcaccctgagcagccccaagcacctgcggcccaagggccagctgcagaaggagcccccagctggcagctgcatgctgggcggcctgagcctgcaggaggtgaccagcctggccatggaggagagccaggaggccaagagcctgcaccagcccctgggcatctgcacagacaggaccagtgaccccaacgtgctgcacagcggggaggagggcaccccccagtacctgaagggccagctgcccctgctgagctctgtgcagatcgagggccaccccatgagcctgcccctgcagccccccagccggccctgcagccccagcgaccagggccccagcccctggggcctgctggagagcctggtgtgccccaaggatgaggccaagagccctgcccctgagaccagtgacctggagcagcccacagagctggacagcctcttccggggcctggccctgactgtgcagtgggagagctag

SEQ ID NO: 34853 - DNA, 1911 bp, Artificial Sequence
  Description of Artificial Sequence: Synthetic coding sequence
atgagaggaggccgcggggcccccttctggctgtggcccctgcccaagctggccctgctgcccctgctgtgggtgctcttccagaggacccggccccagggcagcgctggccccctgcagtgctacggcgtgggccccctgggggacctgaactgctcctgggagcccctgggggacctgggcgcccccagcgagctgcacctgcagagccagaagtaccgcagcaacaagacccagacagtggccgtggccgccggccgctcctgggtggccatcccccgggagcagctgaccatgtctgacaagctgctggtgtggggcaccaaggccggccagcccctgtggccccctgtgtttgtgaacctggagacccagatgaagcccaatgccccccggctgggcccagatgtggacttctctgaagatgaccccctggaggccaccgtgcactgggccccacccacctggcccagccacaaggtgctgatctgccagttccactaccgccgctgccaggaggccgcctggaccctgctggagcctgagctgaagaccatccccctgacccctgtggagatccaggacctggagctggccaccggctacaaggtgtatggccgctgcaggatggagaaggaggaggacctgtggggcgagtggagccccatcctgtccttccagaccccaccttctgcccccaaggatgtgtgggtgtctggcaacctgtgtggcaccccaggaggagaggagcccctgctgctgtggaaggcccctggcccctgtgtgcaggtgtcctacaaggtgtggttctgggtgggcggccgggagctgagccctgagggcatcacctgctgctgcagcctcatccccagcggggctgagtgggcccgggtgtctgctgtgaatgccacctcctgggagcccctgaccaacctgagcctggtgtgcctggacagcgccagcgcccccaggtctgtggccgtgagcagcattgctggcagcacagagctgctggtgacctggcagcccggccctggagagcccctggagcacgtggtggactgggccagagatggagaccccctggagaagctgaactgggtgcggctgcccccaggcaacctgagcgccctgctgcccggcaacttcaccgtgggcgtgccctaccgcatcaccgtgacagctgtgtctgccagcggcctggccagcgccagctctgtgtggggcttccgggaggagctggcccccctggtgggccccaccctgtggaggctgcaggatgcccctcctggcaccccagccatcgcctggggcgaggtgcccaggcaccagctgcggggccacctgacccactacaccctgtgtgcccagagcggcaccagccccagcgtgtgcatgaatgtgtctggcaacacccagagcgtgaccctgcctgacctgccctggggcccctgtgagctgtgggtgacagccagcaccatcgccggccagggccccccaggccccatcctgcggctgcacctgcctgacaacaccctgcgctggaaggtgctgcccggcatcctcttcctgtggggcctcttcctgctgggctgcggcctgagcctggccaccagcggccgctgctaccacctgcggcacaaggtgctgccccgctgggtgtgggagaaggtgcctgaccctgccaacagcagcagcggccagccccacatggagcaggtgcctgaggcccagcccctgggggacctgcccatcctggaggtggaggagatggagcccccacctgtgatggagagcagccagcctgcccaggccacagcccccctggacagcggctatgagaagcacttcctgcccaccccagaggagctgggcctgctgggccccccccggccccaggtgctggcctag

SEQ ID NO: 34854 - DNA, 453 bp, Artificial Sequence
  Description of Artificial Sequence: Synthetic coding sequence
atgaccatcctgggcaccaccttcggcatggtgttcagcctgctgcaggtggtgtctggagagagcggctacgcccagaatggagacctggaggatgctgagctggatgactacagcttcagctgctacagccagctggaggtgaatggcagccagcacagcctgacctgtgcctttgaggaccctgatgtgaacatcaccaacctggagtttgagatctgtggggccctggtggaggtgaagtgcctgaacttcaggaagctgcaggagatctacttcatcgagaccaagaagttcctgctgattggcaagagcaacatctgtgtgaaggtgggggagaagagcctgacctgcaagaagattgacctgaccaccatcggcaagaagctgtacatcaaggtgtggctgagcctgctgggctacctgaagaccctgtgcctggacatcctgtag

SEQ ID NO: 34855 - DNA, 543 bp, Artificial Sequence
  Description of Artificial Sequence: Synthetic coding sequence
atgaccatcctgggcaccaccttcggcatggtgttcagcctgctgcaggtggtgtctggagagagcggctacgcccagaatggagacctggaggatgctgagctggatgactacagcttcagctgctacagccagctggaggtgaatggcagccagcacagcctgacctgtgcctttgaggaccctgatgtgaacatcaccaacctggagtttgagatctgtggggccctggtggaggtgaagtgcctgaacttcaggaagctgcaggagatctacttcatcgagaccaagaagttcctgctgattggcaagagcaacatctgtgtgaaggtgggggagaagagcctgacctgcaagaagattgacctgaccaccatcgtgaagccagaggccccctttgacctgtctgtggtgtaccgggagggcgccaatgactttgtggtgaccttcaacaccagccacctgcagaagaagtatgtgaaggtgctgatgcatgatgtggcctaccggcaggagaaggatgagaacaagtggacagactag

SEQ ID NO: 34856 - DNA, 1893 bp, Artificial Sequence
  Description of Artificial Sequence: Synthetic coding sequence
atgcccctgggcggccgggccagcctgaccccccagaagctgtggctgggcacagccaagccaggcagcctgacccaggccctgaacagccccctgacctgggagcacgcctggacaggagtgcctgggggcaccccagactgcctgacagacaccttccgggtgaagaggccccacctgcggcgcagcgccagcaatggccacgtgcccggcacccctgtgtaccgggagaaggaggacatgtatgatgagatcatcgagctgaagaagagcctgcacgtgcagaagagtgatgtggacctgatgaggaccaagctgcggcggctggaggaggagaacagcaggaaggaccggcagatcgagcagctgctggaccccagccggggcacagactttgtgaggaccctggccgagaagaggccagatgcctcctgggtgatcaatggcctgaagcagaggatcctgaagctggagcagcagtgcaaggagaaggatggcaccatcagcaagctgcagacagacatgaagaccaccaacctggaggagatgagaattgccatggagacctactatgaggaggtgcaccggctgcagaccctgctggccagcagcgagaccaccgggaagaagcccctgggggagaagaagacaggagccaagaggcagaagaagatgggcagcgccctgctgagcctgagccgctctgtgcaggagctgacagaggagaaccagagcctgaaggaggacctggacagagtgctgagcaccagccccaccatcagcaagacccagggctacgtggagtggagcaagccccggctgctgcggcgcatcgtggagctggagaagaagctgtctgtgatggagagcagcaagagccatgctgctgagcctgtgcgcagccaccccccagcctgcctggccagcagcagcgccctgcaccggcagcccaggggggacaggaacaaggaccacgagcggctgcggggagctgtgcgggacctgaaggaggagaggacagccctgcaggagcagctgctgcagagggacctggaggtgaagcagctgctgcaggccaaggctgacctggagaaggagctggagtgtgcccgggagggggaggaggagcggcgggagcgggaggaggtgctgcgggaggagatccagaccctgaccagcaagctgcaggagctgcaggagatgaagaaggaggagaaggaggactgcccagaggtgccccacaaggcccaggagctgcctgcccccacccccagcagccgccactgtgagcaggactggcccccagacagcagcgaggagggcctgccccggcccaggagcccctgcagtgatggaagaagagatgctgctgcccgggtgctgcaggcccagtggaaggtgtacaagcacaagaagaagaaggctgtgctggatgaggccgctgtggtgctgcaggccgccttccggggccacctgaccaggaccaagctgctggccagcaaggcccacggcagcgagcccccatctgtgcccggcctgcctgaccagagcagccctgtgccccgggtgcccagccccatcgcccaggccaccggcagccctgtgcaggaggaggccatcgtcatcatccagagcgccctgcgggcccacctggcccgggcccggcacagcgccaccgggaagaggaccaccacagctgccagcaccaggagaagaagtgccagcgccacccatggagatgccagcagcccccccttcctggccgccctgcctgaccccagccccagcggcccccaggccctggcccccctgcctggagatgatgtgaacagtgatgacagtgatgacatcgtgattgcccccagcctgcccaccaagaacttccctgtgtag

SEQ ID NO: 34857 - DNA, 2088 bp, Artificial Sequence
  Description of Artificial Sequence: Synthetic coding sequence
atgttcctgggcactggagagcccgccctggacacaggagatgacagcctgtctgctgtgacctttgacagtgatgtggagaccaaggccaagaggaaggccttccacaagcccccacccaccagccccaagagcccctacctgagcaagcccaggaaggtggcctcctggaggagcctgaggacagctggctccatgcccctgggcggccgggccagcctgaccccccagaagctgtggctgggcacagccaagccaggcagcctgacccaggccctgaacagccccctgacctgggagcacgcctggacaggagtgcctgggggcaccccagactgcctgacagacaccttccgggtgaagaggccccacctgcggcgcagcgccagcaatggacatgtgcccggcacccctgtgtaccgggagaaggaggacatgtatgatgagatcatcgagctgaagaagagcctgcacgtgcagaagagtgatgtggacctgatgaggaccaagctgcggcggctggaggaggagaacagcaggaaggaccggcagatcgagcagctgctggaccccagccggggcacagactttgtgaggaccctggccgagaagaggccagatgcctcctgggtgatcaatggcctgaagcagaggatcctgaagctggagcagcagtgcaaggagaaggatggcaccatcagcaagctgcagacagacatgaagaccaccaacctggaggagatgagaattgccatggagacctactatgaggaggtgcaccggctgcagaccctgctggccagcagcgagaccaccgggaagaagcccctgggggagaagaagacaggagccaagaggcagaagaagatgggcagcgccctgctgagcctgagccgctctgtgcaggagctgacagaggagaaccagagcctgaaggaggacctggacagagtgctgagcaccagccccaccatcagcaagacccagggctacgtggagtggagcaagccccggctgctgcggagaattgtggagctggagaagaagctgtctgtgatggagagcagcaagagccacgccgctgagcctgtgcgcagccaccccccagcctgcctggccagcagcagcgccctgcaccggcagcccaggggggacaggaacaaggaccacgagcggctgcggggagctgtgcgggacctgaaggaggagaggacagccctgcaggagcagctgctgcagagggacctggaggtgaagcagctgctgcaggccaaggctgacctggagaaggagctggagtgtgcccgggagggggaggaggagcggcgggagcgggaggaggtgctgcgggaggagatccagaccctgaccagcaagctgcaggagctgcaggagatgaagaaggaggagaaggaggactgcccagaggtgccccacaaggcccaggagctgcctgcccccacccccagcagccgccactgtgagcaggactggcccccagacagcagcgaggagggcctgccccggcccaggagcccctgcagtgatggaagaagagatgctgctgcccgggtgctgcaggcccagtggaaggtgtacaagcacaagaagaagaaggctgtgctggatgaagctgctgtggtgctgcaggccgccttccggggccacctgaccaggaccaagctgctggccagcaaggcccacggcagcgagccccccagcgtgcccggcctgcctgaccagagcagccctgtgccccgggtgcccagccccatcgcccaggccaccggcagccctgtgcaggaggaggccatcgtcatcatccagagcgccctgcgggcccacctggcccgggcccggcacagcgccaccgggaagaggaccaccacagctgccagcacccggcggcgcagcgccagcgccacccatggagatgccagcagcccccccttcctggccgccctgcctgaccccagccccagcggcccccaggccctggcccccctgcctggagatgatgtgaacagtgatgacagtgatgacatcgtcatcgcccccagcctgcccaccaagaacttccctgtgtag

SEQ ID NO: 34858 - DNA, 1935 bp, Artificial Sequence
  Description of Artificial Sequence: Synthetic coding sequence
atgttcctgggcactggagagcccgccctggacaccagccacctgatcagcctgagccgggccagcctgaccccccagaagctgtggctgggcacagccaagccaggcagcctgacccaggccctgaacagccccctgacctgggagcacgcctggacaggagtgcctgggggcaccccagactgcctgacagacaccttccgggtgaagaggccccacctgcggcgcagcgccagcaatggccacgtgcccggcacccctgtgtaccgggagaaggaggacatgtatgatgagatcatcgagctgaagaagagcctgcacgtgcagaagagtgatgtggacctgatgaggaccaagctgcggcggctggaggaggagaacagcaggaaggaccggcagatcgagcagctgctggaccccagccggggcacagactttgtgaggaccctggccgagaagaggccagatgcctcctgggtgatcaatggcctgaagcagaggatcctgaagctggagcagcagtgcaaggagaaggatggcaccatcagcaagctgcagacagacatgaagaccaccaacctggaggagatgagaattgccatggagacctactatgaggaggtgcaccggctgcagaccctgctggccagcagcgagaccaccgggaagaagcccctgggggagaagaagacaggagccaagaggcagaagaagatgggcagcgccctgctgagcctgagccgctctgtgcaggagctgacagaggagaaccagagcctgaaggaggacctggacagagtgctgagcaccagccccaccatcagcaagacccagggctacgtggagtggagcaagccccggctgctgcggcgcatcgtggagctggagaagaagctgtctgtgatggagagcagcaagagccatgctgctgagcctgtgcgcagccaccccccagcctgcctggccagcagcagcgccctgcaccggcagcccaggggggacaggaacaaggaccacgagcggctgcggggagctgtgcgggacctgaaggaggagaggacagccctgcaggagcagctgctgcagagggacctggaggtgaagcagctgctgcaggccaaggctgacctggagaaggagctggagtgtgcccgggagggggaggaggagcggcgggagcgggaggaggtgctgcgggaggagatccagaccctgaccagcaagctgcaggagctgcaggagatgaagaaggaggagaaggaggactgcccagaggtgccccacaaggcccaggagctgcctgcccccacccccagcagccgccactgtgagcaggactggcccccagacagcagcgaggagggcctgccccggcccaggagcccctgcagtgatggaagaagagatgctgctgcccgggtgctgcaggcccagtggaaggtgtacaagcacaagaagaagaaggctgtgctggatgaggccgctgtggtgctgcaggccgccttccggggccacctgaccaggaccaagctgctggccagcaaggcccacggcagcgagcccccatctgtgcccggcctgcctgaccagagcagccctgtgccccgggtgcccagccccatcgcccaggccaccggcagccctgtgcaggaggaggccatcgtcatcatccagagcgccctgcgggcccacctggcccgggcccggcacagcgccaccgggaagaggaccaccacagctgccagcaccaggagaagaagtgccagcgccacccatggagatgccagcagcccccccttcctggccgccctgcctgaccccagccccagcggcccccaggccctggcccccctgcctggagatgatgtgaacagtgatgacagtgatgacatcgtgattgcccccagcctgcccaccaagaacttccctgtgtag

SEQ ID NO: 34859 - DNA, 387 bp, Artificial Sequence
  Description of Artificial Sequence: Synthetic coding sequence
atgcccctgggcggccgggccagcctgaccccccagaagctgtggctgggcacagccaagccaggcagcctgacccaggccctgaacagccccctgacctgggagcacgcctggacaggagtgcctgggggcaccccagactgcctgacagacaccttccgggtgaagaggccccacctgcggcgcagcgccagcaatggccacgtgcccggcacccctgtgtaccgggagaaggaggacatgtatgatgagatcatcgagctgaagaagagcctgcacgtgcagaagagtgatgtggacctgatgaggaccaagctgcggcggctggaggaggagaacagcaggaaggaccggcagatcgagcagctgctggaccccagcaggtag

SEQ ID NO: 34860 - DNA, 387 bp, Artificial Sequence; identical to SEQ ID NO: 34859
  Description of Artificial Sequence: Synthetic coding sequence

SEQ ID NO: 34861 - DNA, 2040 bp, Artificial Sequence
  Description of Artificial Sequence: Synthetic coding sequence
atgttcctgggcactggagagcccgccctggacaccaaggccaagaggaaggccttccacaagcccccacccaccagccccaagagcccctacctgagcaagcccaggaaggtggcctcctggaggagcctgaggacagctggctccatgcccctgggcggccgggccagcctgaccccccagaagctgtggctgggcacagccaagccaggcagcctgacccaggccctgaacagccccctgacctgggagcacgcctggacaggagtgcctgggggcaccccagactgcctgacagacaccttccgggtgaagaggccccacctgcggcgcagcgccagcaatggacatgtgcccggcacccctgtgtaccgggagaaggaggacatgtatgatgagatcatcgagctgaagaagagcctgcacgtgcagaagagtgatgtggacctgatgaggaccaagctgcggcggctggaggaggagaacagcaggaaggaccggcagatcgagcagctgctggaccccagccggggcacagactttgtgaggaccctggccgagaagaggccagatgcctcctgggtgatcaatggcctgaagcagaggatcctgaagctggagcagcagtgcaaggagaaggatggcaccatcagcaagctgcagacagacatgaagaccaccaacctggaggagatgagaattgccatggagacctactatgaggaggtgcaccggctgcagaccctgctggccagcagcgagaccaccgggaagaagcccctgggggagaagaagacaggagccaagaggcagaagaagatgggcagcgccctgctgagcctgagccgctctgtgcaggagctgacagaggagaaccagagcctgaaggaggacctggacagagtgctgagcaccagccccaccatcagcaagacccagggctacgtggagtggagcaagccccggctgctgcggagaattgtggagctggagaagaagctgtctgtgatggagagcagcaagagccacgccgctgagcctgtgcgcagccaccccccagcctgcctggccagcagcagcgccctgcaccggcagcccaggggggacaggaacaaggaccacgagcggctgcggggagctgtgcgggacctgaaggaggagaggacagccctgcaggagcagctgctgcagagggacctggaggtgaagcagctgctgcaggccaaggctgacctggagaaggagctggagtgtgcccgggagggggaggaggagcggcgggagcgggaggaggtgctgcgggaggagatccagaccctgaccagcaagctgcaggagctgcaggagatgaagaaggaggagaaggaggactgcccagaggtgccccacaaggcccaggagctgcctgcccccacccccagcagccgccactgtgagcaggactggcccccagacagcagcgaggagggcctgccccggcccaggagcccctgcagtgatggaagaagagatgctgctgcccgggtgctgcaggcccagtggaaggtgtacaagcacaagaagaagaaggctgtgctggatgaagctgctgtggtgctgcaggccgccttccggggccacctgaccaggaccaagctgctggccagcaaggcccacggcagcgagccccccagcgtgcccggcctgcctgaccagagcagccctgtgccccgggtgcccagccccatcgcccaggccaccggcagccctgtgcaggaggaggccatcgtcatcatccagagcgccctgcgggcccacctggcccgggcccggcacagcgccaccgggaagaggaccaccacagctgccagcacccggcggcgcagcgccagcgccacccatggagatgccagcagcccccccttcctggccgccctgcctgaccccagccccagcggcccccaggccctggcccccctgcctggagatgatgtgaacagtgatgacagtgatgacatcgtcatcgcccccagcctgcccaccaagaacttccctgtgtag

SEQ ID NO: 34862 - DNA, 4896 bp, Artificial Sequence
  Description of Artificial Sequence: Synthetic coding sequence
atggagaggagagctgctggccctggctgggccgcctatgagcggctgacagctgaggagatggatgagcagaggcggcagaatgtggcctaccagtacctgtgccgcctggaggaggccaagcgctggatggaggcctgcctgaaggaggagctgcccagccctgtggagctggaggagagcctgagaaatggagtgctgctggccaagctgggccactgctttgcccccagcgtggtgcccctgaagaagatctatgatgtggagcagctgcgctaccaggccaccggcctgcacttccgccacacagacaacatcaacttctggctgagcgccatcgcccacatcggcctgcccagcaccttcttccctgagaccacagacatctatgacaagaagaacatgccccgggtggtgtactgcatccacgccctgagcctcttcctgttccggctgggcctggccccccagatccatgacctgtatggcaaggtgaagttcaccgctgaggagctgagcaacatggccagcgagctggccaagtatggcctgcagctgcctgccttcagcaagattggaggcatcctggccaatgagctgtctgtggatgaagctgctgtgcatgctgctgtgctggccatcaatgaagctgtggagcggggcgtggtggaggacaccctggccgccctgcagaaccccagcgccctgctggagaacctgcgggagcccctggccgctgtgtaccaggagatgctggcccaggccaagatggagaaggccgccaatgccaggaaccatgatgaccgggagagccaggacatctatgaccactacctgacccaggccgagatccagggcaacatcaaccacgtgaatgtgcacggggccctggaggtggtggatgatgccctggagcggcagagccctgaggccctgctgaaggccctgcaggaccctgccctggccctgcggggcgtgagaagagactttgctgactggtacctggagcagctgaacagcgaccgggagcagaaggcccaggagctgggcctggtggagctgctggagaaggaggaggtgcaggccggcgtggccgccgccaacaccaagggggaccaggagcaggccatgctgcatgctgtgcagaggatcaacaaggccatcagaagaagagtggccgctgacacagtgaaggagctgatgtgcccagaggcccagctgccccctgtgtaccctgtggccagctccatgtaccagctggagctggccgtgctgcagcagcagcagggcgagctgggccaggaggagctgtttgtggccgtggagatgctgtctgctgtggtgctgatcaacagagccctggaggccagagatgccagcggcttctggagcagcctggtgaacccagccaccggcctggccgaggtggagggagaaaatgcccagcgctactttgatgccctgctgaagctgcggcaggagcggggcatgggagaggacttcctgtcctggaatgacctgcaggccaccgtgtcccaggtgaatgcccagacccaggaggagacagacagagtgctggccgtgtccctcatcaatgaggccctggacaagggcagccctgagaagaccctgagcgccctgctgctgcctgctgctggcctggatgatgtgtccctgcctgtggccccccgctaccacctgctgctggtggccgccaagaggcagaaggcccaggtgactggagaccctggagctgtgctgtggctggaggagatccggcagggcgtggtgcgggccaaccaggacaccaacacagcccagaggatggccctgggcgtggccgccatcaaccaggccatcaaggagggcaaggccgcccagacagagcgggtgctgagaaatcctgctgtggccctgcggggcgtggtgcctgactgtgccaacggctaccagagggccctggagagcgccatggccaagaagcagaggcctgctgacacagccttctgggtgcagcacgacatgaaggatggaacagcctactacttccacctgcagaccttccagggcatctgggagcagcccccaggctgccccctgaacaccagccacctgacccgggaggagatccagagcgctgtgaccaaggtgacagctgcctatgaccggcagcagctgtggaaggccaacgtgggctttgtgatccagctgcaggcccggctgcggggcttcctggtgcggcagaagtttgctgagcacagccacttcctgcggacctggctgcctgctgtgatcaagatccaggcccactggaggggctaccggcagaggaagatctacctggagtggctgcagtacttcaaggccaacctggatgccatcatcaagatccaggcctgggccaggatgtgggccgcccggcggcagtacctgcggcggctgcactacttccagaagaatgtgaacagcatcgtgaagatccaggccttcttccgggccaggaaggcccaggatgactaccgcatcctggtgcacgccccccacccccccctgtctgtggtgagaagatttgcccacctgctgaaccagagccagcaggacttcctggccgaggccgagctgctgaagctgcaggaggaggtggtgaggaagatccgcagcaaccagcagctggagcaggacctgaacatcatggacatcaagattggcctgctggtgaagaaccgcatcaccctgcaggaggtggtgagccactgcaagaagctgaccaagaggaacaaggagcagctgagtgacatgatggtgctggacaagcagaagggcctgaagagcctgagcaaggagaagaggcagaagctggaggcctaccagcacctgttctacctgctgcagacccagcccatctacctggccaagctgatcttccagatgccccagaacaagaccaccaagttcatggaggccgtcatcttcagcctgtacaactatgccagcagccggcgggaggcctacctgctgctgcagctgttcaagacagccctgcaggaggagatcaagagcaaggtggagcagccccaggatgtggtgacaggcaaccccaccgtggtgcggctggtggtgcgcttctacagaaatggccggggccagagcgccctgcaggagatcctgggcaaggtgatccaggatgtgctggaggacaaggtgctgtctgtgcacacagatcctgtgcacctgtacaagaactggatcaaccagacagaggcccagacaggccagaggagccacctgccctatgatgtgaccccagagcaggccctgagccaccctgaggtgcagaggcggctggacatcgccctgaggaacctgctggccatgacagacaagttcctgctggccatcaccagctctgtggaccagatcccctacggcatgagatatgtggccaaggtgctgaaggccaccctggccgagaagttcccagatgccacagattctgaggtgtacaaggtggtgggcaacctgctgtactaccgcttcctgaacccagctgtggtggccccagatgcctttgacatcgtggccatggctgctggaggagccctggccgccccccagagacatgccctgggcgctgtggcccagctgctgcagcacgccgctgctgggaaggccttcagcggccagagccagcacctgcgggtgctgaatgactacctggaggagacccacctgaagttcaggaagttcatccaccgggcctgccaggtgcctgagcctgaggagagatttgctgtggatgagtacagcgacatggtggccgtggccaagcccatggtgtacatcaccgtgggggagctggtgaacacccaccggctgctgctggagcaccaggactgcatcgccccagaccaccaggaccccctgcacgagctgctggaggacctgggggagctgcccaccatcccagacctgattggagagagcattgctgctgatggccacacagacctgagcaagctggaggtgtccctgaccctgaccaacaagtttgagggcctggaggctgatgctgatgacagcaacaccaggagcctgctgctgagcaccaagcagctgctggccgacatcatccagttccaccctggggacaccctgaaggagatcctgagcctgagcgccagccgggagcaggaggccgcccacaagcagctgatgagccggcggcaggcctgcacagcccagaccccagagcccctgcggcggcacaggagcctgacagcccacagcctgctgcccctggccgagaagcagaggagagtgctgaggaacctgcggcggctggaggccctgggcctggtgtctgccagaaatggctaccagggcctggtggatgagctggccaaggacatccggaaccagcaccgccaccgccacaggaggaaggccgagctggtgaagctgcaggccaccctgcagggcctgagcaccaagaccaccttctatgaggagcagggcgactactacagccagtacatccgggcctgcctggaccacctggccccagacagcaagagcagcggcaagggcaagaagcagcccagcctgcactacacagctgcccagctgctggagaagggcgtgctggtggagattgaggacctgcctgccagccacttcagaaatgtcatctttgacatcaccccaggagatgaggccggcaagtttgaggtgaatgccaagttcctgggcgtggacatggagcgcttccagctgcactaccaggacctgctgcagctgcagtatgaaggagtggccgtgatgaagctgttcaacaaggccaaggtgaatgtgaacctgctgatcttcctgctgaacaagaagttcctgaggaagtag

SEQ ID NO: 34863 - DNA, 465 bp, Artificial Sequence
  Description of Artificial Sequence: Synthetic coding sequence
atggctgctgcctggggcagcagcctgacagctgccacccagagagctgtgaccccctggccccggggccgcctgctgacagccagcctgggcccccaggcccggcgggaggccagcagcagcagccctgaggccggggagggccagatccggctgacagacagctgtgtgcagaggctgctggagatcacagagggcagcgagttcctgcggctgcaggtggagggcggcggctgcagcggcttccagtacaagttcagcctggacaccgtcatcaacccagatgacagagtgtttgagcagggcggggcccgggtggtggtggacagcgacagcctggcctttgtgaagggggcccaggtggacttcagccaggagctgatccgcagcagcttccaggtgctgaacaacccccaggcccagcagggctgcagctgtggcagcagcttcagcatcaagctgtag

SEQ ID NO: 34864 - DNA, 666 bp, Artificial Sequence
  Description of Artificial Sequence: Synthetic coding sequence
atgcccctggccctgaccctgctgctgctgagcggcctgggcgcccctgggggctggggctgcctgcagtgtgaccccctggtgctggaggccctgggccacctgcggagcgccctgatccccagccgcttccagctggagcagctgcaggcccgggccggggctgtgctgatgggcatggagggccccttcttccgggactatgccctgaatgtgtttgtgggcaaggtggagaccaaccagctggacctggtggccagctttgtgaagaaccagacccagcacctgatgggcaacagcctgaaggatgagcccctgctggaggagctggtgaccctgcgggccaacgtcatcaaggagttcaagaaggtgctgatctcctatgagctgaaggcctgcaaccccaagctgtgccgcctgctgaaggaggaggtgctggactgcctgcactgccagaggatcacccccaagtgcatccacaagaagtactgctttgtggaccggcagccccgggtggccctgcagtaccagatggacagcaagtaccccaggaaccaggccctgctgggcatcctgatctctgtgtccctggccgtgtttgtgtttgtggtgattgtggtgtctgcctgcacctaccggcagaacaggaagctgctgctgcagtag

SEQ ID NO: 34865 - DNA, 579 bp, Artificial Sequence
  Description of Artificial Sequence: Synthetic coding sequence
atgcccctggccctgaccctgctgctgctgagcggcctgggcgcccctgggggctggggctgcctgcagtgtgaccccctggtgctggaggccctgggccacctgcggagcgccctgatccccagccgcttccagctggagcagctgcaggcccgggccggggctgtgctgatgggcatggagggccccttcttccgggactatgccctgaatgtgtttgtgggcaaggtggagaccaaccagctggacctggtggccagctttgtgaagaaccagacccagcacctgatgggcaacagcctgaaggatgagcccctgctggaggagctggtgaccctgcgggccaacgtcatcaaggagttcaagaaggtgctgatctcctatgagctgaaggccggcaacccagcctggccctgcagcacccgctggacagccaacacccggggcacccggcgctgctgggccagcagcttcctgtgcctgtggctgagcctgagctcctggagctcctggagccggctggtgcacacagacaagacagagaacagctgctgcagcaggacagtggtgtggggctag

SEQ ID NO: 34866 - DNA, 720 bp, Artificial Sequence
  Description of Artificial Sequence: Synthetic coding sequence
atgggagacctgtggctgttcctgctgctgcccctgagcgccttccacggcgtgaagggctgcctggagtgtgaccccaagttcattgaagatgtgggcagcctgctgggcaacctgatccccagcgaggtgcccggccgcacccagctgctggagcggcagatcaaggagatgatccacctgtccttcaaggtgagccacagcgacaagaggctgcgggtgctggccgtgcagcaggtggtgaagctgcggacctggctgaagaatgagttctacaagctgggcaatgagacctggaagggcgtcttcatctaccagggcaagctgctggatgtgtgccagaacctggagagcaagctgaaggagctgctgaagaacttcagcgagatcgcctgcagcgaggactgcatcgtggtggagggccccatcctggactgctggacctgcctgaggatgaccaaccgctgcttcaagggggagtactgtggagatgaggaccccaggaaggcagaaaatcgggagatcgccctcttcctgatcctgctggccacagctgtgatcctgggcagcgctgtgctgctcttccacttctgcatcttccacaggaggaagatgaaggccatcagaagaagcctgaaggagtatgtggagaagaagctggaggagctgatgggcaagattgatgagaaggaggagaaggacttccggctgaggaagtag

SEQ ID NO: 34867 - DNA, 1053 bp, Artificial Sequence
  Description of Artificial Sequence: Synthetic coding sequence
atgggcccccacttcaccctgctgtgtgccgccctggccggctgcctgctgcctgctgagggctgcgtcatctgtgaccccagcgtggtgctggccctgaagagcctggagaaggactacctgcccggccacctggatgccaagcaccacaaggccatgatggagcgggtggagaatgctgtgaaggacttccaggagctgagcctgaatgaagatgcctacatgggcgtggtggatgaggccaccctgcagaagggctcctggagcctgctgaaggacctgaagaggatcacagacagtgatgtgaagggggacctgtttgtgaaggagctgttctggatgctgcacctgcagaaggagacctttgccacctacgtggcccgcttccagaaggaggcctactgccccaacaagtgtggggtgatgctgcagaccctcatctggtgcaagaactgcaagaaggaggtgcacgcctgcaggaagagctatgactgtggggagagaaatgtggaggtgccccagatggaggacatgatcctggactgtgagctgaactggcaccaggccagcgagggcctgacagactacagcttctacagagtgtggggcaacaacacagagaccctggtgtccaagggcaaggaggccaccctgaccaagcccatggtgggcccagaagatgctggcagctaccgctgtgagctgggctctgtgaacagcagccctgccaccatcatcaacttccacgtgacagtgctgcccaagatgatcaaggaggagaagcccagccccaacatcgtgaccccaggagaggccaccacagagagcagcatcagcctgcagcccctgcagcctgagaagatgctggccagccggctgctgggcctgctgatctgtggcagcctggccctgatcaccggcctgacctttgccatcttcagaagaaggaaggtgattgacttcatcaagagcagcctgtttggcctgggcagcggggctgctgagcagacccaggtgcccaaggagaaggccacagacagccggcagcagtag

SEQ ID NO: 34868 - DNA, 552 bp, Artificial Sequence
  Description of Artificial Sequence: Synthetic coding sequence
atggccagcagagctggccccagggctgctggaacagatggcagtgacttccagcaccgggagcgggtggccatgcactaccagatgtctgtgaccctgaagtatgagatcaagaagctgatctacgtgcacctggtgatctggctgctgctggtggccaagatgtctgtgggccacctgcggctgctgagccatgaccaggtggccatgccctaccagtgggagtacccctacctgctgagcatcctgcccagcctgctgggcctgctgtccttccccaggaacaacatctcctacctggtgctgtccatgatctccatgggcctcttcagcatcgcccccctcatctacggctccatggagatgtttcctgctgcccagcagctgtaccgccacggcaaggcctaccgcttcctgtttggcttctctgctgtgtccatcatgtacctggtgctggtgctggccgtgcaggtgcacgcctggcagctgtactacagcaagaagctgctggacagctggttcaccagcacccaggagaagaagcacaagtag

SEQ ID NO: 34869 - DNA, 546 bp, Artificial Sequence
  Description of Artificial Sequence: Synthetic coding sequence
atggccagcagagctggccccagggctgctggaacagatggcagtgacttccagcaccgggagcgggtggccatgcactaccagatgtctgtgaccctgaagtatgagatcaagaagctgatctacgtgcacctggtgatctggctgctgctggtggccaagatgtctgtgggccacctgcggctgctgagccatgaccaggtggccatgccctaccagtgggagtacccctacctgctgagcatcctgcccagcctgctgggcctgctgtccttccccaggaacaacatctcctacctggtgctgtccatgatctccatgggcctcttccacaggagcacccacctgtggcagcacggagatgtgccctgctgcacagctgccacagccatggcccggcccaccgtgagcagcctggtgttcctgcccttccccatgtacctggtgctggtgctggccgtgcaggtgcacgcctggcagctgtactacagcaagaagctgctggacagctggttcaccagcacccaggagaagaagcacaagtag

SEQ ID NO: 34870 - DNA, 1881 bp, Artificial Sequence
  Description of Artificial Sequence: Synthetic coding sequence
atgagcaagaagggccgcagcaagggggagaagccagagatggagacagatgctgtgcagatggccaatgaggagctgcgggccaagctgaccagcatccagatcgagttccagcaggagaagagcaaggtgggcaagctgcgggagcggctgcaggaggccaagctggagcgggagcaggagcagaggaggcacacagcctacatcagcgagctgaaggccaagctgcacgaggagaagaccaaggagctgcaggccctgcgggagggcctcatccggcagcacgagcaggaggccgccaggacagccaagatcaaggagggggagctgcagaggctgcaggccaccctgaatgtgctgagagatggagctgctgacaaggtgaagacagccctgctgacagaggcccgggaggaggcccggcgggcctttgatggagagcggctgcggctgcagcaggagatcctggagctgaaggccgccaggaagcaggccgaggaggccctgagcaactgcatgcaggccgacaagaccaaggctgctgacctgcgggccgcctaccaggcccaccaggatgaggtgcaccgcatcaagcgggagtgtgagcgggacatccggcggctgatggatgagatcaagggcaaggacagagtcatcctggccctggagaaggagctgggcgtgcaggccggccagacccagaagctgctgctgcagaaggaggccctggatgagcagctggtgcaggtgaaggaggccgagcggcaccacagcagccccaagcgggagctgcccccaggcatcggggacatggtggagctgatgggcgtgcaggaccagcacatggatgaaagagatgtgcggcgcttccagctgaagattgctgagctgaacagcgtcatcaggaagctggaggacaggaacaccctgctggctgatgaaagaaatgagctgctgaagaggagccgggagacagaggtgcagctgaagcccctggtggagaagaacaagaggatgaacaagaagaatgaagacctgctgcagagcatccagaggatggaggagaagatcaagaacctgaccagagaaaatgtggagatgaaggagaagctgagcgcccaggccagcctgaagaggcacaccagcctgaatgacctgagcctgaccagagatgagcaggagattgagttcctgcggctgcaggtgctggagcagcagcacgtgattgatgacctgagcctggagcgggagcggctgctgcggagcaagaggcaccggggcaagagcctgaagccacccaagaagcacgtggtggagaccttcttcggctttgatgaggagagcgtggacagcgagaccctgtctgagaccagctacaacacagacagaacagacaggaccccagccaccccagaggaggacctggatgatgccacagcccgggaggaggccgacctgcgcttctgccagctgacccgggagtaccaggccctgcagagggcctatgccctgctgcaggagcaggtgggcggcaccctggatgctgagcgggaggcccggacccgggagcagctgcaggccgacctgctgcgctgccaggccaagattgaggacctggagaagctgctggtggagaagggccaggacagcaagtgggtggaggagaagcagctgctgatccgcaccaaccaggacctgctggagaagatctaccgcctggagatggaggagaaccagctgaagaatgagatgcaggatgccaaggaccagaatgagctgctggagttccgggtgctggagctggaggtgcgggacagcatctgctgcaagctgagcaatggagctgacatcctgtttgagcccaagctgaagttcatgtag

SEQ ID NO: 34871 - DNA, 2496 bp, Artificial Sequence
  Description of Artificial Sequence: Synthetic coding sequence
atgagcaagaagggccgcagcaagggggagaagccagagatggagacagatgctgtgcagatggccaatgaggagctgcgggccaagctgaccagcatccagatcgagttccagcaggagaagagcaaggtgggcaagctgcgggagcggctgcaggaggccaagctggagcgggagcaggagcagaggaggcacacagcctacatcagcgagctgaaggccaagctgcacgaggagaagaccaaggagctgcaggccctgcgggagggcctcatccggcagcacgagcaggaggccgccaggacagccaagatcaaggagggggagctgcagaggctgcaggccaccctgaatgtgctgagagatggagctgctgacaaggtgaagacagccctgctgacagaggcccgggaggaggcccggcgggcctttgatggagagcggctgcggctgcagcaggagatcctggagctgaaggccgccaggaagcaggccgaggaggccctgagcaactgcatgcaggccgacaagaccaaggctgctgacctgcgggccgcctaccaggcccaccaggatgaggtgcaccgcatcaagcgggagtgtgagcgggacatccggcggctgatggatgagatcaagggcaaggacagagtcatcctggccctggagaaggagctgggcgtgcaggccggccagacccagaagctgctgctgcagaaggaggccctggatgagcagctggtgcaggtgaaggaggccgagcggcaccacagcagccccaagcgggagctgcccccaggcatcggggacatggtggagctgatgggcgtgcaggaccagcacatggatgaaagagatgtgcggcgcttccagctgaagattgctgagctgaacagcgtcatcaggaagctggaggacaggaacaccctgctggctgatgaaagaaatgagctgctgaagaggagccgggagacagaggtgcagctgaagcccctggtggagaagaacaagaggatgaacaagaagaatgaagacctgctgcagagcatccagaggatggaggagaagatcaagaacctgaccagagaaaatgtggagatgaaggagaagctgagcgcccaggccagcctgaagaggcacaccagcctgaatgacctgagcctgaccagagatgagcaggagattgagttcctgcggctgcaggtgctggagcagcagcacgtgattgatgacctgagcctggagcgggagcggctgctgcggagcaagaggcaccggggcaagagcctgaagccacccaagaagcacgtggtggagaccttcttcggctttgatgaggagagcgtggacagcgagaccctgtctgagaccagctacaacacagacagaacagacaggaccccagccaccccagaggaggacctggatgatgccacagcccgggaggaggccgacctgcgcttctgccagctgacccgggagtaccaggccctgcagagggcctatgccctgctgcaggagcaggtgggcggcaccctggatgctgagcgggaggcccggacccgggagcagctgcaggccgacctgctgcgctgccaggccaagattgaggacctggagaagctgctggtggagaagggccaggacagcaagtgggtggaggagaagcagctgctgatccgcaccaaccaggacctgctggagaagatctaccgcctggagatggaggagaaccagctgaagaatgagatgcaggatgccaaggaccagaatgagctgctggagttccgggtgctggagctggaggagcgggagcggcgcagccctgccttcaacctgcagatcaccaccttccctgagaaccacagcagcgccctgcagctgttctgccaccaggagggcgtgaaggatgtgaatgtgtctgagctgatgaagaagctggacatcctgggggacaatggaaacctgagaaatgaggagcaggtggccatcatccaggccggcaccgtgctggccctgtgtgagaagtggctgaagcagatcgagggcacagaggccgccctgacccagaagatgctggacctggagaaggagaaggacctcttcagccggcagaagggctacctggaggaggagctggactacaggaagcaggccctggaccaggcctacctgaagatccaggacctggaggccaccctgtacacagccctgcagcaggagcccggccggcgggccggggaggccctgtctgagggccagcgggaggacctgcaggccgctgtggagaaggtgcggcggcagatcctgcggcagagccgggagtttgacagccagatcctgcgggagaggatggagctgctgcagcaggcccagcagaggatccgggagctggaggacaagctggagttccagaagaggcacctgaaggagctggaggagaagttcctgttcctgttcctgttcttcagcctggccttcatcctgtggccctag

SEQ ID NO: 34872 - DNA, 1941 bp, Artificial Sequence
  Description of Artificial Sequence: Synthetic coding sequence
atgagcaagaagggccgcagcaagggggagaagccagagatggagacagatgctgtgcagatggccaatgaggagctgcgggccaagctgaccagcatccagatcgagttccagcaggagaagagcaagatggatgagatcaagggcaaggacagagtcatcctggccctggagaaggagctgggcgtgcaggccggccagacccagaagctgctgctgcagaaggaggccctggatgagcagctggtgcaggtgaaggaggccgagcggcaccacagcagccccaagcgggagctgcccccaggcattggagacatggtggagctgatgggcgtgcaggaccagcacatggatgaaagagatgtgcggcgcttccagctgaagattgctgagctgaacagcgtcatcaggaagctggaggacaggaacaccctgctggctgatgaaagaaatgagctgctgaagaggagccgggagacagaggtgcagctgaagcccctggtggagaagaacaagaggatgaacaagaagaatgaagacctgctgcagagcatccagaggatggaggagaagatcaagaacctgacccgggagaatgtggagatgaaggagaagctgagcgcccaggccagcctgaagaggcacaccagcctgaatgacctgagcctgaccagagatgagcaggagattgagttcctgcggctgcaggtgctggagcagcagcacgtgattgatgacctgagcctgaagcacgtggtggagaccttctttggatttgatgaggagagcgtggacagcgagaccctgtctgagaccagctacaacacagacagaacagacaggaccccagccaccccagaggaggacctggatgatgccacagcccgggaggaggccgacctgcgcttctgccagctgacccgggagtaccaggccctgcagagggcctatgccctgctgcaggagcaggtgggcggcaccctggatgctgagcgggaggcccggacccgggagcagctgcaggccgacctgctgcgctgccaggccaagattgaggacctggagaagctgctggtggagaagggccaggacagcaagtgggtggaggagaagcagctgctgatccgcaccaaccaggacctgctggagaagatctaccgcctggagatggaggagaaccagctgaagaatgagatgcaggatgccaaggaccagaatgagctgctggagttccgggtgctggagctggaggagcgggagaggaggagccctgccttcaacctgcagatcaccaccttccctgagaaccacagcagcgccctgcagctgttctgccaccaggagggcgtgaaggatgtgaatgtgtctgagctgatgaagaagctggacatcctgggggacaatggaaacctgagaaatgaggagcaggtggccatcatccaggccggcaccgtgctggccctgtgtgagaagtggctgaagcagatcgagggcacagaagctgccctgacccagaagatgctggacctggagaaggagaaggacctcttcagccggcagaagggctacctggaggaggagctggactacaggaagcaggccctggaccaggcctacctgaagatccaggacctggaggccaccctgtacacagccctgcagcaggagcctggaagaagagctggggaggccctgtctgagggccagcgggaggacctgcaggccgctgtggagaaggtgcggcggcagatcctgcggcagagccgggagtttgacagccagatcctgcgggagaggatggagctgctgcagcaggcccagcagaggatccgggagctggaggacaagctggagttccagaagaggcacctgaaggagctggaggagaagttcctgttcctgttcctgttcttcagcctggccttcatcctgtggccctag

SEQ ID NO: 34873 - DNA, 1881 bp, Artificial Sequence; identical to SEQ ID NO: 34870
  Description of Artificial Sequence: Synthetic coding sequence

SEQ ID NO: 34874 - DNA, 1296 bp, Artificial Sequence
  Description of Artificial Sequence: Synthetic coding sequence
atgagcaagaagggccgcagcaagggggagaagccagagatggagacagatgctgtgcagatggccaatgaggagctgcgggccaagctgaccagcatccagatcgagttccagcaggagaagagcaaggtgggcaagctgcgggagcggctgcaggaggccaagctggagcgggagcaggagcagaggaggcacacagcctacatcagcgagctgaaggccaagctgcacgaggagaagaccaaggagctgcaggccctgcgggagggcctcatccggcagcacgagcaggaggccgccaggacagccaagatcaaggagggggagctgcagaggctgcaggccaccctgaatgtgctgagagatggagctgctgacaaggtgaagacagccctgctgacagaggcccgggaggaggcccggcgggcctttgatggagagcggctgcggctgcagcaggagatcctggagctgaaggccgccaggaagcaggccgaggaggccctgagcaactgcatgcaggccgacaagaccaaggctgctgacctgcgggccgcctaccaggcccaccaggatgaggtgcaccgcatcaagcgggagtgtgagcgggacatccggcggctgatggatgagatcaagggcaaggacagagtcatcctggccctggagaaggagctgggcgtgcaggccggccagacccagaagctgctgctgcagaaggaggccctggatgagcagctggtgcaggtgaaggaggccgagcggcaccacagcagccccaagcgggagctgcccccaggcatcggggacatggtggagctgatgggcgtgcaggaccagcacatggatgaaagagatgtgcggcgcttccagctgaagattgctgagctgaacagcgtcatcaggaagctggaggacaggaacaccctgctggctgatgaaagaaatgagctgctgaagaggagccgggagacagaggtgcagctgaagcccctggtggagaagaacaagaggatgaacaagaagaatgaagacctgctgcagagcatccagaggatggaggagaagatcaagaacctgaccagagaaaatgtggagatgccagaccctgctggggcccacggggctgctgctgctggccctgctgagaaccccaggactggaggccagacaggagtgtctgaggccgcccctgagaggactggaggcaaggtgtttgtgcccttctttgtgttcctgaccagcatccacagcgtggccctgatgacctctgtgtcccaggagctgggcctgtag

SEQ ID NO: 34875 - DNA, 1710 bp, Artificial Sequence
  Description of Artificial Sequence: Synthetic coding sequence
atgagcaagaagggccgcagcaagggggagaagccagagatggagacagatgctgtgcagatggccaatgaggagctgcgggccaagctgaccagcatccagatcgagttccagcaggagaagagcaaggtgggcaagctgcgggagcggctgcaggaggccaagctggagcgggagcaggagcagaggaggcacacagcctacatcagcgagctgaaggccaagctgcacgaggagaagaccaaggagctgcaggccctgcgggagggcctcatccggcagcacgagcaggaggccgccaggacagccaagatcaaggagggggagctgcagaggctgcaggccaccctgaatgtgctgagagatggagctgctgacaaggtgaagacagccctgctgacagaggcccgggaggaggcccggcgggcctttgatggagagcggctgcggctgcagcaggagatcctggagctgaaggccgccaggaagcaggccgaggaggccctgagcaactgcatgcaggccgacaagaccaaggctgctgacctgcgggccgcctaccaggcccaccaggatgaggtgcaccgcatcaagcgggagtgtgagcgggacatccggcggctgatggatgagatcaagggcaaggacagagtcatcctggccctggagaaggagctgggcgtgcaggccggccagacccagaagctgctgctgcagaaggaggccctggatgagcagctggtgcaggtgaaggaggccgagcggcaccacagcagccccaagcgggagctgcccccaggcatcggggacatggtggagctgatgggcgtgcaggaccagcacatggatgaaagagatgtgcggcgcttccagctgaagattgctgagctgaacagcgtcatcaggaagctggaggacaggaacaccctgctggctgatgaaagaaatgagctgctgaagaggagccgggagacagaggtgcagctgaagcccctggtggagaagaacaagaggatgaacaagaagaatgaagacctgctgcagagcatccagaggatggaggagaagatcaagaacctgaccagagaaaatgtggagatgaaggagaagctgagcgcccaggccagcctgaagaggcacaccagcctgaatgacctgagcctgaccagagatgagcaggagattgagttcctgcggctgcaggtgctggagcagcagcacgtgattgatgacctgagcctggagcgggagcggctgctgcggagcaagaggcaccggggcaagagcctgaagccacccaagaagcacgtggtggagaccttcttcggctttgatgaggagagcgtggacagcgagaccctgtctgagaccagctacaacacagacagaacagacaggaccccagccaccccagaggaggacctggatgatgccacagcccgggaggaggccgacctgcgcttctgccagctgacccgggaggacctgcaggccgctgtggagaaggtgcggcggcagatcctgcggcagagccgggagtttgacagccagatcctgcgggagaggatggagctgctgcagcaggcccagcagaggatccgggagctggaggacaagctggagttccagaagaggcacctgaaggagctggaggagaagttcctgttcctgttcctgttcttcagcctggccttcatcctgtggccctag

SEQ ID NO: 34876 - DNA, 1557 bp, Artificial Sequence
  Description of Artificial Sequence: Synthetic coding sequence
atgagcaagaagggccgcagcaagggggagaagccagagatggagacagatgctgtgcagatggccaatgaggccctgcgggagggcctcatccggcagcacgagcaggaggccgccaggacagccaagatcaaggagatcctggagctgaaggccgccaggaagcaggccgaggaggccctgagcaactgcatgcaggccgacaagaccaaggctgctgacctgcgggccgcctaccaggcccaccaggatgaggtgcaccgcatcaagcgggagtgtgagcgggacatccggcggctgatggatgagatcaagggcaaggacagagtcatcctggccctggagaaggagctgggcgtgcaggccggccagacccagaagctgctgctgcagaaggaggccctggatgagcagctggtgcaggtgaaggaggccgagcggcaccacagcagccccaagcgggagctgcccccaggcatcggggacatggtggagctgatgggcgtgcaggaccagcacatggatgaaagagatgtgcggcgcttccagctgaagattgctgagctgaacagcgtcatcaggaagctggaggacaggaacaccctgctggctgatgaaagaaatgagctgctgaagaggagccgggagacagaggtgcagctgaagcccctggtggagaagaacaagaggatgaacaagaagaatgaagacctgctgcagagcatccagaggatggaggagaagatcaagaacctgaccagagaaaatgtggagatgaaggagaagctgagcgcccaggccagcctgaagaggcacaccagcctgaatgacctgagcctgaccagagatgagcaggagattgagttcctgcggctgcaggtgctggagcagcagcacgtgattgatgacctgagcctggagcgggagcggctgctgcggagcaagaggcaccggggcaagagcctgaagccacccaagaagcacgtggtggagaccttcttcggctttgatgaggagagcgtggacagcgagaccctgtctgagaccagctacaacacagacagaacagacaggaccccagccaccccagaggaggacctggatgatgccacagcccgggaggaggccgacctgcgcttctgccagctgacccgggagtaccaggccctgcagagggcctatgccctgctgcaggagcaggtgggcggcaccctggatgctgagcgggaggcccggacccgggagcagctgcaggccgacctgctgcgctgccaggccaagattgaggacctggagaagctgctggtggagaagggccaggacagcaagtgggtggaggagaagcagctgctgatccgcaccaaccaggacctgctggagaagatctaccgcctggagatggaggagaaccagctgaagaatgagatgcaggatgccaaggaccagaatgagctgctggagttccgggtgctggagctggaggtgcgggacagcatctgctgcaagctgagcaatggagctgacatcctgtttgagcccaagctgaagttcatgtag

SEQ ID NO: 34877 - DNA, 2433 bp, Artificial Sequence
  Description of Artificial Sequence: Synthetic coding sequence
atgagcaagaagggcaggaacaagggggagaagccagaggccctgattgtggccctgcaggccgccaatgaagacctgcggaccaagctgacagacatccagatcgagctgcaccaggagaagagcaaggtgtccaagctggagcgggagaagacccaggaggccaagaggatccgggagctggagcagaggaagcacacagtgctggtgacagagctgaaggccaagctgcacgaggagaagatgaaggagctgcaggccgtgcgggagaacctgatcaagcagcacgagcaggagatgagcaggacagtgaaggtgagagatggagagatccagaggctgaagagcgccctgtgtgccctgagagatggcagcagtgacaaggtgaggacagccctgaccatcgaggcccgggaggaggccaggaagctgtttgacacagagcggctgaagctgctgcaggagattgctgacctgaagacagccaagaagcaggtggatgaggccctgagcaacatgatccaggccgacaagatcaaggccggggacctgcggtctgagcaccagagccaccaggaggccatcagcaagatcaagtgggagagcgagcgggacatccggcggctgatggatgagatcaaggccaaggaccgcatcatcttcagcctggagaaggagctggagacccagacaggctacgtgcagaagctgcagctgcagaaggaggccctggatgagcagctgttcctggtgaaggaggccgagtgcaacatgagcagccccaagcgggagatccctggccgggctggagatggcagcgagcactgcagcagcccagacctgcggaggaaccagaagagaattgctgagctgaatgccaccatcaggaagctggaggacaggaacaccctgctgggagatgaaagaaatgagctgctgaagagggtgcgggagacagagaagcagtgcaagcccctgctggagaggaacaagtgcctggccaagagaaatgatgagctgatggtgtccctgcagaggatggaggagaagctgaaggctgtgaccaaggaaaattctgagatgagggagaagatcaccagccacccccccctgaagaagctgaagagcctgaatgacctggaccaggccaatgaggagcaggagacagagttcctgaagctgcaggtgattgagcagcagaacatcattgatgagctgacccgggaccgggagaagctgatcagaagaaggaagcaccggcgcagcagcaagcccatcaagaggcctgtgctggaccccttcatcggctatgatgaagattccatggacagcgagaccagctccatggccagcttcagaacagacaggaccccagccaccccagatgatgacctggatgagagcctggccgctgaggagagcgagctgcgcttccggcagctgaccaaggagtaccaggccctgcagagggcctatgccctgctgcaggagcagacaggaggcatcattgatgctgagcgggaggccaaggcccaggagcagctgcaggccgaggtgctgcgctacaaggccaagattgaggacctggaggccaccctggcccagaagggccaggacagccactgggtggaggacaagcagctgttcatcaagaggaaccaggagctgctggagaagattgagaagcaggaggccgagaaccaccggctgcagcaggagctgcaggatgcccgggaccagaatgagctgctggagttcaggaacctggagctggaggagcgggagcggcgcagcccccccttcaacctgcagatccaccccttcagtgatggagtgtctgccctgcagatctactgcatgaaggagggcgtgaaggatgtgaacatcccagacctgatcaagcagctggacatcctgggggacaatggaaacctgagaaatgaggagcaggtggccatcatccaggccagcacagtgctgagcctggccgagaagtggatccagcagatcgagggcgctgaggccgccctgcaccagaagatgatggagctggagagtgacatggagcagttctgcaagatcaagggctacctggaggaggagctggactacaggaagcaggccctggaccaggcctacatgaggatccaggagctggaggccaccctgtacaatgccctgcagcaggagaccgtcatcaagtttggagagctgctgtctgagaagcagcaggaggagctgaggacagctgtggagaagctgcggcggcagatgctgaggaagagccgggagtatgactgccagatcctgcaggagaggatggagctgctgcagcaggcccaccagaggatccgggacctggaggacaagacagacatccagaagaggcagatcaaggacctggaggagaagagcaacaggaagcatggatag

SEQ ID NO: 34878 - DNA, 2337 bp, Artificial Sequence
  Description of Artificial Sequence: Synthetic coding sequence
atggtgtccaagctggagcgggagaagacccaggaggccaagaggatccgggagctggagcagaggaagcacacagtgctggtgacagagctgaaggccaagctgcacgaggagaagatgaaggagctgcaggccgtgcgggagaacctgatcaagcagcacgagcaggagatgagcaggacagtgaaggtgagagatggagagatccagaggctgaagagcgccctgtgtgccctgagagatggcagcagtgacaaggtgaggacagccctgaccatcgaggcccgggaggaggccaggaagctgtttgacacagagcggctgaagctgctgcaggagattgctgacctgaagacagccaagaagcaggtggatgaggccctgagcaacatgatccaggccgacaagatcaaggccggggacctgcggtctgagcaccagagccaccaggaggccatcagcaagatcaagtgggagagcgagcgggacatccggcggctgatggatgagatcaaggccaaggaccgcatcatcttcagcctggagaaggagctggagacccagacaggctacgtgcagaagctgcagctgcagaaggaggccctggatgagcagctgttcctggtgaaggaggccgagtgcaacatgagcagccccaagcgggagatccctggccgggctggagatggcagcgagcactgcagcagcccagacctgcggaggaaccagaagagaattgctgagctgaatgccaccatcaggaagctggaggacaggaacaccctgctgggagatgaaagaaatgagctgctgaagagggtgcgggagacagagaagcagtgcaagcccctgctggagaggaacaagtgcctggccaagagaaatgatgagctgatggtgtccctgcagaggatggaggagaagctgaaggctgtgaccaaggaaaattctgagatgagggagaagatcaccagccacccccccctgaagaagctgaagagcctgaatgacctggaccaggccaatgaggagcaggagacagagttcctgaagctgcaggtgattgagcagcagaacatcattgatgagctgacccgggaccgggagaagctgatcagaagaaggaagcaccggcgcagcagcaagcccatcaagaggcctgtgctggaccccttcatcggctatgatgaagattccatggacagcgagaccagctccatggccagcttcagaacagacaggaccccagccaccccagatgatgacctggatgagagcctggccgctgaggagagcgagctgcgcttccggcagctgaccaaggagtaccaggccctgcagagggcctatgccctgctgcaggagcagacaggaggcatcattgatgctgagcgggaggccaaggcccaggagcagctgcaggccgaggtgctgcgctacaaggccaagattgaggacctggaggccaccctggcccagaagggccaggacagccactgggtggaggacaagcagctgttcatcaagaggaaccaggagctgctggagaagattgagaagcaggaggccgagaaccaccggctgcagcaggagctgcaggatgcccgggaccagaatgagctgctggagttcaggaacctggagctggaggagcgggagcggcgcagcccccccttcaacctgcagatccaccccttcagtgatggagtgtctgccctgcagatctactgcatgaaggagggcgtgaaggatgtgaacatcccagacctgatcaagcagctggacatcctgggggacaatggaaacctgagaaatgaggagcaggtggccatcatccaggccagcacagtgctgagcctggccgagaagtggatccagcagatcgagggcgctgaggccgccctgcaccagaagatgatggagctggagagtgacatggagcagttctgcaagatcaagggctacctggaggaggagctggactacaggaagcaggccctggaccaggcctacatgaggatccaggagctggaggccaccctgtacaatgccctgcagcaggagaccgtcatcaagtttggagagctgctgtctgagaagcagcaggaggagctgaggacagctgtggagaagctgcggcggcagatgctgaggaagagccgggagtatgactgccagatcctgcaggagaggatggagctgctgcagcaggcccaccagaggatccgggacctggaggacaagacagacatccagaagaggcagatcaaggacctggaggagaagttcctgttcctgttcctgttcttcagcctggccttcatcctgtggccctag

SEQ ID NO: 34879 - DNA, 2400 bp, Artificial Sequence
  Description of Artificial Sequence: Synthetic coding sequence
atgagcaagaagggcaggaacaagggggagaagccagaggccctgattgtggccctgcaggccgccaatgaagacctgcggaccaagctgacagacatccagatcgagctgcaccaggagaagagcaaggtgtccaagctggagcgggagaagacccaggaggccaagaggatccgggagctggagcagaggaagcacacagtgctggtgacagagctgaaggccaagctgcacgaggagaagatgaaggagctgcaggccgtgcgggagaacctgatcaagcagcacgagcaggagatgagcaggacagtgaaggtgagagatggagagatccagaggctgaagagcgccctgtgtgccctgagagatggcagcagtgacaaggtgaggacagccctgaccatcgaggcccgggaggaggccaggaagctgtttgacacagagcggctgaagctgctgcaggagattgctgacctgaagacagccaagaagcaggtggatgaggccctgagcaacatgatccaggccgacaagatcaaggccggggacctgcggtctgagcaccagagccaccaggaggccatcagcaagatcaagtgggagagcgagcgggacatccggcggctgatggatgagatcaaggccaaggaccgcatcatcttcagcctggagaaggagctggagacccagacaggctacgtgcagaagctgcagctgcagaaggaggccctggatgagcagctgttcctggtgaaggaggccgagtgcaacatgagcagccccaagcgggagatccctggccgggctggagatggcagcgagcactgcagcagcccagacctgcggaggaaccagaagagaattgctgagctgaatgccaccatcaggaagctggaggacaggaacaccctgctgggagatgaaagaaatgagctgctgaagagggtgcgggagacagagaagcagtgcaagcccctgctggagaggaacaagtgcctggccaagagaaatgatgagctgatggtgtccctgcagaggatggaggagaagctgaaggctgtgaccaaggaaaattctgagatgagggagaagatcaccagccacccccccctgaagaagctgaagagcctgaatgacctggaccaggccaatgaggagcaggagacagagttcctgaagctgcaggtgattgagcagcagaacatcattgatgagctgacccgggaccgggagaagctgatcagaagaaggaagcaccggcgcagcagcaagcccatcaagaggcctgtgctggaccccttcatcggctatgatgaagattccatggacagcgagaccagctccatggccagcttcagaacagacaggaccccagccaccccagatgatgacctggatgagagcctggccgctgaggagagcgagctgcgcttccggcagctgaccaaggagtaccaggccctgcagagggcctatgccctgctgcaggagcagacaggaggcatcattgatgctgagcgggaggccaaggcccaggagcagctgcaggccgaggtgctgcgctacaaggccaagattgaggacctggaggccaccctggcccagaagggccagatcgagaagcaggaggccgagaaccaccggctgcagcaggagctgcaggatgcccgggaccagaatgagctgctggagttcaggaacctggagctggaggagcgggagaggaggagcccccccttcaacctgcagatccaccccttcagtgatggagtgtctgccctgcagatctactgcatgaaggagggcgtgaaggatgtgaacatcccagacctgatcaagcagctggacatcctgggggacaatggaaacctgagaaatgaggagcaggtggccatcatccaggccagcacagtgctgagcctggccgagaagtggatccagcagattgaaggagctgaggccgccctgcaccagaagatgatggagctggagagtgacatggagcagttctgcaagatcaagggctacctggaggaggagctggactacaggaagcaggccctggaccaggcctacatgaggatccaggagctggaggccaccctgtacaatgccctgcagcaggagaccgtcatcaagtttggagagctgctgtctgagaagcagcaggaggagctgaggacagctgtggagaagctgcggcggcagatgctgaggaagagccgggagtatgactgccagatcctgcaggagaggatggagctgctgcagcaggcccaccagaggatccgggacctggaggacaagacagacatccagaagaggcagatcaaggacctggaggagaagttcctgttcctgttcctgttcttcagcctggccttcatcctgtggccctag

SEQ ID NO: 34880 - DNA, 2370 bp, Artificial Sequence
  Description of Artificial Sequence: Synthetic coding sequence
atgagcaagaagggcaggaacaagggggagaagccagaggccctgattgtggccctgcaggccgccaatgaagacctgcggaccaagctgacagacatccagatcgagctgcaccaggagaagagcaaggtgtccaagctggagcgggagaagacccaggaggccaagaggatccgggagctggagcagaggaagcacacagtgctggtgacagagctgaaggccaagctgcacgaggagaagatgaaggagctgcaggccgtgcgggagaacctgatcaagcagcacgagcaggagatgagcaggacagtgaaggtgagagatggagagatccagaggctgaagagcgccctgtgtgccctgagagatggcagcagtgacaaggtgaggacagccctgaccatcgaggcccgggaggaggccaggaagctgtttgacacagagcggctgaagctgctgcaggagattgctgacctgaagacagccaagaagcaggtggatgaggccctgagcaacatgatccaggccgacaagatcaaggccggggacctgcggtctgagcaccagagccaccaggaggccatcagcaagatcaagtgggagagcgagcgggacatccggcggctgatggatgagatcaaggccaaggaccgcatcatcttcagcctggagaaggagctggagacccagacaggctacgtgcagaagctgcagctgcagaaggaggccctggatgagcagctgttcctggtgaaggaggccgagtgcaacatgagcagccccaagcgggagatccctggccgggctggagatggcagcgagcactgcagcagcccagacctgcggaggaaccagaagagaattgctgagctgaatgccaccatcaggaagctggaggacaggaacaccctgctgggagatgaaagaaatgagctgctgaagagggtgcgggagacagagaagcagtgcaagcccctgctggagaggaacaagtgcctggccaagagaaatgatgagctgatggtgtccctgcagaggatggaggagaagctgaaggctgtgaccaaggaaaattctgagatgagggagaagatcaccagccacccccccctgaagaagctgaagagcctgaatgacctggaccaggccaatgaggagcaggagacagagttcctgaagctgcaggtgattgagcagcagaacatcattgatgagctgacccgggaccgggagaagctgatcagaagaaggaagcaccggcgcagcagcaagcccatcaagaggcctgtgctggaccccttcatcggctatgatgaagattccatggacagcgagaccagctccatggccagcttcagaacagacaggaccccagccaccccagatgatgacctggatgagagcctggccgctgaggagagcgagctgcgcttccggcagctgaccaaggagtaccaggccctgcagagggcctatgccctgctgcaggagcagacaggaggcatcattgatgctgagcgggaggccaaggcccaggagcagctgcaggccgaggtgctgcgctacaaggccaagattgaggacctggaggccaccctggcccagaagggccagatcgagaagcaggaggccgagaaccaccggctgcagcaggagctgcaggatgcccgggaccagaatgagctgctggagttcaggaacctggagctggaggagcgggagaggaggagcccccccttcaacctgcagatccaccccttcagtgatggagtgtctgccctgcagatctactgcatgaaggagggcgtgaaggatgtgaacatcccagacctgatcaagcagctggacatcctgggggacaatggaaacctgagaaatgaggagcaggtggccatcatccaggccagcacagtgctgagcctggccgagaagtggatccagcagattgaaggagctgaggccgccctgcaccagaagatgatggagctggagagtgacatggagcagttctgcaagatcaagggctacctggaggaggagctggactacaggaagcaggccctggaccaggcctacatgaggatccaggagctggaggccaccctgtacaatgccctgcagcaggagaccgtcatcaagtttggagagctgctgtctgagaagcagcaggaggagctgaggacagctgtggagaagctgcggcggcagatgctgaggaagagccgggagtatgactgccagatcctgcaggagaggatggagctgctgcagcaggcccaccagaggatccgggacctggaggacaagacagacatccagaagaggcagatcaaggacctggaggagaagagcaacaggatgcctgcctag

SEQ ID NO: 34881 - DNA, 2535 bp, Artificial Sequence
  Description of Artificial Sequence: Synthetic coding sequence
atgagcaagaggggcatgagcagccgggccaagggggacaaggccgaggccctggccgccctgcaggccgccaatgaagacctgcgggccaagctgacagacatccagatcgagctgcagcaggagaagagcaaggtgtccaaggtggagcgggagaagaaccaggagctgcggcaggtgcgggagcacgagcagcacaagacagctgtgctgctgacagagctgaagaccaagctgcacgaggagaagatgaaggagctgcaggccgtgcgggagaccctgctgcggcagcacgaggccgagctgctgcgggtcatcaagatcaaggacaatgaaaaccagaggctgcaggccctgctgagcgccctgagagatggcggccctgagaaggtgaagacagtgctgctgtctgaggccaaggaggaggccaagaagggctttgaggtggagaaggtgaagatgcagcaggagatcagcgagctgaagggggccaagaggcaggtggaggaggccctgaccctggtgatccaggccgacaagatcaaggctgctgagatccgctctgtgtaccacctgcaccaggaggagatcacccgcatcaagaaggaatgtgagcgggagatccggcggctgatggaggagatcaagttcaaggacagagctgtgtttgtgctggagcgggagctgggcgtgcaggccggccacgcccagaggctgcagctgcagaaggaggccctggatgagcagctgagccaggtgcgggaggccgacagacaccctggcagcccccggcgggagctgccccacgccgccggggctggagatgccagtgaccacagcggcagccctgagcagcagctggatgagaaggatgcccggcgcttccagctgaagattgctgagctgagcgccatcatcaggaagctggaggacagaaatgccctgctgtctgaggagagaaatgagctgctgaagagggtgcgggaggccgagagccagtacaagcccctgctggacaagaacaagaggctgagcaggaagaatgaagacctgagccacgccctgcggaggatggagaacaagctgaagtttgtgacccaggagaacatcgagatgaggcagagagctggcatcatccggcggcccagcagcctgaatgacctggaccagagccaggatgagcgggaggtggacttcctgaagctgcagatcgtggagcagcagaacctgattgatgagctgagcaagaccctggagacagctggctacgtgaagtctgtgctggagcgggacaagctgctgcgcttcaggaagcagaggaagaagatggccaagctgcccaagcctgtggtggtggagaccttcttcggctatgatgaggaggccagcctggagagtgatggcagctctgtgtcctaccagacagacagaacagaccagaccccctgcaccccagatgatgacctggaggagggcatggccaaggaggagacagagctgcgcttccggcagctgaccatggagtaccaggccctgcagagggcctatgccctgctgcaggagcaggtgggcggcaccctggatgctgagcgggaggtgaagacccgggagcagctgcaggccgaggtgcagagggcccaggccagaattgaggacctggagaaggccctggccgagcagggccaggacatgaagtggattgaggagaagcaggccctgtacagaagaaaccaggagctggtggagaagatcaagcagatggagacagaggaggcccggctgcggcatgaggtgcaggatgcccgggaccagaatgagctgctggagttccgcatcctggagctggaggagcgggagaggaagagccctgccatctccttccaccacaccccatttgtggatggcaagagccccctgcaggtgtactgtgaggccgagggcgtgacagacatcgtggtggccgagctgatgaagaagctggacatcctgggggacaatgccaacctgaccaatgaggagcaggtggtggtgatccaggccaggacagtgctgaccctggccgagaagtggctgcagcagatcgaggagacagaagctgccctgcagaggaagatggtggacctggagagcgagaaggagctgttcagcaagcagaagggctacctggatgaggagctggactacaggaagcaggccctggaccaggccaacaagcacatcctggagctggaggccatgctgtatgatgccctgcagcaggaggccggggccaaggtggccgagctgctgtctgaggaggagcgggagaagctgaaggtggccgtggagcagtggaagaggcaggtgatgtctgagctgcgggagagagatgcccagatcctgcgggagaggatggagctgctgcagctggcccagcagaggatcaaggagctggaggagagaattgaggcccagaagaggcagatcaaggagctggaggagaagttcctgttcctgttcctgttcttcagcctggccttcatcctgtggagctag

SEQ ID NO: 34882 - DNA, 996 bp, Artificial Sequence
  Description of Artificial Sequence: Synthetic coding sequence
atgtccatgaccacccgggcctgggaggagctggatggcggcctgggcagctgccaggccctggaggaccacagcgccctggccgagacccaggaggaccgggccagcgccaccccccggctggccgacagcggctctgtgccccatgacagccaggtggccgagggccccagcgtggacacccggcccaagaagatggagaaggagcctgctgcccggggcaccccaggcaccgggaaggagcggctgaaggccggggccagccccaggtctgtgcctgccaggaagaaggcccagacagccccacccctgcagcccccacctcctcctccagccctgtctgaggagctgccctggggagacctgagcctgaacaagtgcctggtgctggccagcctggtggccctgctgggcagcgccttccagctgtgcagagatgctgtgcctggagaggccgccctgcaggcccgggtgcctgagccctgggtgccccccagcagcgccccccgggagcccagcagccccctgcccaagtttgaggcccaggccccacccagcgcccccccagcccccagggctgaggccgaggtgcggcccaagatccctggcagccgggaggccgcagaaaatgatgaggaggagcctggagaggccactggagaggccgtgagagaagatagagtgaccctggccgaccggggccccaaggagcggccccggcgggagggcaagcccaggaaggagaagcccaggaaggaggagcggcccaagaaggagcggcccaggaaggaggagcggcccagggctgcccgggagccccgggaggccctgccccagcgctgggagagccgggagggcggccaccggccctgggcccgggacagcagagatgctgagcccaggaagaagcaggcctgggtgagcccccggcggccagatgaggagcagaggcctggcagccggcagaagctgcgggccggcaagggccgggactag

SEQ ID NO: 34883 - DNA, 1887 bp, Artificial Sequence
  Description of Artificial Sequence: Synthetic coding sequence
atgagccctgggggcaagtttgattttgatgatggcggctgctacgtgggcggctgggaggccggccgggcccacggctatggagtgtgcaccggccctggggcccagggcgagtacagcggctgctgggcccacggctttgagagcctgggcgtcttcaccggccctgggggccacagctaccagggccactggcagcagggcaagcgggagggcctgggcgtggagaggaagagccgctggacctacagaggagagtggctgggcggcctgaagggccgctctggagtgtgggagagcgtgtctggcctgcgctatgccggcctgtggaaggatggcttccaggacggctacggcacagagacctacagtgatggcggcacctaccagggccagtggcaggccggcaagagacatggctatggagtgcggcagagcgtgccctaccaccaggccgccctgctgcggagccccaggaggaccagcctggacagcggccacagcgacccccccaccccacctccacccctgcccctgcctggagatgagggcggcagccctgccagcggcagcagaggaggctttgtgctggccggccctggagatgctgatggagccagcagcaggaagaggaccccagctgctgggggcttcttccgccgcagcctgctgctgagcggcctgcgggccggcggcagaagaagcagcctgggcagcaagaggggcagcctgcggtctgaggtgagcagcgaggtgggcagcactggacctcctggcagcgaggccagcggccccccagctgctgcccccccagccctgattgagggcagcgccacagaggtgtatgctggggagtggagggctgaccggcgcagcggcttcggcgtgtcccagaggagcaatggcctgcgctatgaaggagagtggctgggcaacagaagacatggctacggccgcaccaccaggccagatggcagccgggaggagggcaagtacaagaggaaccggctggtgcatggaggccgggtgcgcagcctgctgcccctggccctgcggcggggcaaggtgaaggagaaggtggacagagctgtggagggcgcccggcgggctgtgtctgctgcccggcagaggcaggagattgctgctgcccgggcagcagatgccctgctgaaggctgtggccgccagctctgtggccgagaaggctgtggaggccgccaggatggccaagctgattgcccaggacctgcagcccatgctggaggcccctggaagaagaccccggcaggacagcgagggcagtgacacagagcccctggatgaggacagccctggggtgtatgaaaatggcctgacccccagcgagggcagccctgagctgcccagcagccctgccagcagccggcagccctggaggcccccagcctgccgcagccccctgcccccaggaggagaccagggccccttcagcagccccaaggcctggccagaggagtggggcggggccggggcccaggccgaggagctggccggctatgaagcagaagatgaggccggcatgcagggccctggccccagagatggcagccccctgctgggcggctgcagcgacagcagcggcagcctgcgggaggaggagggggaggatgaggagcccctgccccccctgcgggccccagctggaacagagcctgagcccatcgccatgctggtgctgcggggcagcagcagccggggcccagatgctggctgcctgacagaggagctgggggagcctgctgccacagagaggcctgcccagcctggagctgccaaccccctggtggtgggcgctgtggccctgctggacctgagcctggccttcctgttcagccagctgctgacctag

SEQ ID NO: 34884 - DNA, 1887 bp, Artificial Sequence; identical to SEQ ID NO: 34883
  Description of Artificial Sequence: Synthetic coding sequence

SEQ ID NO: 34885 - DNA, 1887 bp, Artificial Sequence; identical to SEQ ID NO: 34883
  Description of Artificial Sequence: Synthetic coding sequence

SEQ ID NO: 34886 - DNA, 1524 bp, Artificial Sequence
  Description of Artificial Sequence: Synthetic coding sequence
atgaggcggctgccccgggccctgctgctgcagctgcggctggccctgctggtggccgccggggcccctgaggtgctggtgtctgcccccaggagcctggtgtggggccctggcctgcaggccgctgtggtgctgcctgtgcgctacttctacctgcaggccgtgaacagcgagggccagaacctgaccaggagccctgctggggagacccccttcaaggtggtggtgaagagcctgagccccaaggagctggtgcgcatccacgtgcccaagcccctggacagaaatgatggcaccttcctgatgagatacaggatgtatgaaacagtggatgagggcctgaagattgaggtgctgtatggagatgagcacgtggcccagagcccctacatcctgaagggccctgtgtaccacgagtactgtgagtgcccagaggacccccaggcctggcagaagaccctgagctgccccaccaaggagccccagatcgccaaggactttgccagcttccccagcatcaacctgcagcagatgctgaaggaggtgcccaagagatttggagatgagcggggggccatcgtgcactacaccatcctgaacaaccacgtgtacagaagaagcctgggcaagtacacagacttcaagatgttcagtgatgagatcctgctgagcctgaccaggaaggtgctgctgcctgacctggagttctacgtgaacctgggggactggcccctggagcacaggaaggtgaatggcacccccagccccatccccatcatctcctggtgtggcagcctggacagcagagatgtggtgctgcccacctatgacatcacccacagcatgctggaggccatgaggggcgtgaccaatgacctgctgagcatccagggcaacacaggccccagctggatcaacaagacagagcgggccttcttccggggccgggacagccgggaggagcggctgcagctggtgcagctgagcaaagaaaacccccagctgctggatgctggcatcaccggctacttcttcttccaggagaaggagaaggagctgggcaaggccaagctgatgggcttctttgacttcttcaagtacaagtaccaggtgaatgtggatggcaccgtggccgcctaccgctacccctacctgatgctgggggacagcctggtgctgaagcaggacagcccctactatgagcacttctacatggccctggagccctggaagcactacgtgcccatcaagaggaacctgagtgacctgctggagaaggtgaagtgggccaaggaaaatgatgaggaggccaagaagatcgccaaggagggccagctgatggcccgggacctgctgcagccccaccggctgtactgctactactaccaggtgctgcagaagtatgcagagcggcagagcagcaagccagaggtgagagatggcatggagctggtgccccagcctgaggacagcacagccatctgccagtgccacaggaagaagcccagccgggaggagctgtag

SEQ ID NO: 34887 - DNA, 1230 bp, Artificial Sequence
  Description of Artificial Sequence: Synthetic coding sequence
atggtggagctgttcatcttcctgttcctgctgggggagacccccttcaaggtggtggtgaagagcctgagccccaaggagctggtgcgcatccacgtgcccaagcccctggacagaaatgatggcaccttcctgatgagatacaggatgtatgaaacagtggatgagggcctgaagattgaggtgctgtatggagatgagcacgtggcccagagcccctacatcctgaagggccctgtgtaccacgagtactgtgagtgcccagaggacccccaggcctggcagaagaccctgagctgccccaccaaggagccccagatcgccaaggactttgccagcttccccagcatcaacctgcagcagatgctgaaggaggtgcccaagagatttggagatgagcggggggccatcgtgcactacaccatcctgaacaaccacgtgtacagaagaagcctgggcaagtacacagacttcaagatgttcagtgatgagatcctgctgagcctgaccaggaaggtgctgctgcctgacctggagttctacgtgaacctgggggactggcccctggagcacaggaaggtgaatggcacccccagccccatccccatcatctcctggtgtggcagcctggacagcagagatgtggtgctgcccacctatgacatcacccacagcatgctggaggccatgaggggcgtgaccaatgacctgctgagcatccagggcaacacaggccccagctggatcaacaagacagagcgggccttcttccggggccgggacagccgggaggagcggctgcagctggtgcagctgagcaaagaaaacccccagctgctggatgctggcatcaccggctacttcttcttccaggagaaggagaaggagctgggcaaggccaagctgatgggcttctttgacttcttcaagtacaagtaccaggtgaatgtggatggcaccgtggccgcctaccgctacccctacctgatgctgggggacagcctggtgctgaagcaggacagcccctactatgagcacttctacatggccctggagccctggaagcactacgtgcccatcaagaggaacctgagtgacctgctggagaaggtgaagtgggccaagagcttcaccctgagcccccggctggagtgcagcggcaccatcagcacccactgcaacctgtgcctgcccggcagcaggaactttgtgccccagcccccagagtag

SEQ ID NO: 34888 - DNA, 1356 bp, Artificial Sequence
  Description of Artificial Sequence: Synthetic coding sequence
atggtggagctgttcatcttcctgttcctgctgggggagacccccttcaaggtggtggtgaagagcctgagccccaaggagctggtgcgcatccacgtgcccaagcccctggacagaaatgatggcaccttcctgatgagatacaggatgtatgaaacagtggatgagggcctgaagattgaggtgctgtatggagatgagcacgtggcccagagcccctacatcctgaagggccctgtgtaccacgagtactgtgagtgcccagaggacccccaggcctggcagaagaccctgagctgccccaccaaggagccccagatcgccaaggactttgccagcttccccagcatcaacctgcagcagatgctgaaggaggtgcccaagagatttggagatgagcggggggccatcgtgcactacaccatcctgaacaaccacgtgtacagaagaagcctgggcaagtacacagacttcaagatgttcagtgatgagatcctgctgagcctgaccaggaaggtgctgctgcctgacctggagttctacgtgaacctgggggactggcccctggagcacaggaaggtgaatggcacccccagccccatccccatcatctcctggtgtggcagcctggacagcagagatgtggtgctgcccacctatgacatcacccacagcatgctggaggccatgaggggcgtgaccaatgacctgctgagcatccagggcaacacaggccccagctggatcaacaagacagagcgggccttcttccggggccgggacagccgggaggagcggctgcagctggtgcagctgagcaaagaaaacccccagctgctggatgctggcatcaccggctacttcttcttccaggagaaggagaaggagctgggcaaggccaagctgatgggcttctttgacttcttcaagtacaagtaccaggtgaatgtggatggcaccgtggccgcctaccgctacccctacctgatgctgggggacagcctggtgctgaagcaggacagcccctactatgagcacttctacatggccctggagccctggaagcactacgtgcccatcaagaggaacctgagtgacctgctggagaaggtgaagtgggccaaggaaaatgatgaggaggccaagaagatcgccaaggagggccagctgatggcccgggacctgctgcagccccaccggctgtactgctactactaccaggtgctgcagaagtatgcagagcggcagagcagcaagccagaggtgagagatggcatggagctggtgccccagcctgaggacagcacagccatctgccagtgccacaggaagaagcccagccgggaggagctgtag

SEQ ID NO: 34889 - DNA, 639 bp, Artificial Sequence
  Description of Artificial Sequence: Synthetic coding sequence
atgaacctcttccgcttcctgggggacctgagccacctgctggccatcatcctgctgctgctgaagatctggaagagccgcagctgtgccggcatcagcggcaagagccaggtgctgtttgctgtggtgttcaccgcccgctacctggacctcttcaccaactacatcagcctgtacaacacctgcatgaaggtggtgtacatcgcctgcagcttcaccaccgtgtggctgatctacagcaagttcaaggccacctatgatggcaaccacgacaccttccgggtggagttcctggtggtgcccacagccatcctggccttcctggtgaaccacgacttcacccccctggagatcctgtggaccttcagcatctacctggagagcgtggccatcctgccccagctgttcatggtgtccaagacaggagaggccgagaccatcaccagccactacctgtttgccctgggcgtgtaccgcaccctgtacctgttcaactggatctggagataccactttgagggcttctttgacctgattgccatcgtggccggcctggtgcagacagtgctgtactgtgacttcttctacctgtacatcaccaaggtgctgaagggcaagaagctgagcctgcctgcctag

SEQ ID NO: 34890 - DNA, 639 bp, Artificial Sequence
  Description of Artificial Sequence: Synthetic coding sequence
atgaacatcttccggctgactggagacctgagccacctggccgccatcgtcatcctgctgctgaagatctggaagaccaggagctgtgccggcatcagcggcaagagccagctgctgtttgccctggtgttcaccacccgctacctggacctcttcaccagcttcatcagcctgtacaacacctccatgaaggtgatctacctggcctgcagctatgccaccgtgtacctgatctacctgaagttcaaggccacctatgatggcaaccacgacaccttccgggtggagttcctggtggtgcctgtgggcggcctgtccttcctggtgaaccacgacttcagccccctggagatcctgtggaccttcagcatctacctggagagcgtggccatcctgccccagctgttcatgatcagcaagacaggagaggccgagaccatcaccacccactacctgttcttcctgggcctgtaccgggccctgtacctggtgaactggatctggaggttctactttgagggcttctttgacctgattgctgtggtggccggcgtggtgcagaccatcctgtactgtgacttcttctacctgtacatcaccaaggtgctgaagggcaagaagctgagcctgcctgcctag

SEQ ID NO: 34891 - DNA, 561 bp, Artificial Sequence
  Description of Artificial Sequence: Synthetic coding sequence
atgaacatcttccggctgactggagacctgagccacctggccgccatcgtcatcctgctgctgaagatctggaagaccaggagctgtgccggcatcagcggcaagagccagctgctgtttgccctggtgttcaccacccgctacctggacctcttcaccagcttcatcagcctgtacaacacctccatgaaggtgatctacctggcctgcagctatgccaccgtgtacctgatctacctgaagttcaaggccacctatgatggcaaccacgacaccttccgggtggagttcctggtggtgcctgtgggcggcctgtccttcctggtgaaccacgacttcagccccctggagtacagccgggagaggagctctgtgtgccagcacaagtgccagaggcccagccctgcctctgtgctgcagggcgccaggacagagttcctgccccagcagaggcacaagatgctggacacagagaaccagaagctgaacagctttgtggccgacagccaccagtggctgtgcaagaatgctgaggagaagagccagaaggtgtctgtgtag

SEQ ID NO: 34892 - DNA, 543 bp, Artificial Sequence
  Description of Artificial Sequence: Synthetic coding sequence
atgtctgtgctgcggcccctggacaagctgcccggcctgaacacagccaccatcctgctggtgggcacagaagatgccctgctgcagcagctggccgacagcatgctgaaggaggactgtgccagcgagctgaaggtgcacctggccaagagcctgcccctgcccagctctgtgaaccggcccagaattgacctgattgtgtttgtggtgaacctgcacagcaagtacagcctgcagaacacagaggagagcctgcggcacgtggatgccagcttcttcctgggcaaggtgtgcttcctggccaccggggccggccgggagagccactgcagcatccaccgccacacagtggtgaagctggcccacacctaccagagccccctgctgtactgtgacctggaggtggagggcttccgggccaccatggcccagaggctggtgcgggtgctgcagatctgtgccggccacgtgcctggggtgtctgccctgaacctgctgagcctgctgcggagcagcgagggccccagcctggaggacctgtag

SEQ ID NO: 34893 - DNA, 663 bp, Artificial Sequence
  Description of Artificial Sequence: Synthetic coding sequence
atgaatgtgttccgcatcctgggggacctgagccacctgctggccatgatcctgctgctgggcaagatctggaggagcaagtgctgcaagggcatcagcggcaagagccagatcctgtttgccctggtgttcaccacccgctacctggacctcttcaccaacttcatcagcatctacaacacagtgatgaaggtggtgttcctgctgtgtgcctacgtgacagtgtacatgatctacggcaagttcaggaagacctttgacagtgaaaatgacaccttccggctggagttcctgctggtgcctgtgattggcctgtccttcctggagaactacagcttcaccctgctggagatcctgtggaccttcagcatctacctggagagcgtggccatcctgccccagctgttcatgatcagcaagacaggagaggccgagaccatcaccacccactacctgttcttcctgggcctgtaccgggccctgtacctggccaactggatccgccgctaccagacagagaacttctatgaccagattgctgtggtgtctggagtggtgcagaccatcttctactgtgacttcttctacctgtatgtgaccaagggccgctcctgggatgacagcaatgctgacaccggcctgcggagctacagcagcatctag

SEQ ID NO: 34894 - DNA, 2334 bp, Artificial Sequence
  Description of Artificial Sequence: Synthetic coding sequence
atgttccccagaggagctgaggcccaggactggcacctggacatgcagctgaccgggaaggtggtgctgtctgctgctgccctgctgctggtgacagtggcctaccgcctgtacaagagcaggcctgccccagcccagcgctggggcggcaatggccaggccgaggccaaggaggaggccgagggcagcggccagcctgctgtgcaggaggccagccctggggtgctgctgcggggccccaggagaagaagaagcagcaagagagctgaggccccccagggctgcagctgtgagaacccccggggcccctacgtgctggtgactggagccaccagcacagacaggaagccccagaggaagggcagcggggaggagcggggcggccagggcagtgacagcgagcaggtgcccccctgctgccccagccaggagaccaggacagctgtgggcagcaacccagaccccccccacttcccccggctgggcagcgagcccaagagcagccctgctggcctgattgctgctgctgatggcagctgtgccggcggggagcccagcccctggcaggacagcaagccccgggagcaccctggcctgggccagctggagcccccccactgccactacgtggcccccctgcagggcagcagtgacatgaaccagagctgggtgttcaccagggtgattggagtgtcccgggaggaggccggggccctggaggccgccagtgatgtggacctgaccctgcaccagcaggagggcgcccccaacagcagctacaccttcagcagcatcgcccgggtgaggatggaggagcacttcatccagaaggccgagggcgtggagccccggctgaagggcaaggtgtatgactactacgtggagagcaccagccaggccatcttccagggccgcctggcccccaggacagctgccctgacagaggtgcccagccccaggcctcctcctggcagcctgggcaccggggccgccagcggcggccaggccggggacaccaagggagctgctgagcgggccgccagcccccagacaggcccctggcccagcacccggggcttcagcaggaaggagagcctgctgcagattgctgaaaatcctgagctgcagctgcagccagatggcttccggctgcctgccccaccctgcccagaccccggggccctgcccggcctgggccgcagcagccgggagccccacgtgcagcctgtggccggcaccaacttcttccacatccccctgaccccagccagcgccccccaggtgcggctggacctgggcaactgctatgaggtgctgaccctggccaagaggcagaacctggaggccctgaaggaggccgcctacaaggtgatgtctgagaactacctgcaggtgctgcggagcccagacatctacggctgcctgagcggggctgagcgggagctgatcctgcagaggcggctgcggggccggcagtacctggtggtggctgatgtgtgccccaaggaggacagcggcggcctgtgctgctatgatgatgagcaggatgtgtggaggcccctggccaggatgcctcctgaggccgtgtcccggggctgtgccatctgcagcctcttcaactacctgtttgtggtgtctggctgccagggccctggccaccagcccagcagcagggtcttctgctacaaccccctgaccggcatctggagcgaggtgtgccccctgaaccaggcccggccccactgccgcctggtggccctggatggccacctgtatgccatcggaggagaatgtctgaacagcgtggagagatatgacccccggctggaccgctgggactttgccccacccctgcccagcgacacctttgccctggcccacacagccaccgtgcgggccaaggagatctttgtgactggaggcagcctgcgcttcctgctcttccgcttcagcgcccaggagcagcgctggtgggccggccccaccggcggcagcaaggacagaacagctgagatggtggccgtgaatggcttcctgtacagatttgacctgaacagaagcctgggcattgctgtgtaccgctgcagcgccagcacccggctgtggtatgaatgtgccacctaccgcaccccctacccagatgccttccagtgtgctgtggtggacaacctgatctactgtgtgggccgccgcagcaccctgtgcttcctggccgacagcgtgagccccaggtttgtgcccaaggagctgcggagcttccctgccccccagggcaccctgctgcccaccgtgctgaccctgcccaccccagacctgccccagaccagggtgtag

SEQ ID NO: 34895 - DNA, 2088 bp, Artificial Sequence
  Description of Artificial Sequence: Synthetic coding sequence
ggccagcctgctgtgcaggaggccagccctggggtgctgctgcggggccccaggagaagaagaagcagcaagagagctgaggccccccagggctgcagctgtgagaacccccggggcccctacgtgctggtgactggagccaccagcacagacaggaagccccagaggaaaggaagtggagaggagcggggcggccagggcagtgacagcgagcaggtgcccccctgctgccccagccaggagaccaggacagctgtgggcagcaacccagaccccccccacttcccccggctgggcagcgagcccaagagcagccctgctggcctgattgctgctgctgatggcagctgtgccggcggggagcccagcccctggcaggacagcaagccccgggagcaccctggcctgggccagctggagcccccccactgccactacgtggcccccctgcagggcagcagtgacatgaaccagagctgggtgttcaccagggtcatcggcgtgtcccgggaggaggccggggccctggaggccgccagtgatgtggacctgaccctgcaccagcaggagggcgcccccaacagcagctacaccttcagcagcatcgcccgggtgaggatggaggagcacttcatccagaaggccgagggcgtggagccccggctgaagggcaaggtgtatgactactacgtggagagcaccagccaggccatcttccagggccgcctggcccccaggacagctgccctgacagaggtgcccagcccccggcccccacctggcagcctgggcactggagctgccagcggcggccaggccggggacaccaagggagctgctgagagagctgccagcccccagacaggcccctggcccagcacccggggcttcagcaggaaggagagcctgctgcagattgctgagaaccctgagctgcagctgcagccagatggcttccggctgcctgccccaccctgcccagaccccggggccctgcccggcctgggccgcagcagccgggagccccacgtgcagcctgtggccggcaccaacttcttccacatccccctgaccccagccagcgccccccaggtgcggctggacctgggcaactgctatgaggtgctgaccctggccaagaggcagaacctggaggccctgaaggaggccgcctacaaggtgatgtctgagaactacctgcaggtgctgcggagcccagacatctacggctgcctgtctggagctgagcgggagctgatcctgcagaggcggctgcggggccggcagtacctggtggtggctgatgtgtgccccaaggaggacagcggcggcctgtgctgctatgatgatgagcaggatgtgtggaggcccctggccaggatgcctcctgaggccgtgtcccggggctgtgccatctgcagcctcttcaactacctgtttgtggtgtctggctgccagggccctggccaccagcccagcagcagggtcttctgctacaaccccctgaccggcatctggagcgaggtgtgccccctgaaccaggcccggccccactgccgcctggtggccctggatggccacctgtatgccatcggcggggagtgcctgaacagcgtggagagatatgacccccggctggaccgctgggactttgccccacccctgcccagcgacacctttgccctggcccacacagccaccgtgcgggccaaggagatctttgtgactggaggcagcctgcgcttcctgctcttccgcttcagcgcccaggagcagcgctggtgggccggccccactggaggcagcaaggacagaacagctgagatggtggccgtgaatggcttcctgtacagatttgacctgaacagaagcctgggcattgctgtgtaccgctgcagcgccagcacccggctgtggtatgaatgtgccacctaccgcaccccctacccagatgccttccagtgtgctgtggtggacaacctgatctactgtgtgggcagaagaagcaccctgtgcttcctggccgacagcgtgagcccccgggaggccgccatcgtgcccagctacctgctggtggaggtgtgctag

SEQ ID NO: 34896 - DNA, 1929 bp, Artificial Sequence
  Description of Artificial Sequence: Synthetic coding sequence
atgcagcccaggtctgagaggcctgctggccgcacccagagccctgagcacggcagccctggccctggccctgaggcccctcctcctcctccaccccagcccccagcccctgaggccgagaggacccggccccggcaggcccggcctgctgcccccatggagggcgctgtgcagctgctgagccgggagggccacagcgtggcccacaacagcaagaggcactaccatgatgcctttgtggccatgagcaggatgaggcagaggggcctgctgtgtgacatcgtgctgcacgtggccgccaaggagatccgggcccacaaggtggtgctggccagctgcagcccctacttccacgccatgttcaccaatgagatgtctgagagccggcagacccacgtgaccctgcatgacatcgacccccaggccctggaccagctggtgcagtttgcctacacagctgagatcgtggtgggggagggcaatgtgcagaccctgctgcctgctgccagcctgctgcagctgaatggagtgagagatgcctgctgcaagttcctgctgagccagctggaccccagcaactgcctgggcatccggggctttgctgatgcccacagctgcagcgacctgctgaaggccgcccaccgctacgtgctgcagcactttgtggatgtggccaagacagaggagttcatgctgctgcccctgaagcaggtgctggagctggtgtccagtgacagcctgaatgtgcccagcgaggaggaggtgtacagagctgtgctgtcctgggtgaagcatgatgtggatgcccggcggcagcacgtgccccggctgatgaagtgtgtgcggctgcccctgctgagccgggacttcctgctgggccacgtggatgctgagagcctggtgcgccaccacccagactgcaaggacctgctgattgaggccctgaagttccacctgctgcctgagcagaggggcgtgctgggcaccagcaggacccggccccggcgctgtgagggcgccggccctgtgctgtttgctgtgggcggcggcagcctgtttgccatccacggggactgtgaggcctatgacaccaggacagaccgctggcacgtggtggcctccatgagcacccggcgggcccgggtgggcgtggccgctgtgggcaaccggctgtatgctgtgggcggctatgatggcaccagtgacctggccaccgtggagagctatgaccctgtgaccaacacctggcagcctgaggtgtccatgggcaccaggaggagctgcctgggcgtggccgccctgcacggcctgctgtacagcgctgggggctatgatggagccagctgcctgaacagcgctgagagatatgaccccctgaccggcacctggacctctgtggccgccatgagcaccaggagaagatatgtgcgggtggccaccctggatggcaacctgtatgctgtgggcggctatgacagcagcagccacctggccaccgtggagaagtatgagccccaggtgaatgtgtggagccctgtggcctccatgctgagcagaagaagcagcgctggggtggccgtgctggagggcgccctgtatgtggccggcggcaatgatggcaccagctgcctgaacagcgtggagcgctacagccccaaggccggggcctgggagagcgtggcccccatgaacatccgccgcagcacccatgacctggtggccatggatggctggctgtatgctgtgggcggcaatgatggcagcagcagcctgaacagcattgagaagtacaaccccaggaccaacaagtgggtggccgccagctgcatgttcaccaggaggagctctgtgggcgtggccgtgctggagctgctgaacttccccccacccagcagccccaccctgtctgtgagcagcaccagcctgtag

SEQ ID NO: 34897 - DNA, 1557 bp, Artificial Sequence
  Description of Artificial Sequence: Synthetic coding sequence
atgtctgagagccggcagacccacgtgaccctgcatgacatcgacccccaggccctggaccagctggtgcagtttgcctacacagctgagatcgtggtgggggagggcaatgtgcagaccctgctgcctgctgccagcctgctgcagctgaatggagtgagagatgcctgctgcaagttcctgctgagccagctggaccccagcaactgcctgggcatccggggctttgctgatgcccacagctgcagcgacctgctgaaggccgcccaccgctacgtgctgcagcactttgtggatgtggccaagacagaggagttcatgctgctgcccctgaagcaggtgctggagctggtgtccagtgacagcctgaatgtgcccagcgaggaggaggtgtacagagctgtgctgtcctgggtgaagcatgatgtggatgcccggcggcagcacgtgccccggctgatgaagtgtgtgcggctgcccctgctgagccgggacttcctgctgggccacgtggatgctgagagcctggtgcgccaccacccagactgcaaggacctgctgattgaggccctgaagttccacctgctgcctgagcagaggggcgtgctgggcaccagcaggacccggccccggcgctgtgagggcgccggccctgtgctgtttgctgtgggcggcggcagcctgtttgccatccacggggactgtgaggcctatgacaccaggacagaccgctggcacgtggtggcctccatgagcacccggcgggcccgggtgggcgtggccgctgtgggcaaccggctgtatgctgtgggcggctatgatggcaccagtgacctggccaccgtggagagctatgaccctgtgaccaacacctggcagcctgaggtgtccatgggcaccaggaggagctgcctgggcgtggccgccctgcacggcctgctgtacagcgctgggggctatgatggagccagctgcctgaacagcgctgagagatatgaccccctgaccggcacctggacctctgtggccgccatgagcaccaggagaagatatgtgcgggtggccaccctggatggcaacctgtatgctgtgggcggctatgacagcagcagccacctggccaccgtggagaagtatgagccccaggtgaatgtgtggagccctgtggcctccatgctgagcagaagaagcagcgctggggtggccgtgctggagggcgccctgtatgtggccggcggcaatgatggcaccagctgcctgaacagcgtggagcgctacagccccaaggccggggcctgggagagcgtggcccccatgaacatccgccgcagcacccatgacctggtggccatggatggctggctgtatgctgtgggcggcaatgatggcagcagcagcctgaacagcattgagaagtacaaccccaggaccaacaagtgggtggccgccagctgcatgttcaccaggaggagctctgtgggcgtggccgtgctggagctgctgaacttccccccacccagcagccccaccctgtctgtgagcagcaccagcctgtag

SEQ ID NO: 34898 - DNA, 678 bp, Artificial Sequence
  Description of Artificial Sequence: Synthetic coding sequence
atgaagtgtgtgcggctgcccctgctgagccgggacttcctgctgggccacgtggatgctgagagcctggtgcgccaccacccagactgcaaggacctgctgattgaggccctgaagttccacctgctgcctgagcagaggggcgtgctgggcaccagcaggacccggccccggcgctgtgagggcgccggccctgtgctgtttgctgtgggcggcggcagcctgtttgccatccatggagactgtgaggcctatgacaccaggacagaccgctggcacgtggtggcctccatgagcacccggcgggcccgggtgggcgtggccgctgtgggcaaccggctgtatgctgtgggcggctatgatggcaccagtgacctggccaccgtggagagctatgaccctgtgaccaacacctggcagcctgaggtgtccatgggcacccggcgcagctgcctgggcgtggccgccctgcacggcctgctgtacagcgctgggggctatgatggagccagctgcctgaacagcgctgagagatatgaccccctgaccggcacctggacctctgtggccgccatgagcacccggcggcgctacgtgcgggtggccaccctggatggcaacctgtatgctgtgggcggctatgacagcagcagccacctggccaccgtggagaagtag

SEQ ID NO: 34899 - DNA, 489 bp, Artificial Sequence
  Description of Artificial Sequence: Synthetic coding sequence
atgagaattgccaacagaacccgcttcagcagccccttcctggcccggggggccggctggacccacggccggggcatgatggtggtgggcaccggcaccagcctggccctgagcagcctgctgagcctgctgctgtttgctggcatgcagatgtacagccggcagctggccagcacagagtggctgaccatccagggcggcctgctgggcagcggcctgtttgtgttcagcctgacagccttcaacaacctggagaacctggtgtttgggaagggcttccaggccaagatcttccctgagatcctgctgtgcctgctgctggccctgtttgccagcggcctcatccaccgggtgtgtgtgaccacctgcttcatcttctccatggtgggcctgtactacatcaacaagatcagcagcaccctgtaccaggccgccgcccctgtgctgaccccagccaaggtgacaggcaagagcaagaagagaaattag

SEQ ID NO: 34900 - DNA, 723 bp, Artificial Sequence
  Description of Artificial Sequence: Synthetic coding sequence
atgaggcgctgcagcctgtgtgcctttgatgctgcccggggcccccggcggctgatgagggtgggcctggccctgatcctggtgggccacgtgaacctgctgctgggcgctgtgctgcacggcaccgtgctgcggcacgtggccaaccccagaggagctgtgaccccagagtacacagtggccaacgtcatctctgtgggcagcggcctgctgtctgtgtctgtgggcctggtggccctgctggccagcaggaacctgctgcggccccccctgcactgggtgctgctggccctggccctggtgaacctgctgctgtctgtggcctgcagcctgggcctgctgctggccgtgtccctgactgtggccaatggaggccggcggctgattgctgactgccaccctggcctgctggaccccctggtgcccctggatgagggccctggccacacagactgcccctttgaccccacccgcatctatgacacagccctggccctgtggatccccagcctgctgatgtctgctggggaggccgccctgagcggctactgctgcgtggccgccctgaccctgcggggcgtgggcccctgcaggaaggatggcctgcagggccagctggaggagatgacagagctggagagccccaagtgcaagaggcaggagaatgagcagctgctggaccagaaccaggagatccgggccagccagaggtcctgggtgtag

SEQ ID NO: 34901 - DNA, 669 bp, Artificial Sequence
  Description of Artificial Sequence: Synthetic coding sequence
atgagggtgggcctggccctgatcctggtgggccacgtgaacctgctgctgggcgctgtgctgcacggcaccgtgctgcggcacgtggccaaccccagaggagctgtgaccccagagtacacagtggccaacgtcatctctgtgggcagcggcctgctgtctgtgtctgtgggcctggtggccctgctggccagcaggaacctgctgcggccccccctgcactgggtgctgctggccctggccctggtgaacctgctgctgtctgtggcctgcagcctgggcctgctgctggccgtgtccctgactgtggccaatggaggccggcggctgattgctgactgccaccctggcctgctggaccccctggtgcccctggatgagggccctggccacacagactgcccctttgaccccacccgcatctatgacacagccctggccctgtggatccccagcctgctgatgtctgctggggaggccgccctgagcggctactgctgcgtggccgccctgaccctgcggggcgtgggcccctgcaggaaggatggcctgcagggccagctggaggagatgacagagctggagagccccaagtgcaagaggcaggagaatgagcagctgctggaccagaaccaggagatccgggccagccagaggtcctgggtgtag

SEQ ID NO: 34902 - DNA, 189 bp, Artificial Sequence
  Description of Artificial Sequence: Synthetic coding sequence
gccctgagcggctactgctgcgtggccgccctgaccctgcggggcgtgggcccctgcaggaaggatggcctgcagggccagctggaggagatgacagagctggagagccccaagtgcaagaggcaggagaatgagcagctgctggaccagaaccaggagatccgggccagccagaggtcctgggtgtag

SEQ ID NO: 34903 - DNA, 723 bp, Artificial Sequence; identical to SEQ ID NO: 34900
  Description of Artificial Sequence: Synthetic coding sequence

SEQ ID NO: 34904 - DNA, 2982 bp, Artificial Sequence
  Description of Artificial Sequence: Synthetic coding sequence
atggctgctgagtgggccagccgcttctggctgtgggccaccctgctgatcccagctgctgctgtgtatgaggaccaggtgggcaagtttgactggaggcagcagtatgtgggcaaggtgaagtttgccagcctggagttcagccctggcagcaagaagctggtggtggccacagagaagaatgtgattgctgccctgaacagcaggactggagagatcctgtggaggcatgtggacaagggcacagctgagggcgctgtggatgccatgctgctgcacggccaggacgtcatcaccgtgtccaatggaggccgcatcatgaggtcctgggagaccaacatcggcggcctgaactgggagatcaccctggacagcggcagcttccaggccctgggcctggtgggcctgcaggagagcgtgcgctacatcgctgtgctgaagaagaccaccctggccctgcaccacctgagcagcggccacctgaagtgggtggagcacctgcctgagagtgacagcatccactaccagatggtgtacagctatggcagcggcgtggtgtgggccctgggcgtggtgcccttcagccacgtgaacatcgtgaagttcaacgtggaggatggagaaattgtgcagcaggtgcgggtgtccaccccctggctgcagcacctgagcggggcctgtggggtggtggatgaagctgtgctggtgtgcccagaccccagcagccgcagcctgcagaccctggccctggagacagagtgggagctgcggcagatccccctgcagagcctggacctggagtttggcagcggcttccagccccgggtgctgcccacccagcccaaccctgtggatgccagccgggcccagttcttcctgcacctgagccccagccactacgccctgctgcagtaccactacggcaccctgagcctgctgaagaacttcccccagacagccctggtgtcctttgccaccactggagagaagacagtggccgctgtgatggcctgcagaaatgaggtgcagaagagcagcagcagtgaagatggctccatgggcagcttcagcgagaagagcagcagcaaggacagcctggcctgcttcaaccagacctacaccatcaacctgtacctggtggagaccggccggcggctgctggacaccaccatcaccttcagcctggagcagagcggcaccaggcctgagcggctgtacatccaggtgttcctgaagaaggatgacagcgtgggctaccgggccctggtgcagacagaggaccacctgctgctcttcctgcagcagctggccggcaaggtggtgctgtggagccgggaggagagcctggccgaggtggtgtgcctggagatggtggacctgcccctgactggagcccaggccgagctggagggggagtttgggaagaaggcagatggcctgctgggcatgttcctgaagaggctgagcagccagctgatcctgctgcaggcctggaccagccacctgtggaagatgttttatgatgccaggaagcccaggagccagatcaagaatgagatcaacatcgacaccctggccagagatgagttcaacctgcagaagatgatggtgatggtgacagccagcggcaagctgtttggcatcgagagcagcagcggcaccatcctgtggaagcagtacctgcccaacgtgaagccagacagcagcttcaagctgatggtgcagaggaccacagcccacttcccccaccccccccagtgcaccctgctggtgaaggacaaggagagcggcatgagcagcctgtatgtgttcaaccccatctttgggaagtggagccaggtggcccctcctgtgctgaagaggcccatcctgcagagcctgctgctgcctgtgatggaccaggactatgccaaggtgctgctgctgattgatgatgagtacaaggtgacagccttccctgccaccagaaatgtgctgcggcagctgcacgagctggcccccagcatcttcttctacctggtggatgctgagcagggccgcctgtgtggctaccgcctgaggaaggacctgaccacagagctgtcctgggagctgaccatccccccagaggtgcagagaattgtgaaggtgaagggcaagaggagcagcgagcacgtgcacagccagggccgggtgatgggagacagatctgtgctgtacaagagcctgaaccccaacctgctggccgtggtgacagagagcacagatgcccaccacgagaggaccttcatcggcatcttcctgattgatggagtgacaggccgcatcatccacagctctgtgcagaagaaggccaagggccctgtgcacatcgtgcacagcgagaactgggtggtgtaccagtactggaacaccaaggccaggagaaatgagttcaccgtgctggagctgtatgagggcacagagcagtacaatgccacagccttcagcagcctggaccggccccagctgccccaggtgctgcagcagagctacatcttccccagcagcatcagcgccatggaggccaccatcacagagcggggcatcaccagccgccacctgctgattggcctgcccagcggggccatcctgagcctgcccaaggccctgctggaccccaggaggcctgagatccccacagagcagagccgggaggagaacctgatcccctacagcccagatgtgcagatccacgccgagcgcttcatcaactacaaccagacagtgtccaggatgaggggcatctacacagcccccagcggcctggagagcacctgcctggtggtggcctacggcctggacatctaccagaccagggtgtaccccagcaagcagtttgatgtgctgaaggatgattatgactatgtgctgatcagctctgtgctgtttggcctggtgtttgccaccatgatcaccaagaggctggcccaggtgaagctgctgaacagagcctggaggtag

SEQ ID NO: 34905 - DNA, 4071 bp, Artificial Sequence
  Description of Artificial Sequence: Synthetic coding sequence
atggacctgaaggagaagcacctgggggagcccccatctgccctgggcctgagcaccaggaaggccctgtctgtgctgaaggagcagctggaggccgtgctggagggccacctgcgggagaggaagaagtgcctgacctggaaggaggtgtggaggagcagcttcctgcaccacagcaaccgctgcagctgcttccactggccaggggccagcctgatgctgctggccgtgctgctgctgctgggctgctgcggcggccagcctgctggcagcagaggagtgggcctggtgaatgccagcgccctcttcctgctgctgctgctgaacctggtgctgattggccggcaggaccggctgaagagaagagaggtggagcggcggctgcggggcatcatcgaccagatccaggatgccctgagagatggccgggagatccagtggcccagcgccatgtacccagacctgcacatgccctttgcccccagctggagcctgcactgggcctacagagatggccacctggtgaacctgcctgtgtccctgctggtggagggggacatcatcgccctgcggcccggccaggagagctttgccagcctgcggggcatcaaggatgatgagcacatcgtgctggagcccggggacctcttcccccccttcagccccccacccagccccagaggagaggtggagcggggcccccagagcccccagcagcacaggctcttccgggtgctggagacccctgtgattgacaacatccgctggtgcctggacatggccctgagcaggcctgtgacagccctggacaatgaacgcttcaccgtgcagagcgtgatgctgcactatgctgtgcctgtggtgctggccggcttcctgatcaccaatgccctgcgcttcatcttcagcgcccctggggtgacctcctggcagtacaccctgctgcagctgcaggtgaatggagtgctgcccatcctgcccctgctcttccctgtgctgtgggtgctggccacagcctgtggggaggcccgggtgctggcccagatgagcaaggccagccccagcagcctgctggccaagttcagcgaggacaccctgagcagctacacagaggccgtgagcagccaggagatgctgcgctgcatctggggccacttcctgcgggtgctgggcggcaccagccccaccctgagccacagcagcagcctgctgcacagcctgggctctgtgacagtgctgtgctgcgtggacaagcagggcatcctgtcctggcccaaccccagccctgagaccgtgctcttcttcagcggcaaggtggagcccccccacagcagccatgaggacctgacagatggcctgagcaccaggagcttctgccaccctgagccccatgaaagagatgccctgctggccggcagcctgaacaacaccctgcacctgagcaatgagcaggagcggggggactggccaggagaggcccccaagcccccagagccctacagccaccacaaggcccacggccgcagcaagcaccccagcggcagcaatgtgtccttcagccgggacacagaaggaggagaggaggagcccagcaagacccagcccggcatggagagtgacccctatgaagcagaagattttgtgtgtgactaccacctggagatgctgagcctgagccaggaccagcagaaccccagctgcatccagtttgatgacagcaactggcagctgcacctgaccagcctgaagcccctgggcctgaatgtgctgctgaacctgtgtgatgcctctgtgacagagcggctgtgccgcttcagtgaccacctgtgcaacatcgccctgcaggagagccacagcgctgtgctgcctgtgcacgtgccctggggcctgtgtgagctggcccggctgattggcttcacccctggggccaaggagctgttcaagcaggagaaccacctggccctgtaccgcctgcccagcgctgagaccatgaaggagaccagcctgggccgcctgagctgtgtgaccaagaggcggccccccctgagccacatgatcagcctcttcatcaaggacaccaccaccagcacagagcagatgctgagccatggaacagcagatgtggtgctggaggcctgcacagacttctgggatggagctgacatctaccccctgagcggcagtgacaggaagaaggtgctggacttctaccagagggcctgcctgagcggctactgcagcgcctttgcctacaagcccatgaactgtgccctgagcagccagctgaatggaaaatgtattgagctggtgcaggtgcccggccagagcagcatcttcaccatgtgtgagctgcccagcaccatccccatcaagcagaatgcccggcgcagctcctggagcagtgatgagggcattggagaggtgctggagaaggaggactgcatgcaggccctgagcggccagatcttcatgggcatggtgagcagccagtaccaggcccggctggacatcgtgcggctgattgatggcctggtgaatgcctgcatccgctttgtgtacttcagcctggaggatgagctgaagagcaaggtgtttgctgagaagatgggcctggagaccggctggaactgccacatcagcctgacccccaacggggacatgcctggcagcgagatcccccccagcagccccagccacgccggcagcctgcatgatgacctgaaccaggtgtccagagatgatgctgagggcctgctgctgatggaggaggagggccacagcgacctgatctccttccagcccacagacagcgacatccccagcttcctggaggacagcaacagagccaagctgccccggggcatccaccaggtgcggccccacctgcagaacatcgacaacgtgcccctgctggtgcccctcttcacagactgcaccccagagaccatgtgtgagatgatcaagatcatgcaggagtatggagaggtgacctgctgcctgggcagcagcgccaacctgaggaacagctgcctcttcctgcagagcgacatcagcatcgccctggaccccctgtaccccagccgctgctcctgggagaccttcggctacgccaccagcatctccatggcccaggccagtgatggcctgagccccctgcagctgagcggccagctgaacagcctgccctgcagcctgaccttccggcaggaggagaccatcagcatcatccggctgattgagcaggcccggcatgccacctacggcatcaggaagtgcttcctgttcctgctgcagtgccagctgaccctggtggtgatccagttcctgagctgcctggtgcagctgccccccctgctgagcaccacagacatcctgtggctgagctgcttctgctaccccctgctgagcatcagcctgctgggcaagccaccccacagcagcatcatgtccatggccaccgggaagaacctgcagagcatccccaagaagacccagcactacttcctgctgtgcttcctgctgaagttcagcctgaccatcagcagctgcctgatctgcttcggcttcaccctgcagagcttctgtgacagcagccgggacaggaacctgaccaactgcagctctgtgatgctgcccagcaatgatgaccgggccccagcctggtttgaagattttgccaacggcctgctgagcgcccagaagctgacagctgccctgattgtgctgcacacagtgttcatcagcatcacccacgtgcacaggaccaagcccctgtggaggaagagccccctgaccaacctgtggtgggccgtgacagtgcctgtggtgctgctgggccaggtggtgcagacagctgtggacctgcagctgtggacccaccgggacagccacgtgcacttcggcctggaggatgtgcccctgctgacctggctgctgggctgcctgagcctggtgctggtggtggtgaccaatgagatcgtgaagctgcacgagatccgggtgcgggtgcgctaccagaagaggcagaagctgcagtttgagaccaagctgggcatgaacagccccttctag

SEQ ID NO: 34906 - DNA, 912 bp, Artificial Sequence
  Description of Artificial Sequence: Synthetic coding sequence
atgtgccacggccgcatcgcccccaagagcacctctgtgtttgctgtggcctctgtgggccatggagtcttcctgcccctggtgatcctgtgcaccctgctgggagatggcctggcctctgtgtgccccctgcccccagagccagaaaatggaggctacatctgccacccccggccctgccgggaccccctgacagctggcagcgtcatcgagtacctgtgtgccgagggctacatgctgaagggggactacaagtacctgacctgcaagaatggagagtggaagccagccatggagatcagctgccgcctgaatgaagacaaggacacccacaccagcctgggcgtgcccaccctgagcatcgtggccagcacagccagctctgtggccctgatcctgctgctggtggtgctgtttgtgctgctgcagcccaagctgaagagcttccaccacagcagaagagaccagggcgtgtctggggaccaggtgtccatcatggtggatggagtgcaggtggccctgcccagctatgaggaggccgtgtatggcagcagcggccactgtgtgcccccagctgacccccgggtgcagatcgtgctgtctgagggcagcggccccagcggccgctctgtgccccgggagcagcagctgcctgaccagggcgcctgcagcagcgctggaggagaagatgaggcccctggccagagcggcctgtgtgaggcctggggcagccgggccagcgagaccgtgatggtgcaccaggccaccaccagctcctgggtggccggcagcggcaaccggcagctggcccacaaggagacagctgacagcgagaacagcgacatccagagcctgctgagcctgaccagcgaggagtacacagatgacatccccctgctgaaggaggcctag

SEQ ID NO: 34907 - DNA, 2472 bp, Artificial Sequence
  Description of Artificial Sequence: Synthetic coding sequence
atgttttatgtgattggaggcatcaccgtgtctgtggtggccttcttcttcaccatcaagttcctgtttgagctggccgcccgggtggtgtccttcctgcagaatgaagatcgggagcggcggggggacaggaccatctatgactatgtgcggggcaactacctggaccccaggagctgcaaggtgtcctgggactggaaggacccctatgaggtgggccacagcatggccttccgggtgcacctgttctacaagaatggccagcccttccctgcccacaggcctgtgggcctgcgggtgcacatcagccacgtggagctggccgtggagatccctgtgacccaggaggtgctgcaggagcccaacagcaatgtggtgaaggtggccttcaccgtgaggaaggccggccgctatgagatcaccgtgaagctgggcggcctgaatgtggcctacagcccctactacaagatcttccagcccggcatggtggtgcccagcaagaccaagatcgtgtgccacttcagcaccctggtgctgacctgtggccagccccacaccctgcagatcgtgcccagagatgaatatgacaaccccaccaacaacagcatgagcctgagagatgagcacaactacaccctgagcatccacgagctgggcccccaggaggaggagagcactggagtgtcctttgagaagtctgtgaccagcaaccggcagaccttccaggtgttcctgcggctgaccctgcacagccggggctgcttccacgcctgcatctcctaccagaaccagcccatcaacaacggggagtttgacatcatcgtgctgtctgaagatgagaagaacatcgtggagagaaatgtgtccaccagcggcgtgtccatctactttgaggcctacctgtacaatgccaccaactgcagcagcaccccctggcacctgccccccatgcacatgaccagcagccagaggcggcccagcacagctgtggatgaagaagatgaggacagccccagcgagtgccacaccccagagaaggtgaagaagcccaagaaggtgtactgctacgtgagccccaagcagttctctgtgaaggagttctacctgaagatcatcccctggaggctgtacaccttccgggtgtgccccggcaccaagttctcctacctgggccctgaccctgtgcacaagctgctgaccctggtggtggatgatggcatccagccccctgtggagctgagctgcaaggagaggaacatcctggccgccaccttcatccgcagcctgcacaagaacattggaggcagcgagaccttccaggacaaggtgaacttcttccagcgggagctgcggcaggtgcacatgaagaggccccacagcaaggtgaccctgaaggtgtccagacatgccctgctggagagcagcctgaaggccaccaggaacttcagcatcagtgactggagcaagaactttgaggtggtgttccaggatgaggaggccctggactggggcggcccccggcgggagtggtttgagctgatctgcaaggccctgtttgacaccaccaaccagctgttcacccgcttcagtgacaacaaccaggccctggtgcaccccaaccccaacagacctgcccacctgcggctgaagatgtatgaatttgctggccgcctggtgggcaagtgcctgtatgagagcagcctgggcggggcctacaagcagctggtgcgggcccgcttcaccaggagcttcctggcccagatcatcggcctgaggatgcactacaagtactttgaaacagatgatcctgagttctacaagagcaaggtgtgcttcatcctgaacaatgacatgtctgagatggagctggtgtttgctgaggagaagtacaacaagagcggccagctggacaaggtggtggagctgatgactggaggagcccagacccctgtgaccaatgccaacaagatcttctacctgaacctgctggcccagtaccgcctggccagccaggtgaaggaggaggtggagcacttcctgaagggcctgaatgagctggtgcctgagaacctgctggccatctttgatgaaaatgagctggagctgctgatgtgtggcactggagacatctctgtgtctgacttcaaggcccatgctgtggtggtgggcggctcctggcacttccgggagaaggtgatgcgctggttctggacagtggtgagcagcctgacccaggaggagctggcccggctgctgcagttcaccaccggcagcagccagctgcccccaggcggctttgctgccctgtgccccagcttccagatcatcgccgcccccacccacagcaccctgcccacagcccacacctgcttcaaccagctgtgcctgcccacctatgacagctatgaggaggtgcacaggatgctgcagctggccatcagcgagggctgtgagggcttcggcatgctgtag

SEQ ID NO: 34908 - DNA, 3150 bp, Artificial Sequence
  Description of Artificial Sequence: Synthetic coding sequence
atggagaagaggctgggcgtgaagcccaacccagcctcctggatcctgagcggctactactggcagaccagcgccaagtggctgcggagcctgtacctgttctacacctgcttctgcttctctgtgctgtggctgagcacagatgccagcgagagccgctgccagcagggcaagacccagtttggagtgggcctgcggtctggaggagagaaccacctgtggctgctggagggcacccccagcctgcagagctgctgggccgcctgctgccaggacagcgcctgccacgtgttctggtggctggagggcatgtgcatccaggccgactgcagccggccccagagctgccgggccttccgcacccacagcagcaacagcatgctggtgttcctgaagaagttccagacagcagatgacctgggcttcctgcctgaagatgatgtgccccacctgctgggcctgggctggaactgggcctcctggaggcagagccccccccgggccgccctgcggcctgctgtgagcagcagtgaccagcagagcctcatcaggaagctgcagaagaggggcagccccagtgatgtggtgacccccatcgtgacccagcacagcaaggtgaatgacagcaatgagctgggcggcctgaccaccagcggcagcgctgaggtgcacaaggccatcaccatcagcagccccctgaccacagacctgacagctgagctgagcggcggccccaagaatgtgtctgtgcagcctgagatcagcgagggcctggccaccacccccagcacccagcaggtgaagagcagcgagaagacccagattgctgtgccccagcctgtggcccccagctacagctatgccacccccaccccccaggccagcttccagagcaccagcgccccctaccctgtgatcaaggagctggtggtgtctgctggggagagcgtgcagatcaccctgcccaagaatgaggtgcagctgaatgcctacgtgctgcaggagccccccaagggggagacctacacctatgactggcagctgatcacccacccccgggactacagcggggagatggagggcaagcacagccagatcctgaagctgagcaagctgaccccaggcctgtatgagttcaaggtgattgtggagggccagaatgcccatggagagggctacgtgaatgtgacagtgaagccagagcccaggaagaacagaccacccatcgccatcgtgagcccccagttccaggagatcagcctgcccaccaccagcacagtgattgatggcagccagagcacagatgatgacaagatcgtgcagtaccactgggaggagctgaagggccccctgcgggaggagaagatcagcgaggacacagccatcctgaagctgagcaagctggtgcccggcaactacaccttcagcctgactgtggtggacagtgatggagccaccaacagcaccacagccaacctgactgtgaacaaggctgtggactacccacctgtggccaatgccggccccaaccaggtgatcaccctgccccagaacagcatcaccctgtttggaaaccagagcacagatgaccacggcatcaccagctatgagtggagcctgagccccagcagcaagggcaaggtggtggagatgcagggcgtgaggacccccaccctgcagctgagcgccatgcaggagggggactacacctaccagctgactgtgacagacaccatcggccagcaggccacagcccaggtgaccgtcatcgtgcagcctgagaacaacaagccaccccaggctgatgctggccctgacaaggagctgaccctgcctgtggacagcaccaccctggatggcagcaagagcagtgatgaccagaagatcatctcctacctgtgggagaagacccagggcccagatggagtgcagctggagaatgccaacagctctgtggccaccgtgacaggcctgcaggtgggcacctacgtgttcaccctgactgtgaaggatgaaagaaacctgcagagccagagctctgtgaatgtcatcgtgaaggaggagatcaacaagccacccatcgccaagatcactggaaatgtggtgatcaccctgcccaccagcacagctgagctggatggcagcaagagcagtgatgacaagggcatcgtgtcctacctgtggaccagagatgagggcagccctgctgctggggaggtgctgaaccacagcgaccaccaccccatcctcttcctgagcaacctggtggagggcacctacaccttccacctgaaggtgacagatgccaagggggagagtgacacagacaggaccaccgtggaggtgaagccagaccccaggaagaacaacctggtggagatcatcctggacatcaacgtgtcccagctgacagagcggctgaagggcatgttcatccggcagattggagtgctgctgggcgtgctggacagcgacatcatcgtgcagaagatccagccctacacagagcagagcaccaagatggtgttctttgtgcagaatgaaccaccccaccagatcttcaagggccacgaggtggccgccatgctgaagtctgagctgaggaagcagaaggctgacttcctgatcttccgggccctggaggtgaacacagtgacctgccagctgaactgcagcgaccacggccactgtgacagcttcaccaagcgctgcatctgtgaccccttctggatggagaacttcatcaaggtgcagctgagagatggagacagcaactgtgagtggagcgtgctgtatgtgatcatcgccaccttcgtcatcgtggtggccctgggcatcctgtcctggacagtcatctgctgctgcaagaggcagaagggcaagcccaagaggaagagcaagtacaagatcctggatgccacagaccaggagagcctggagctgaagcccaccagcagagctggcatcaagcagaagggcctgctgctgagcagcagcctgatgcacagcgagagcgagctggacagtgatgatgccatcttcacctggccagaccgggagaagggcaagctgctgcacggccagaatggatctgtgcccaacggccagacccccctgaaggcccggagcccccgggaggagatcctgtag

SEQ ID NO: 34909 - DNA, 4830 bp, Artificial Sequence
  Description of Artificial Sequence: Synthetic coding sequence
atggccggcctgcggcggccccagcccggctgctactgcaggacagctgctgctgtgaacctgctgctgggcgtcttccaggtgctgctgccctgctgcaggcctggaggagcccagggccaggccatcgagcccctgcccaacgtggtggagctgtggcaggccgaggagggggagctgctgctgcccacccagggcgacagcgaggagggcctggaggagcccagccaggagcagagcttcagtgacaagctgttcagcggcaagggcctgcacttccagcccagcgtgctggactttggcatccagttcctgggccaccctgtggccaagatcctgcacgcctacaaccccagccgggacagcgaggtggtggtgaacagcgtgtttgctgctgctggccacttccacgtgccccctgtgccctgcagggtcatcccagccatgggcaagaccagcttccgcatcatcttcctgcccacagaggagggcagcattgagagcagcctcttcatcaacaccagcagctatggagtgctgagctaccacgtgtctggaattggcacccggcgcatcagcacagagggcagcgccaagcagctgcccaatgcctacttcctgctgcccaaggtgcagagcatccagctgagccagatgcaggccgagaccaccaacaccagcctgctgcaggtgcagctggagtgcagcctgcacaacaaggtgtgccagcagctgaagggctgctacctggagagtgatgatgtgctgcggctgcagatgagcatcatggtgaccatggagaacttcagcaaggagtttgaggagaacacccagcacctgctggaccacctgagcatcgtgtatgtggccacagatgagagcgagaccagtgatgacagcgctgtgaacatgtacatcctgcacagcggcaacagcctcatctggatccaggacatccgccacttcagccagagagatgccctgagcctgcagtttgagcctgtgctgctgcccaccagcaccaccaacttcaccaagatcgccagcttcacctgcaaggccaccagctgtgacagcggcatcattgaagatgtgaagaagaccacccacacccccaccctgaaggcctgcctcttcagctctgtggcccagggctacttcaggatggacagcagcgccacccagttccacatcgagacccatgagaacaccagcggcctgtggagcatctggtacagaaaccactttgacagatctgtggtgctgaatgatgtgttcctgagcaaggagaccaagcacatgctgaagatcctgaacttcaccggccccctcttcctgcccccaggctgctggaacatcttcagcctgaagctggccgtgaaggacatcgccatcaacctcttcaccaacgtgttcctgaccaccaacattggagccatctttgccatccccctgcagatctacagcgcccccaccaaggagggcagcctgggctttgaagtcatcgcccactgcggcatgcactacttcatgggcaagagcaaggccggcaaccccaactggaatggcagcctgagcctggaccagagcacctggaatgtggacagcgagctggccaacaagctgtatgagcgctggaagaagtacaagaatggagatgtgtgcaagagaaatgtgctgggcaccaccaggtttgcccacctgaagaagagcaaggagagcgagagctttgtgttcttcctgccccggctgattgctgagcccggcctgatgctgaacttcagcgccacagccctgcggagcaggatgatcaagtactttgtggtgcagaaccccagctcctggcctgtgtccctgcagctgctgcccctgagcctgtaccccaagccagaggccctggtgcacctgctgcaccgctggtttggaacagacatgcagatgatcaacttcaccaccggggagttccagctgacagaggcctgcccctacctgggcacccacagcgaggagagcagatttggcatcctgcacctgcacctgcagcccctggagatgaagagggtgggcgtggtgttcaccccagctgactatggcaaggtgaccagcctcatcctgatccggaacaacctgactgtgattgacatgattggagtggagggctttggagcccgggagctgctgaaggtgggcggccgcctgcccggggccggcggcagcctgcgcttcaaggtgcctgagagcaccctgatggactgccggcggcagctgaaggacagcaagcagatcctgagcatcaccaagaacttcaaggtggagaacatcggccccctgcccatcaccgtgagcagcctgaagatcaatggctacaactgccagggctacggctttgaggtgctggactgccaccagttcagcctggaccccaacaccagccgggacatcagcatcgtgttcaccccagacttcaccagctcctgggtgatccgggacctgagcctggtgacagctgctgacctggagttccgcttcaccctgaatgtgaccctgccccaccacctgctgcccctgtgtgctgatgtggtgcccggccccagctgggaggagagcttctggaggctgaccgtcttctttgtgtccctgagcctgctgggcgtcatcctgattgccttccagcaggcccagtacatcctgatggagttcatgaagacccggcagaggcagaatgccagcagcagcagccagcagaacaacggccccatggatgtgatcagcccccacagctacaagagcaactgcaagaacttcctggacacctacggccccagcgacaagggccggggcaagaactgcctgcctgtgaacaccccccagagccgcatccagaatgctgccaagaggagccctgccacctacggccacagccagaagaagcacaagtgcagcgtgtactacagcaagcacaagaccagcacagctgctgccagcagcaccagcaccaccacagaggagaagcagaccagccccctgggcagcagcctgcctgctgccaaggaggacatctgcacagatgccatgagggagaactggatcagcctgcgctatgccagcggcatcaacgtgaacctgcagaagaacctgaccctgcccaagaacctgctgaacaaggaggagaacaccctgaagaacaccatcgtgttcagcaaccccagcagcgagtgcagcatgaaggagggcatccagacctgcatgttccccaaggagacagacatcaagaccagcgagaacacagctgagttcaaggagcgggagctgtgccccctgaagaccagcaagaagctgcctgagaaccacctgcccaggaacagcccccagtaccaccagcctgacctgcctgagatcagcaggaagaacaacggcaacaaccagcaggtgcctgtgaagaatgaggtggaccactgtgagaacctgaagaaggtggacaccaagcccagcagcgagaagaagatccacaagaccagccgggaggacatgttttctgagaagcaggacatcccctttgtggagcaggaggacccctacaggaagaagaagctgcaggagaagcgggagggcaacctgcagaacctgaactggagcaagagcaggacctgcaggaagaacaagaagaggggcgtggcccctgtgtccaggcctcctgagcagagcgacctgaagctggtgtgcagcgactttgagaggtctgagctgagcagtgacatcaacgtgcgctcctggtgcatccaggagagcacccgggaggtgtgcaaggcagatgctgagatcgccagcagcctgcctgctgcccagcgggaggccgagggctactaccagaagccagagaagaagtgtgtggacaagttctgcagcgacagcagcagtgactgtggcagcagcagcggctctgtgcgggccagccggggctcctggggctcctggagcagcaccagcagcagtgatggagacaagaagcccatggtggatgcccagcacttcctgcctgctggggacagcgtgtcccagaatgacttccccagcgaggcccccatcagcctgaacctgagccacaacatctgcaaccccatgacagtgaacagcctgccccagtatgcagagcccagctgccccagcctgcctgctggccccactggagtggaggaggacaagggcctgtacagccctggggacctgtggcccaccccacctgtgtgtgtgaccagcagcctgaactgcaccctggagaatggagtgccctgtgtgatccaggagagcgcccctgtgcacaacagcttcatcgactggagcgccacctgtgagggccagttcagcagcgcctactgccccctggagctgaatgactacaatgccttccctgaggagaacatgaactatgccaacggcttcccctgcccagcagatgtgcagacagacttcatcgaccacaacagccagagcacctggaacaccccacccaacatgcctgctgcctggggccacgccagcttcatcagcagccccccctacctgaccagcaccaggagcctgagccccatgagcggcctgtttggcagcatctgggccccccagagtgatgtgtatgagaactgctgccccatcaaccccaccacagagcacagcacccacatggagaaccaggccgtggtgtgcaaggagtactacccaggcttcaaccccttccgggcctacatgaacctggacatctggaccaccacagccaacagaaatgccaacttccccctgagccgggacagcagctactgtggaaatgtgtag

SEQ ID NO: 34910 - DNA, 4212 bp, Artificial Sequence
  Description of Artificial Sequence: Synthetic coding sequence
atggccaactgcagccaggaggagctggatgaggagtttgagcagttcatgaaggagctgagtgatgacagctttgagaacagcgacaagacagcccggcagagcaagaaggagatgaagaagaaggacacagtgccctggtggatcacagaagatgacttcaaggatgatggcctgctgggcaccaacgtgtcctacctgaagaccaagaagaccagccagcctgtgatggagattgaggaggagagcgctgagaagatccagttcctgaagagcagcggcaccagcctgctgagcacagacagcctggagaccaatgagctggtggtgtctgagctgaaccacagcagcctgggcgtgggcctggacaccctggaggagcaggaggagaaggagcagttctttgcccggctggagaagggcctgaccagcagcattgactacagccggctgaacaaggagctggacagcaatgacagcacccacttcaaggccctgcacagcaaccaggccaatgctgagctgacagatgatgaacatgaaaatgaaagcaagcatgaggagctggccgagaactacagtgatgactttgaagatgaatatgtgggcgcccccctgaccaccaaggatgaggagatgcccagcaaagaaaacagcaagtctgagaagatctctgtgcccaagcaggaggaggagaagacaggcatgctggccaacgtggtgctgctggacagcctggacagcgtggccgaggtgaacctggatgagcaggacaagatcacccccaagccccgctgcctgcctgagatgacagaaaatgagatgacaggcaccggggtgtcctatggccagagcagcagtgatgtggaggccctgcaccaggcctactgccacatcgcccacagcctgggagatgaggacaagcagaagattgagagcaacacagtggaggacatcaagagctctgtgaagggccacccccaggagaatgaggagaacagcaagaacatcagcaccatggagagtgacctgcccaccgtggaggagctgatgaagcccatcagaattgacagctttggcatcagcggctttgacctgcagcctgtgtcctctgagaaggtggccgagaggaaggagacagagttcttcagcagcctgcccctgaagatgaaccccaacatcctgagccaggacagccagcacgtgaacctcttctttgacaagaatgatgaaaatgtcatcctgcagaagaccaccaatgaatccatggagaacagctgcccccaggtgacagaggtgacagccacagaggagcacgtggacaagatgtacctgaacatcctgaggaagaagatcaccgtgaacagcagcagcctgagccaggatgacaagatcaacaagacctaccgcagccagctgagcagcgaggaggagggcgctgtgatgggcaagcaggtgccctacaagaaggcccggagcgccccacccctgctgaagaggaagccccagagcggcctgtatgcctctgtgcgcagcagcggctacggcaagcccagcagccccctgaagatgttcagcaccctggagaagaagaccagcgaggacatcatcaagagcaagaacctgcggagcatcagcaccagcaaccagcccaggaagaaggagatcctgagcggcaccaagctgatcaagccagctgccctggacaagccagcccacaagacagagagctgcctgagcaccaggaagaagtctgagaaccccacagaaacagacagctgcatccagttccagacagacagcctgggctactgtggggagaacaaggagaagaagctgctgatgttcaagagggtgcaggaggccgaggacaagtggaggggggcccaggccctgattgagcagatcaaggccaccttcagcgagaaggagaaggagctggagaacaagctggaggagctgaagaagcagcaggagaaggagctgttcaagctgaaccaggacaactacatcctgcaggccaagctgagcagctttgaggagaccaacaagaagcagcgctggctgcactttggagaggccgctgaccctgtgactggagagaagctgaagcagatccagaaggagatccaggagcaggagaccctgctgcagggctaccagcaggagaatgaaagactctacaaccaggtgaaggacctgcaggagcagaacaagaagaatgaggagaggatgttcaaggagaaccagagcctcttcagcgaggtggccagcctgaaggagcagatgcacaagagccgcttcctgagccaggtggtggaggacagcgagcccaccaggaaccagaacttcacagacctgctggccgagctgaggatggcccagaaggagaaggacagcctgctggaggacatcaagaggctgaagcaggacaagcaggccctggaggtggactttgagaagatgaagaaggagcgggaccaggccaaggaccagatcgcctacgtgactggagagaagctgtatgagatcaagatcctggaggagacccacaagcaggagatcagccggctgcagaagaggctgcagtggtatgcagagaaccaggagctgctggacaaggatgccctgcggctgcgggaggccaatgaggagattgagaagctgaagctggagattgagaagctgaaggccgagagcggcaaccccagcatccggcagaagatccggctgaaggacaaggccgcagatgccaagaagatccaggacctggagcggcaggtgaaggagatggagggcatcctgaagaggcgctaccccaacagcctgcctgccctgatcctggccgccagcgctgctggggacacagtggacaagaacacagtggagttcatggagaagaggatcaagaagctggaggccgacctggagggcaaggatgaagatgccaagaagagcctgcggaccatggagcagcagttccagaagatgaagatccagtatgagcagaggctggagcagcaggagcagctgctggcctgcaagctgaaccagcacgacagcccccgcatcaaggccctggagaaggagctggatgacatcaaggaggcccaccagatcaccgtgaggaacctggaggccgagattgatgtgctgaagcaccagaatgctgagctggatgtgaagaagaatgacaaggatgatgaggacttccagagcattgagttccaggtggagcaggcccacgccaaggccaagctggtgcggctgaatgaggagctggccgccaagaagcgggagatccaggacctgagcaagacagtggagcggctgcagaaggacaggaggatgatgctgagcaaccagaacagcaagggccgggaggagatgtctgccaagagggccaagaaggatgtgctgcacagcagcaaaggaaatgccaacagcttccctggcaccctggacagcaagctgtaccagccccacaccttcacagacagccacgtgtctgaggtgctgcaggagaactaccgcctgaagaatgagctggagggcctcatcagcgagaagaatgagctgaagatgaagtctgaggccgtgatgaaccagtttgaaaattccatgagaagagtgaaggaggacacagctgcccacatcgccagcctgaaggccagccaccagcgggagattgagaagctgctgtgccagaatgctgtggagaacagcagcagcaaggtggccgagctgaacaggaagatcgccacccaggaggtgctgatccgccacttccagagccaggtgaatgagctgcagagcaagcaggagagcctggtggtgtctgaggtgcgggaggagatcctgcagaaggagatcaccaagctgctggaggagctgcgggaggccaaggagaaccacaccccagagatgaagcactttgtgggcctggagaagaagatcaagcagatggagatgagacatgcccagcgggagcaggagctgcagcagatcatccagcagacccaccaggtggtggagacagagcagaacaaggaggtggagaagtggaagaggctggcccagctgaagaaccgggagctggagaagttcagaacagagctggacagcatcctggatgtgctgcgggagctgcaccggcagggcgtggtggtgcctgtggcctttgctgatgagatgaatgcccctgagtactag

SEQ ID NO: 34911 - DNA, 2751 bp, Artificial Sequence
  Description of Artificial Sequence: Synthetic coding sequence
atggagaccagccaggagaccagcctcttcctggtgaagatcctggaggagctggacagcaagcagaacacagtgtcctaccaggacctgtgcaagagcctgtgtgccaggtttgacctgagccagctggccaagctgcggtctgtgctcttctacacagcctgcctggaccccaacttccctgccaccctcttcaaggacaagatgaagtgcaccgtgaacaaccagcagagcaagaagatcatggtggccgctgacatcgtgaccatcttcaacctgatccagatgaatggaggagctgccaaggagaagctgcccaccggccggcagaaggtgaggaagaaggaggccagctttgagagctgccgcagtgacacagagatctgcaatgctgctgaatgtgagcccctgaactgtgagctgtctgagaggagcttcagccggggctaccccatccggcagagcagcaaatgtaggaagatggactgcaaggactgcccccagtttgtgcctgccagcgagcccaacttcctgctgggcgtgtccaaggaggtgaagaacagagctgccagcctggaccggctgcaggccctggccccctacagcgtgaccagcccccagccctgtgagatgcagaggacctacttccccatgaacattgaaaatgaaagcatcagtgaccaggacagcctgcccatcaaccagagcatcaaggagaccttcatcagcaatgaggagccctttgtggtgcagagctgtgtgcagaagaggaacatcttcaaggaggacttccacaacctgatggctgtgagccccagcctggtgggccccatcagcaaggccgagaatgagcaccgggagccccagagcaggaaggagccccacaagccacccttcttcaaccacagctttgagatgccctacaacagccagtacctgaaccctgtgtacagccctgtgcctgacaagaggcgggccaagcatgagagcctggatgacctgcaggccagcacctacttcggccccacccctgtgatgggcacccaggaggcccggcgctgcctgggcaagcccaacaagcagaccccctggccagccaagtcctggagcctgaacacagaggaggtgcctgactttgagaggagcttcttcaacagaaaccccagcgaggagaagctgcactacccaaatgccagcagccagacccccaacttccctgcccctgagcggcggcccacctacctggtgcccaaggaccagcagcccatcctgcccatcgcctatgctgccaagcagaatggcctgaagagcaaggagatcagcagccctgtggacctggagaagcatgagcctgtgaagaagttcaaggacaagagcatcaactgcaccagcggccagctgagcagtgacaccagctctgtgggcacccagacagagcacgtgctggagcccaagaagtgccgggacctgtgcaccagcggccagggcaagtacagcgacagacacaccatgaagcacagtgatgatgattctgaaattgtgtctgatgacatcagtgacatcttccgcttcctggatgacatgagcatcagcggcagcactggagtcatccagagcagctgctacaacagcacaggcagcctgagccagctgcacaagagtgactgtgacagcagccctgagcacaacctgaccaagatcgccaatggagtgcccaacagcaaaggagacaagggcaacagacctgagaacacccaccacagcgaggaggagctgaagacctctgtgtgcaagctggtgctgagaattggagaaattgaaaggaagctggagagcctgagcggcgtgagagatgagatcagccaggtgctgggcaagctgaacaagctggaccagaagatgcagcagcctgagaaggtgtctgtgcagattgacctgaacagcctgaccagcgagggccccagtgatgacagcgccagccccaggatgtttcatgcccacagcggcagccacggccccaagctggagaacaacccagactggtgctgcagtgatgccagcggcagcaacagcgagagcctgcgggtgaaggccctgaagaagagcctcttcacccggcccagcagccgcagcctgacagaagaaaattctgccacagagagcaagatcgccagcatcagcaacagcccccgggactggaggaccatcacctacaccaacagagtgggcctgaatgaggaggagatcaaggacaccggccctggggacaacaaggactggcacaggaagagcaaggaggccgaccggcagtatgacatccccccccagcaccggctgcccaagcagcccaaggatggcttcctggtggagcaggtgttcagcccccacccctacccagccagcctgaaggcccacatgaagagcaaccccctgtacacagacatgaggctgacagagctggccgaggtgaagaggggccagcccagctggaccatcgaggagtatgccagaaatgctggggacaagggcaagctgacagccctggacctgcagacccaggagagcctgaaccccaacaacctggagtactggatggaggacatctacaccccaggctatgacagcctgctgaagaggaaggaggccgagttcagaagagccaaggtgtgcaagattgctgccctgattgctgctgctgcctgcaccgtcatcctggtgattgtggtgcccatctgcaccatgaagagctag

SEQ ID NO: 34912 - DNA, 6534 bp, Artificial Sequence
  Description of Artificial Sequence: Synthetic coding sequence
atggaggagatcctgaggaagctgcagaaggaggccagcggcagcaagtacaaggccatcaaggagagctgcacctgggccctggagaccctgggcggcctggacaccatcgtgaagatcccccctcatgtgctgcgggagaagtgcctgctgcccctgcagctggccctggagagcaagaatgtgaagctggcccagcacgccctggccggcatgcagaagctgctgtctgaggagagatttgtgtccatggagacagacagtgatgagaagcagctgctgaaccagatcctgaatgctgtgaaggtgacccccagcctgaatgaagacctgcaggtggaggtgatgaaggtgctgctgtgcatcacctacacccccacctttgacctgaatggatctgctgtgctgaagattgctgaggtgtgcatcgagacctacatcagcagctgccaccagaggagcatcaacacagctgtgcgggccaccctgagccagatgctgagtgacctgaccctgcagctgcggcagaggcaggagaacaccatcatcgagaacccagatgtgccccaggactttggaaaccagggcagcacagtggagagcctgtgtgatgatgtggtgtctgtgctgactgtgctgtgtgagaagctgcaggccgccatcaatgacagccagcagctgcagctgctgtacctggagtgcatcctgtctgtgctgagcagcagcagcagctccatgcacctgcaccggcgcttcacagacctgatctggaagaacctgtgcccagccctgattgtcatcctgggcaaccccatccatgacaagaccatcaccagcgcccacaccagcagcaccagcaccagcctggagagtgacagcgccagccctggggtgtctgaccacggccggggcagcggctgcagctgcacagccccagccctgagcggccctgtggcccggaccatctactacatcgctgctgagctggtgcggctggtgggctctgtggacagcatgaagcctgtgctgcagagcctgtaccaccgggtgctgctgtaccccccaccccagcaccgggtggaggccatcaagatcatgaaggagatcctgggcagcccccagaggctgtgtgacctggccggccccagcagcacagaaagtgagagcaggaagaggagcatcagcaagaggaagagccacctggacctgctgaagctgatcatggatggcatgacagaggcctgcatcaagggcggcatcgaggcctgctatgctgctgtgtcctgtgtgtgcaccctgctgggcgccctggatgagctgagccagggcaagggcctgtctgagggccaggtgcagctgctgctgctgcggctggaggagctgaaggatggagctgagtggagccgggacagcatggagatcaatgaagctgacttccgctggcagaggagagtgctgagcagcgagcacaccccctgggagagcggaaatgaaagaagcctggacatcagcatctctgtgaccacagacaccggccagaccaccctggagggggagctgggccagaccaccccagaggaccacagcggcaaccacaagaacagcctgaagagccctgccatccctgagggcaaggagaccctgagcaaggtgctggagacagaggccgtggaccagccagatgtggtgcagaggagccacacagtgccctacccagacatcaccaacttcctgtctgtggactgcaggaccaggagctatggcagccgctacagcgagagcaacttctctgtggatgaccaggacctgagcaggacagaatttgacagctgtgaccagtacagcatggctgctgagaaggacagcggccgcagtgatgtgtctgacatcggcagtgacaactgcagcctggctgatgaggagcagaccccccgggactgcctgggccacaggagcctgaggacagctgccctgagcctgaagctgctgaagaaccaggaggccgaccagcacagcgcccggctcttcatccagagcctggagggcctgctgccccggctgctgagcctgagcaatgtggaggaggtggacacagccctgcagaactttgccagcaccttctgcagcggcatgatgcacagccctggctttgatggcaacagcagcctgtccttccagatgctgatgaatgctgacagcctgtacacagctgcccactgtgccctgctgctgaacctgaagctgagccacggggactactacaggaagaggcccaccctggcccctggggtgatgaaggacttcatgaagcaggtgcagaccagcggcgtgctgatggtgttcagccaggcctggattgaggagctgtaccaccaggtgctggacaggaacatgctgggggaggccggctactggggcagccctgaggacaacagcctgcccctcatcaccatgctgacagacattgatggcctggagagcagcgccatcggcggccagctgatggccagcgctgccacagagagcccctttgcccagagcagaagaattgatgacagcacagtggccggcgtggcctttgcccgctacatcctggtgggctgctggaagaacctgattgacaccctgagcacccccctgactggaaggatggccggcagcagcaagggcctggccttcatcctgggcgctgagggcatcaaggagcagaaccagaaggagagagatgccatctgcatgagcctggatggcctgaggaaggccgcccggctgagctgtgccctgggcgtggccgccaactgtgccagcgccctggcccagatggctgctgccagctgtgtgcaggaggagaaggaggagcgggaggcccaggagcccagtgatgccatcacccaggtgaagctgaaggtggagcagaagctggagcagatcggcaaggtgcagggcgtgtggctgcacacagcccacgtgctgtgcatggaggccatcctgtctgtgggcctggagatgggcagccacaacccagactgctggccccacgtgttccgggtgtgtgaatatgtgggcaccctggagcacaaccacttcagtgatggagccagccagccccccctgaccatcagccagccccagaaggccactggatctgctggcctgctgggggaccctgaatgtgagggcagccccccagagcacagccctgagcagggccgcagcctgagcacagcccctgtggtgcagcccctgagcatccaggacctggtgcgggagggcagccggggccgggccagtgacttccggggcggcagcctgatgagcggcagcagcgctgccaaggtggtgctgaccctgagcacccaggccgaccggctgtttgaagatgccacagacaagctgaacctgatggccctgggcggcttcctgtaccagctgaagaaggccagccagagccagctgttccacagcgtgacagacacagtggactacagcctggccatgcctggagaggtgaagagcacccaggacaggaagagcgccctgcacctgttccggctgggcaatgccatgctgcgcatcgtgcgcagcaaggcccggcccctgctgcacgtgatgcgctgctggagcctggtggccccccacctggtggaggccgcctgccacaaggagcggcacgtgtcccagaaggctgtgtccttcatccatgacatcctgacagaggtgctgacagactggaatgaaccaccccacttccacttcaatgaggccctcttccggccctttgagcgcatcatgcagctggagctgtgtgatgaagatgtgcaggaccaggtggtgaccagcattggagagctggtggaggtgtgcagcacccagatccagagcggctggaggcccctcttcagcgccctggagaccgtgcatggaggcaacaagtctgagatgaaggagtacctggtgggggactacagcatgggcaagggccaggcccctgtgtttgatgtgtttgaggccttcctgaacacagacaacatccaggtgtttgccaatgctgccaccagctacatcatgtgcctgatgaagtttgtgaagggcctgggggaggtggactgcaaggagattggagactgtgccccagcccctggggcccccagcacagacctgtgcctgcctgccctggactacctgcggcgctgcagccagctgctggccaagatctacaagatgcccctgaagcccatcttcctgagcggccgcctggccggcctgccccggcggctgcaggagcagagcgccagcagtgaagatggcattgaatctgtgctgagtgactttgatgatgacaccggcctgattgaggtgtggatcatcctgctggagcagctgacagctgctgtgagcaactgcccccggcagcaccagccccccaccctggacctgctgtttgagctgctgagagatgtgaccaagaccccaggccctggcttcggcatctatgctgtggtgcacctgctgctgcctgtgatgtctgtgtggctgcggcgcagccacaaggaccacagctactgggacatggccagcgccaacttcaagcacgccatcggcctgagctgtgagctggtggtggagcacatccagagcttcctgcacagcgacatccgctatgagagcatgatcaacaccatgctgaaggacctgtttgagctgctggtggcctgtgtggccaagcccacagagaccatcagccgggtgggctgcagctgcatccgctacgtgctggtgacagctggccctgtgttcacagaggagatgtggaggctggcctgctgtgccctgcaggatgccttcagcgccaccctgaagcctgtgaaggacctgctgggctgcttccacagcggcacagagagcttctctggagagggctgccaggtgcgggtggccgcccccagcagcagccccagcgctgaggccgagtactggaggatccgggccatggcccagcaggtgttcatgctggacacccagtgcagccccaagacccccaacaactttgaccacgcccagagctgccagctgatcatcgagctgcccccagatgagaagcccaacggccacaccaagaagtctgtgtccttccgggagatcgtggtgtccctgctgagccaccaggtgctgctgcagaacctgtatgacatcctgctggaggagtttgtgaagggccccagccctggagaggagaagaccatccaggtgcctgaggccaagctggccggcttcctgcgctacatctccatgcagaacctggccgtcatctttgacctgctgctggacagctacagaacagcccgggagtttgacaccagccctggcctgaagtgcctgctgaagaaggtgtctggcatcggcggggccgccaacctgtaccggcagagcgccatgtccttcaacatctacttccacgccctggtgtgtgctgtgctgaccaaccaggagaccatcacagctgagcaggtgaagaaggtgctgtttgaagatgatgagaggagcacagacagcagccagcagtgcagcagtgaagatgaggacatctttgaggagacagcccaggtgtccccaccccggggcaaggagaagaggcagtggagggccaggatgcccctgctgtctgtgcagcctgtgtccaatgctgactgggtgtggctggtgaagaggctgcacaagctgtgcatggagctgtgcaacaactacatccagatgcacctggacctggagaactgcatggaggagccccccatcttcaagggggaccccttcttcatcctgcccagcttccagagcgagagcagcacccccagcactggaggcttcagcggcaaggagacccccagtgaagatgacaggagccagagccgggagcacatgggagagagcctgagcctgaaggccggcggcggggacctgctgctgccccccagccccaaggtggagaagaaggaccccagcaggaagaaggagtggtgggagaatgccggcaacaagatctacaccatggctgctgacaagaccatcagcaagctgatgacagagtacaagaagaggaagcagcagcacaacctgagcgccttccccaaggaggtgaaggtggagaagaagggggagcccctgggcccccggggccaggacagccccctgctgcagaggccccagcacctgatggaccagggccagatgaggcacagcttctctgctggccctgagctgctgcggcaggacaagaggcccaggagcggcagcacaggcagcagcctgtctgtgtctgtgagagatgctgaggcccagatccaggcctggaccaacatggtgctgactgtgctgaaccagatccagatcctgcctgaccagaccttcaccgccctgcagcctgctgtgttcccctgcatcagccagctgacctgccacgtgacagacatccgggtgcggcaggccgtgcgggagtggctgggccgggtgggccgggtgtatgacatcatcgtgtag

SEQ ID NO: 34913 - DNA, 3042 bp, Artificial Sequence
  Description of Artificial Sequence: Synthetic coding sequence
atggccgagcccggccacagccaccacctgagcgcccgggtgcggggccgcacagagcggcgcatcccccggctgtggaggctgctgctgtgggccggcacagccttccaggtgacccagggcaccggccctgagctgcacgcctgcaaggagagcgagtaccactatgagtacacagcctgtgacagcacaggcagccgctggagggtggccgtgccccacaccccaggcctgtgcaccagcctgcctgaccccatcaagggcacagagtgcagcttcagctgcaatgctggggagttcctggacatgaaggaccagagctgcaagccctgtgccgagggccgctacagcctgggcaccggcatccgctttgatgagtgggatgagctgccccacggctttgccagcctgagcgccaacatggagctggatgacagcgctgctgagagcactggaaactgcaccagcagcaagtgggtgcccaggggggactacatcgccagcaacacagatgagtgcacagccaccctgatgtatgctgtgaacctgaagcagagcggcaccgtgaactttgagtactactacccagacagcagcatcatctttgagttctttgtgcagaatgaccagtgccagcccaatgctgatgacagccgctggatgaagaccacagagaagggctgggagttccacagcgtggagctgaacagaggcaacaacgtgctgtactggaggaccacagccttctctgtgtggaccaaggtgcccaagcctgtgctggtgaggaacatcgccatcactggagtggcctacaccagcgagtgcttcccctgcaagccaggcacctacgccgacaagcagggcagcagcttctgcaagctgtgcccagccaacagctacagcaacaagggggagaccagctgccaccagtgtgaccctgacaagtacagcgagaagggcagcagcagctgcaatgtgcggcctgcctgcacagacaaggactacttctacacccacacagcctgtgatgccaatggagagacccagctgatgtacaagtgggccaagcccaagatctgcagcgaggacctggagggcgctgtgaagctgcctgccagcggcgtgaagacccactgccccccctgcaaccctggcttcttcaagaccaacaacagcacctgccagccctgcccctacggcagctacagcaatggaagtgactgcacccgctgcccagctggaacagagcctgctgtgggctttgagtacaagtggtggaacaccctgcccaccaacatggagaccaccgtgctgagcggcatcaactttgagtacaagggcatgacaggctgggaggtggccggggaccacatctacacagctgctggggccagtgacaatgacttcatgatcctgaccctggtggtgcccggcttccggcccccccagagcgtgatggctgacacagagaacaaggaggtggcccgcatcacctttgtgtttgagaccctgtgcagcgtgaactgtgagctgtacttcatggtgggcgtgaacagcaggaccaacacccctgtggagacctggaagggcagcaagggcaagcagagctacacctacatcatcgaggagaacaccaccaccagcttcacctgggccttccagaggaccaccttccacgaggccagcaggaagtacaccaatgatgtggccaagatctacagcatcaacgtgaccaacgtgatgaatggagtggccagctactgccggccctgtgccctggaggccagtgatgtgggcagcagctgcaccagctgcccagctggctactacatcgaccgggacagcggcacctgccacagctgccccaccaacaccatcctgaaggcccaccagccctatggagtgcaggcctgtgtgccctgtggccctggcaccaagaacaacaagatccacagcctgtgctacaatgactgcaccttcagcaggaacacccccaccaggaccttcaactacaacttcagcgccctggccaacacagtgaccctggccggcggccccagcttcaccagcaagggcctgaagtacttccaccacttcaccctgagcctgtgtggcaaccagggcaggaagatgtctgtgtgcacagacaacgtgacagacctgcgcatccctgagggggagagcggcttcagcaagagcatcacagcctacgtgtgccaggccgtcatcatccccccagaggtgacaggctacaaggccggcgtgagcagccagcctgtgtccctggccgaccggctgattggagtgaccacagacatgaccctggatggcatcaccagccctgctgagctgttccacctggagagcctgggcatcccagatgtgatcttcttctaccgcagcaatgatgtgacccagagctgcagcagcggccgcagcaccaccatccgggtgcgctgcagcccccagaagacagtgcccggcagcctgctgctgcccggcacctgcagtgatggcacctgtgatggctgcaacttccacttcctgtgggagagcgctgctgcctgccccctgtgcagcgtggccgactaccacgccatcgtgagcagctgtgtggccggcatccagaagaccacctacgtgtggagggagcccaagctgtgcagcggcggcatcagcctgcctgagcagagggtgaccatctgcaagaccatcgacttctggctgaaggtgggcatctctgctggcacctgcacagccatcctgctgactgtgctgacctgctacttctggaagaagaaccagaagctggagtacaagtacagcaagctggtgatgaatgccaccctgaaggactgtgacctgcctgctgctgacagctgtgccatcatggagggagaagatgtggaggatgacctgatcttcaccagcaagaagagcctgtttgggaagatcaagagcttcaccagcaagaggaccccagatggctttgattctgtgcccctgaagaccagcagcggcggcctggacatggacctgtag

SEQ ID NO: 34914 - DNA, 1869 bp, Artificial Sequence
  Description of Artificial Sequence: Synthetic coding sequence
atggccaccgtgctgagccgggccctgaagctgcccgggaagaagagcccagacctgggggagtatgaccccctgacccaggccgacagtgatgaaagtgaagatgacctggtgctgaacctgcagaagaatggaggagtgaagaatggcaagagccccctgggggaggcccctgagccagacagtgatgctgaggtggccgaggccgccaagccccacctgtctgaggtgaccacagagggctaccccagcgagcccctgggcggcctggagcagaaggccgccagcagcctggtgtcctatgtgaggacctctgtgttcctgctgaccctgggcatctccatgatcctggtgctgctgtgtgccttcctgatcccctgccccccccgggacctgcacagcacctggagccgccacctgggcagccagggcggcggggacctgagccccctggagctggctgatgtgaatggagatggcctgagagatgtgctgctgagctttgtgatgagcagaaatggatctgctgtgggcgtgtccaggcctgctgccaacctggtgtgcctgagcggcatgaatggcagcaccctgtggagcagcctgctgcctgaggaggcccgggacatcacctgcctggagctgatgcctggcagcctggccgagaccatctgcctggtgacaggcacccacaagatgctgagcgccttcaatgccaccagcggcaaggccatctggaccctgaaccccaactacctgagcaatggcaccctggccgcccctgtggtggtgctgcctgacctggatgaagatggagtgcgggacctggtggtgctggccatcggggagctgcagcctgacctgtgcttcctgctggtgtctggccgcacaggcaaccctgtgggccggcctgtgaagtacaacatcgtgggcgtgggcaacctgattggcccccaggtgtacatcaccaccaacggggctgtgtacatcctgtttggatttggaaacatccaggccgtggccctgcgggacatctttgtgcaggcccagaacagagacagcagcccccccagcctgcagatcgaggagcctgagtgggagaagaggaggagcatcaacctgtctgagctgattgatgtgtacagtgatggagtggagctgctgcagatggtgaaggccccagacagcaactgcagcaacctgctgatcaccacccggcagagcctggtgctgctgcggggccagaacctgaccccctactgggccctgcggctgcagggcctgcggagccagcccaccccaggctacttcacagatgaccagaccctggacttcctgctgcagatccaggatggagtgggcatgaagaagatgatggtggtggatggagacagcggcagcatcgtgtggagctaccgggccccctgccacatgaaggagaccccagccaccagcgctgtgaccagtgaccagaagagcgtcttcctgttctgggccgagggcctgtctgctgccagccccaacagcgacatcatcctgggcacagagccccccagcctgcaccacctgtacctgctgcacccagccttccccagcatcctgctggacctggccaacaccaccggcaccgtgacagccagcgaggtgggcatcaatgacctgtggaaggatgccttctacgtgaccaggaccaccggccccagcagcgagggccaccctgctgccctggtggtgtccaagctgagcctgcgctgggccctgatggagggccagatggcccagctgcaggagagcacccccaagattggccgcggggagctgcggcgcttcctgagccgcatcaagtttgtggaggccccctatgagatctag

SEQ ID NO: 34915 - DNA, 1869 bp, Artificial Sequence; identical to SEQ ID NO: 34914
  Description of Artificial Sequence: Synthetic coding sequence

SEQ ID NO: 34916 - DNA, 600 bp, Artificial Sequence
  Description of Artificial Sequence: Synthetic coding sequence
atgaccagctgtggccagcagagcctgaatgtgctggccgtgctcttcagcctgctcttctctgctgtgctgagcgcccacttccgggtgtgtgagccctacacagaccacaagggccgctaccacttcggcttccactgcccccggctgagtgacaacaagaccttcatcctgtgctgccaccacaacaacacagtgttcaagtactgctgcaatgaaacagagttccaggccgtgatgcaggccaacctgacagccagcagcgagggctacatgcacaacaactacacagccctgctgggcgtgtggatctacggcttctttgtgctgatgctgctggtgctggacctgctgtactacagcgccatgaactatgacatctgcaaggtgtacctggcccgctggggcatccagggccgctggatgaagcaggacccccggcgctggggcaacccagcccgggccccccggcccggccagagggccccccagccccagcccccacctggccccctgccccaggccccccaggccgtgcacaccctgcggggagatgcccacagcccccccctgatgaccttccagagcagcagcgcctag

SEQ ID NO: 34917 - DNA, 3543 bp, Artificial Sequence
  Description of Artificial Sequence: Synthetic coding sequence
atgaccctgcagggccgggctgacctgagcggcaaccagggcaatgctgctggccgcctggccaccgtgcatgagcctgtggtgacccagtgggccgtgcaccccccagccccagcccaccccagcctgctggacaagatggagaaggccccaccccagccccagcacgagggcctgaagagcaaggagcacctgccccagcagcctgctgagggcaagacagccagcagaagagtgccccggctgcgggctgtggtggagagccaggccttcaagaacatcctggtggatgagatggacatgatgcacgcccgggccgccaccctcatccaggccaactggaggggctactggctgcggcagaagctgatcagccagatgatggccgccaaggccatccaggaggcctggaggcgcttcaacaagaggcacatcctgcacagcagcaagagcctggtgaagaagaccagggctgaggagggggacatcccctaccacgccccccagcaggtgcgcttccagcaccctgaggagaaccggctgctgagcccccccatcatggtgaacaaggagacccagttccccagctgtgacaacctggtgctgtgccggccccagagcagccccctgctgcagcccccagctgcccagggcaccccagagccctgtgtgcagggcccccatgctgcccgggtgcggggcctggccttcctgccccaccagacagtgaccatccgcttcccctgccctgtgtccctggatgccaagtgccagccctgcctgctgaccaggaccatccgcagcacctgcctggtgcacatcgagggggacagcgtgaagaccaagagggtgtctgcccggaccaacaaggcccgggcccctgagacccccctgagccgccgctatgaccaggccgtgacccggcccagccgggcccagacccagggccctgtgaaggccgagacccccaaggcccccttccagatctgccccggccccatgatcaccaagaccctgctgcagacctaccctgtggtgtctgtgaccctgccccagacctacccagccagcaccatgaccaccaccccacccaagaccagccctgtgcccaaggtgaccatcatcaagaccccagcccagatgtacccaggccccaccgtgaccaagacagccccccacacctgccccatgcccaccatgaccaagatccaggtgcaccccacagccagcaggacaggcaccccccggcagacctgcccagccaccatcacagccaagaaccggccccaggtgtccctgctggccagcatcatgaagagcctgccccaggtgtgccccggccctgccatggccaagaccccaccccagatgcaccctgtgaccaccccagccaagaaccccctgcagacctgcctgagcgccaccatgagcaagaccagcagccagaggagccctgtgggcgtgaccaagcccagcccccagacccggctgcctgccatgatcaccaagaccccagcccagctgcggtctgtggccaccatcctgaagaccctgtgcctggccagccccaccgtggccaacgtgaaggccccaccccaggtggccgtggccgccggcacccccaacaccagcggcagcatccatgaaaatccacccaaggccaaggccaccgtgaatgtgaagcaggccgccaaggtggtgaaggccagcagccccagctacctggccgagggcaagatccgctgcctggcccagccccaccctggcaccggggtgcccagggctgctgctgagctgcccctggaggccgagaagatcaagacaggcacccagaagcaggccaagacagacatggccttcaagacctctgtggccgtggagatggccggggcccccagctggaccaaggtggccgaggagggggacaagccaccccacgtgtatgtgcctgtggacatggctgtgaccctgccccggggccagctggccgcccccctgaccaatgccagcagccagaggcaccccccctgcctgagccagaggcccctggccgcccccctgaccaaggccagcagccagggccacctgcccacagagctgaccaagacccccagcctggcccacctggacacctgcctgagcaagatgcacagccagacccacctggccaccggggctgtgaaggtgcagagccaggcccccctggccacctgcctgaccaagacccagagccggggccagcccatcacagacatcaccacctgcctgatcccagcccaccaggccgctgacctgagcagcaacacccacagccaggtgctgctgaccggcagcaaggtgagcaaccacgcctgccagaggctgggcggcctgagcgccccaccctgggccaagccagaggaccggcagacccagccccagccccacggccacgtgcctgggaagaccacccagggcggcccctgcccagctgcctgtgaggtgcagggcatgctggtgccccccatggcccccaccggccacagcacctgcaatgtggagagctggggagacaacggggccacccgggcccagcccagcatgcctggccaggccgtgccctgccaggaggacaccggccctgcagatgctggggtggtgggcggccagagctggaacagagcctgggagcccgcccggggagctgcctcctgggacacctggaggaacaaggctgtggtgcccccccggcgcagcggggagcccatggtgtccatgcaggccgctgaggagatccgcatcctggccgtcatcaccatccaggccggcgtgcggggctacctggcccggcggcgcatccggctgtggcacagaggagccatggtgatccaggccacctggaggggctacagagtgagaagaaacctggcccacctgtgccgggccaccaccaccatccagagcgcctggaggggctacagcacccggcgggaccaggcccggcactggcagatgctgcaccctgtgacctgggtggagctgggcagcagagctggggtgatgtctgaccgctcctggttccaggacggccgggccaggacagtgtctgaccaccgctgcttccagagctgccaggcccacgcctgcagcgtgtgccacagcctgagcagccgcatcggcagccccccatctgtggtgatgctggtgggcagcagccccaggacctgccacacctgtggccgcacccagcccaccagggtggtgcagggcatgggccagggcacagagggccctggagctgtgtcctgggccagcgcctaccagctggccgccctgagcccccggcagccccaccggcaggacaaggccgccacagccatccagagcgcctggaggggcttcaagatccggcagcagatgaggcagcagcagatggccgccaagatcgtgcaggccacctggaggggccaccacaccaggagctgcctgaagaacacagaggccctgctgggccctgctgaccccagcgccagcagccgccacatgcactggccaggcatctag

SEQ ID NO: 34918 - DNA, 5406 bp, Artificial Sequence
  Description of Artificial Sequence: Synthetic coding sequence
atgtctgatgacatcaggaagagatttgagttccccaacagcctcatccagagccaggccgtgggccacctgattgctgctgtgctgaaggaaaatggcttcagcgagaagatccaccagagcaccaaccagaccccagccctgaacctgctgtgggagaagtgctgcagcgacaacgtggtggtgaggacagcctgctgtgagggcctggtggccctggtggcccaggaccatgctgagttctcctatgtgctgaatggcatcctgaacctgatccccagcaccaggaacacccacggcctcatcaaggccatcatgcacctgctgcagatgcaggccctgaaggagggccagggcggggagaagaacatccagagcatctacaccatccggaaccacccccaccccctcatcaccgtgctggagcacaggccagactgctggcctgtgttcctgcagcagctgacagccttcttccagcagtgcccagagcggctggaggtgtcctgcatccagatcatggcccccttcctgtggtacctgtactgtgagcccagccagctgcaggagtatgccaagctgcggctggccctgctgaaggtgctgctgcagccccaggtgctgtgtgacaaggaccagcccagcatcctggagcagcagatcctgcagctgtgctgtgacatcgtgccctgcctgcaggtgaaggacctgatccagaccacagaggccatgatgtttattgaggaggtgtgcctgagcctgctgcggcaccctgtgttctggaagatccagctgacccagatgagcctgcagctgctgtgtgtgtctgaggtgtccctgaagatcactggagaatgtagcagcagcatccacctgctggagcacagcgtggagctgctgaaggaggacttccctgtggagctggtgatcattggaattgccctgctgctgctgcagaccccagccagccagcagaagcccatcctgaacctggccctgaagctgctgtctgtgacagaggaccagaagatccccaagagcagcctgctgctggtgatgcccatcctgcagatcctgagcagcacagccctggaggactgcatctctgtggatgaggagggccccagccggcagcagctggccctgaacctgctggagatgatccagcaggagtgctacagagatgaccaccagaagctgagctacaagctggtgtgccctgtgacctccatgtatggcaccatcttcaccgcctggaggatcctggaggtgatgacagacagcagcgctgccagtgactggctggcctctgtggagagcctgctgcccatcacagctgtgatcccagccccagccttcctgctgctggcccacctgctggtggaggacaagggccagaacctgcaccagatcctgaaggtgaccacagagctggcccaggccgacagcagccaggtgcccaacctgatccctgtgctgatgttcaagctgggccggcccctggagcccatcctgtacaatgacatcctgtacaccctgcccaagctgggcgtgcacaaggtgtgcatcggccagatcctgcgcatcatccagctgctgggcaccaccccccggctgcgggctgtgaccctgcggctgctgaccagcctgtgggagaagcaggacagagtgtacccagagctgcagcgcttcatggctgtgtctgatgtgcccagcctgtctgtgggcaaggaggtgcagtgggagaagctgattgccaaggccgccagcatccgggacatctgcaagcagaggccctaccagcacggggctgacatgctggccgccatcagccaggtgctgaatgaatgtaccaagccagaccaggccaccccagctgccctggtgctgcagggcctgcacgccctgtgccaggccgaggtggtgtgcatccgcagcacctggaatgccctgagccccaagctgagctgtgacacccggcccctcatcctgaagaccctgtctgagctgttcagcctggtgcccagcctgactgtgaacaccacagaatatgagaacttcaaggtgcaggtgctgtccttcctgtggacccacacccagaacaaggaccccatcgtggccaatgctgcctaccgcagcctggccaacttcaccgctggggagcacaccatcctgcacctgcctgagaagatccggcctgagatccccatccctgaggagctggatgatgatgaagatgtggaggatgtggacctgtctgtgcccggcagctgctacctgaagctgctgagcctgaccccacccctggtgctgcctgccctggaggagttcttcaccagcctggtgaagcaggagatggtgaacatgccccggggcatctaccacagcgccctgaagggcggggcccggagtgaccagggcaagacagtggccggcatccccaacttcatcctgaagatgtatgagaccaacaagcagcccggcctgaagccaggcctggccggcggcatgctgttctgctatgatgtgtccatgtaccagagcaaggatggcaagcccctgaaccggctgatggccagccggggccgctccttcaagcagaccagcctggccctggtgcatgaggtgcacatccagctgtctgagtggcaccgggccatcttcctgccccaggcctggctggcctacatgaacagagcctaccacgccatcctgcagggccgcctgggggagctggagctgcagctgaagcacggcaaggaggagcctgaggaggtgcagtacaagaagagcacagcctggctgtgggtgcgggacatgctgacagatgagatcaccaaggctgctgccaaggagagccctgtggtgaagggaaatgccctgctggccctgagcagcctggccgtggtggtgtccagacatgaggccagcctgagcagtgacagtgatggcctgctggaggtgcagcccaacttcctgtccatgaaggagtgggtgtccatggtgctggacaccctgctggtgattgtggacagccactaccagccccggggccagctgctgtcctggttctactacaagagctacagcggggagaacacagccagcgccatcgcccggtctgctgctgccacagccctgagcctgctggtgcctgtgttcatcatcagctgcaaggagaaggtggaggagatcctgaacatgctgacagcccggctgcccgggaagcccagcgcagatgagagccaggccgtgcagatccacatgggcctggccctgggcatgttcctgagccggctgtgtgaggagaagctgagtgacatcagcggccaggagatgaacctgctgctgatgaagagcctggatgccctggagaactgctgctttgacaccagcctggagtacaacacaggctgcatcctgggcgtgggcctggtgctgagcctgatgagccacagcagccagatgcagagccgggtgcacgtggccgccctgctgaggaagctgagcgcccacgtggatgacagcggcagccagagcaggaccttccaggaggtgctggcctacaccctgagctgtgtgtgcaccagcgccttctctgctggcatcatcgaggccacagaagcagaagatgtgatgaacaagctgcggctgctggtggagaacagccagcagaccagcggctttgccctggccctgggcaacatcgtgcacggcctgtctgtgtgtggccacggcaaggccgaggacctgggcagcaagctgctgcctgcctggatccgcatcgtgctgacagagggcacccccaccatgctgtgcctggccgccctgcacggcatggtggccctggtgggctctgaaggagatgtgatgcagctgaagtctgaggccatccagaccagccacttccagggccgcctgaatgaggtgatccgcaccctgacccaggtgatctctgtgtctggagtcatcggcctgcagagcaatgctgtgtggctgctgggccacctgcacctgagcaccctgagcagcagccagagccgggcctctgtgcccacagactacagctacctgcctgagagcagcttcatcggggccgccatcggcttcttcatcactggaggcaagaagggccctgagagcgtgccccccagcctgctgaaggtggtgatgaagcccatcgccaccgtgggggagagctaccagtacccacctgtgaactgggccgccctgctgagccccctgatgaggctgaactttggagaggagatccagcagctgtgcctggagatcatggtgacccaggcccagagcagccagaatgctgctgccctgctgggcctgtgggtgaccccacccctcatccacagcctgagcctgaacaccaagcgctacctgctgatcagcgcccccctgtggatcaagcacatcagtgatgagcagatcctgggctttgtggagaacctgatggtggccgtgttcaaggccgccagccccctgggcagccctgagctgtgccccagcgccctgcacggcctgagccaggccatgaagctgcccagccctgcccaccacctgtggagcctgctgtctgaggccaccgggaagatctttgacctgctgcccaacaagatccggaggaaggacctggagctgtacatcagcatcgccaagtgcctgctggagatgacagatgatgatgccaacagaattgcccaggtgaccaagagcaacatcgagaaggccgcctttgtgaagctgtacctggtgtcccagggccgcttccccctggtgaacctgacagacatgctgtctgtggccgtgcagcaccgggagaaggaggtgctggcctggatgatcctgcacagcctgtaccaggccagaattgtgagccacgccaacacaggagtgctgaagaggatggagtggctgctggagctgatgggctacatcagaaatgtggcctaccagagcaccagcttccacaacacagccctggacaaggccctggacttcttcctgctgatctttgccacagctgtggtggcctgggccgaccacacagcccccctgctgctgggcctgagcgcctcctggctgccctggcaccaggagaatggacctgctggccctgtgcccagcttcctgggccgcagccccatgcaccgggtgaccctgcaggaggtgctgaccctgctgcccaacagcatggccctgctgctgcagaaggagccctggaaggagcagacccagaagttcatcgactggctgttcagcatcatggagagccccaaggaggccctgagcgcccagagccgggacctgctgaaggccaccctgctgagcctgcgggtgctgcctgagttcaagaagaaggctgtgtggacccgggcctacggctggtag

SEQ ID NO: 34919 - DNA, 5406 bp, Artificial Sequence; identical to SEQ ID NO: 34918
  Description of Artificial Sequence: Synthetic coding sequence

SEQ ID NO: 34920 - DNA, 1557 bp, Artificial Sequence
  Description of Artificial Sequence: Synthetic coding sequence
atgctgtgtgccagcttcctgggcctgggcctgtctgtggccatcgtgggccccaccttccaggacctggccaccaacgtgaacagaaacatcagcagcctgtccttcatctttgtgggccgggccctgggctacctgagcggctctgtgattggaggcttcctggtggatgtgatgaactacttcctgctgctgggcatctccatgtctgccaccaccgtgggcctgtacctggtgcccttctgcaagacagccatcctgctgactgtgatgatgagcatctttggagtgtccatcggcatcctggacaccggcggcaatgtgctgatcctggccatctggggagacaagggggccccccacatgcaggccctgcacttctcctttgccctgggcgccttcctggcccccctgctggccaagctggccctgggccccacagccagcgctgagaaccacacagaaagtgacttccacccagccctgaaccagagcagtgatgctgacagcgaggccctgtttggagtgcccaatgacaagaacctgctgtgggcctatgctgtgattggcacctacatgttcctggtgtctgtcatcttcttctgcctcttcctgaagaacagcagcaagcaggagaaggcccgggccagcgctgagaccttccggcgggccaagtaccacaatgccctgctgtgcctgctcttcctgttcttcttcttctacgtgggcgctgaggtgacctacggcagctatgtgttctcctttgccaccacccacgccggcatgaaggagagcgaggccgccggcctgaacagcatcttctggggcacctttgctgcctgccggggcctggccatcttctttgccacctgcctgcagcccggcaccatgattgtgctgagcaacatcggcagcctgaccagcagcctcttcctggtgctgtttgacaagaaccccatctgcctgtggatcgccacctctgtgtatggagcctccatggccaccaccttccccagcggcgtgtcctggattgagcagtacaccaccatccacggcaagtctgctgccttcttcgtcatcggggccagcctgggggagatggccatcccagctgtgattggcatcctgcagggcaagtacccagacctgcctgtggtgctgtacaccagcctgggcgccagcatcgccaccggcatcctcttccctgtgctgtacaagctggccaccagccccctggaccggcagaggaaggaggacaggaagtctgaggaccagaaggccctgctgagcagcagcggcctgaatgaatatgaggaggagaatgaggaggaggatgctgagaagtggaatgagatggactttgagatgattgagaccaatgacaccatgaggcacagcatcatcgagaccagccgcagcagcctgacagagcccacagctgaggtgtacaaccagtaccccagcaatgccctggtgtttgagagcagccccttcaacacaggcagcgcccacgtgaagcacctgcctgagaccaggaccaagggcaccaacgtgtag

SEQ ID NO: 34921 - DNA, 1905 bp, Artificial Sequence
  Description of Artificial Sequence: Synthetic coding sequence
atgtggctgcagcagaggctgaagggcctgcccggcctgctgagcagctcctgggcccggcggctgctgtgcctgctgggcctgctgctgctgctgctgtggtttggaggcagcggggccaggagagctgctgggggcctgcacctgctgccctggagcagaggagagcctggagctgctgagcccagcgcctgcctggaggccgccacccgggcctggaggggcctgcgggagcggggggaggtggtgcccctgggccctggggtgcctgccctggtggccaacggcttcctggccctggatgtggccgccaaccggctgtgggtgaccccaggagagcgggagcctgctgtggccccagactttgtgccctttgtgcagctgcggcccctgagcgccctggccgaggccggggaggccgtgctgctgctgcgggagggcctgctgcggcgggtgcgctgcctgcagctgggcagccctggccctggccctgtggccgccggccctggccctgcctctgtgtctggcctggccgccggcagcggccgggactgtgtgctgctgcaggaggacttcctggcccaccggggccggccccacgtgtacctgcagaggatccagctgaacaaccccacagagcgggtggccgccctgcagacagtgggccccacagctggccctgcccccaaggccttcaccagcaccctggagaaggtgggggaccaccagttcctgctgtacagcggccgcagcccccccacccccaccggcctggtgcacctggtggtggtggccgccaagaagctggtgaaccggctgcaggtggcccccaagacccagctggatgagaccgtgctgtgggtggtgcacgtgtctggccccatcaacccccaggtgctgaagagcaaggccgccaaggagctgaaggccctgcaggacctggccaggaaggagatgctggagctgctggacatgcctgctgctgagctgctgcaggaccaccagctgctgtgggcccagctgttcagccctggggtggagatgaagaagatcacagacacccacacccccagcggcctgactgtgaacctgaccctgtactacatgctgagctgcagccctgcccccctgctgagccccagcctgagccaccgggagcgggaccagatggagagcaccctgaactatgaggaccactgcttcagcggccacgccaccatgcatgctgagaacctgtggccaggccgcctgagctctgtgcagcagatcctgcagctgagtgacctgtggaggctgaccctgcagaagaggggctgcaagggcctggtgaaggtgggcgcccctggcatcctgcagggcatggtgctgagctttggaggcctgcagttcacagagaaccacctgcagttccaggccgaccctgatgtgctgcacaacagctatgccctgcacggcatccgctacaagaatgaccacatcaacctggccgtgctggctgatgctgagggcaagccctacctgcacgtgtctgtggagagccggggccagcctgtgaagatctatgcctgcaaggccggctgcctggatgagcctgtggagctgaccagcgcccccaccggccacaccttctctgtgatggtgacccagcccatcacccccctgctgtacatcagcacagacctgacccacctgcaggacctgcggcacaccctgcacctgaaggccatcctggcccatgatgagcacatggcccagcaggaccccggcctgcccttcctgttctggttctctgtggccagcctcatcaccctcttccacctgttcctgttcaagctgatctacaatgagtactgcggccctggggccaagcccctcttccgcagcaaggaggaccccagcgtgtag

SEQ ID NO: 34922 - DNA, 1233 bp, Artificial Sequence
  Description of Artificial Sequence: Synthetic coding sequence
atgagcctgatggtggtgtccatggcctgtgtgggcttcttcctgctggagggcccctggccccacgtgggcggccaggacaagcccttcctgagcgcctggccaggcaccgtggtgtctgagggccagcacgtgaccctgcagtgccgcagccggctgggcttcaatgagttcagcctgagcaaagaagatggcatgcctgtgcctgagctgtacaaccgcatcttcagaaattccttcctgatgggccctgtgaccccagcccacgccggcacctaccgctgctgcagcagccacccccacagccccaccggctggagcgcccccagcaaccctgtggtgatcatggtgactggagtgcacaggaagcccagcctgctggcccaccctggccccctggtgaagagcggggagaccgtcatcctgcagtgctggagcgatgtgcgctttgagcgcttcctgctgcaccgggagggcatcacagaggaccccctgcggctggtgggccagctgcatgatgctggcagccaggtgaactacagcatgggccccatgaccccagccctggccggcacctaccgctgcttcggctctgtgacccacctgccctatgagctgagcgcccccagcgaccccctggacatcgtggtggtgggcctgtatggcaagcccagcctgagcgcccagcccggccccaccgtgcaggccggggagaatgtgaccctgagctgcagcagccgcagcctgtttgacatctaccacctgagccgggaggccgaggccggggagctgcggctgacagctgtgctgcgggtgaatggcaccttccaggccaacttccccctgggccctgtgacccatggaggcaactaccgctgcttcggcagcttccgggccctgccccacgcctggagcgaccccagcgaccccctgcctgtgtctgtgacaggcaacagccgccacctgcacgtgctgattggcacctctgtggtgatcatcccctttgccatcctgctcttcttcctgctgcaccgctggtgtgccaacaagaagaatgctgtggtgatggaccaggagcctgctggcaacagaacagtgaacagagaagattctgatgagcaggacccccaggaggtgacctacgcccagctgaaccactgtgtgttcacccagaggaagatcacccggcccagccagaggcccaagaccccacccacagacacctctgtgtag

SEQ ID NO: 34923 - DNA, 624 bp, Artificial Sequence
  Description of Artificial Sequence: Synthetic coding sequence
atggagaatgaagatggctacatgaccctgtccttcaagaaccgctgcaagagcaagcagaagagcaaggacttcagcctgtacccccagtactactgcctgctgctgatcttcggctgcatcgtcatcctgatcttcatcatgactggaattgacctgaagttctggcacaagaagatggacttcagccagaatgtgaatgtgagcagcctgagcggccacaactacctgtgccccaatgactggctgctgaatgaaggcaagtgctactggttcagcaccagcttcaagacctggaaggagagccagagggactgcacccagctgcaggcccacctgctggtgatccagaacctggatgagctggagttcatccagaacagcctgaagccaggccacttcggctggattggcctgtatgtgaccttccagggcaacctgtggatgtggattgatgagcacttcctggtgcctgagctgttcagcgtcatcggccccacagatgacaggagctgtgctgtgatcaccggcaactgggtgtacagcgaggactgcagcagcaccttcaagggcatctgccagagagatgccatcctgacccacaacggcaccagcggcgtgtag

SEQ ID NO: 34924 - DNA, 1230 bp, Artificial Sequence
  Description of Artificial Sequence: Synthetic coding sequence
atggaggagagctgggaggccgcccctgggggccaggccggggctgagctgcccatggagcctgtgggcagcctggtgcccaccctggagcagccccaggtgcctgccaaggtgcggcagcctgagggccctgagagcagccccagccctgctggagctgtggagaaggccgccggggccggcctggagcccagcagcaagaagaagccacccagccccaggcctggcagcccccgggtgccccccctgagcctgggctatggagtgtgcccagagccccccagccctggccctgccctggtgaagctgcccagaaatggagaggcccctggagctgagcccgcccccagcgcctgggcccccatggagctgcaggtggatgtgcgggtgaagcctgtgggcgccgccggcggcagcagcacccccagcccccggcccagcacccgcttcctgaaggtgcctgtgcctgagagccctgccttcagcagacatgctgaccctgcccaccagctgctgctgcgggcccccagccagggcggcacctggggccgccgcagccccctggccgccgccaggacagaaagtggctgtgatgctgagggccgggccagccctgctgagggcagcgctggcagccctggcagccccacctgctgccgctgcaaggagctgggcctggagaaggaggatgctgccctgctgcccagggctggcctggatggagatgagaagctgcccagggctgtgaccctgaccggcctgcccatgtatgtgaagagcctgtactgggccctggccttcatggctgtgctgctggccgtgtctggagtggtgattgtggtgctggccagccgggccggggcccgctgccagcagtgccccccaggctgggtgctgtctgaggagcactgctactacttctctgctgaggcccaggcctgggaggccagccaggccttctgcagcgcctaccacgccaccctgcccctgctgagccacacccaggacttcctgggccgctaccctgtgagccgccacagctgggtgggcgcctggaggggcccccagggctggcactggattgatgaggcccccctgcccccccagctgctgcctgaagatggagaggacaacctggacatcaactgtggggccctggaggagggcaccctggtggccgccaactgcagcaccccccggccctgggtgtgtgccaagggcacccagtag

SEQ ID NO: 34925 - DNA, 945 bp, Artificial Sequence
  Description of Artificial Sequence: Synthetic coding sequence
atggaggagagctgggaggccgcccctgggggccaggccggggctgagctgcccatggagcctgtgggcagcctggtgcccaccctggagcagccccaggtgcctgccaaggtgcggcagcctgagggccctgagagcagccccagccctgctggagctgtggagaaggccgccggggccggcctggagcccagcagcaagaagaagccacccagccccaggcctggcagcccccgggtgccccccctgagcctgggctatggagtgtgcccagagccccccagccctggccctgccctggtgaagctgcccagaaatggagaggcccctggagctgagcccgcccccagcgcctgggcccccatggagctgcaggtggatgtgcgggtgaagcctgtgggcgccgccggcggcagcagcacccccagcccccggcccagcacccgcttcctgaaggtgcctgtgcctgagagccctgccttcagcagacatgctgaccctgcccaccagctgctgctgcgggcccccagccagggcggcacctggggccgccgcagccccctggccgccgccaggacagaaagtggctgtgatgctgagggccgggccagccctgctgagggcagcgctggcagccctggcagccccacctgctgccgctgcaaggagctgggcctggagaaggaggatgctgccctgctgcccagggctggcctggatggagatgagaagctgcccagggctgtgaccctgacagacagcctgaggacagcccggaccatctggatcagcacagtgggcccctggaggaaggcccgctggtggctgcagacagctgccctgcaggaccccggctctgtgccccggggccccagcgacctgggcagcgcctggagcagcgcctgccaggctgatgctgccccacccaccggggaggccagctag

SEQ ID NO: 34926 - DNA, 2274 bp, Artificial Sequence
  Description of Artificial Sequence: Synthetic coding sequence
atgctgagcctgctggtgtggatcctgaccctgagtgacaccttcagccagggcacccagacccgcttcagccaggagcctgctgaccagacagtggtggccggccagagagctgtgctgccctgtgtgctgctgaactacagcggcatcgtgcagtggaccaaggatggcctggccctgggcatgggccagggcctgaaggcctggccccgctacagagtggtgggcagcgcagatgctggccagtacaacctggagatcacagatgctgagctgagtgatgatgccagctatgagtgccaggccacagaagctgccctgcggagccggcgggccaagctgactgtgctgatccccccagaggacaccagaattgatggcggccctgtgatcctgctgcaggccggcaccccccacaacctgacctgccgggccttcaatgccaagccagctgccaccatcatctggttcagagatggcacccagcaggagggcgctgtggccagcacagagctgctgaaggatggcaagcgggagaccaccgtgtcccagctgctgatcaaccccacagacctggacatcggccgggtcttcacctgccgctccatgaatgaggccatccccagcggcaaggagaccagcattgagctggatgtgcaccacccccccaccgtgaccctgagcattgagccccagacagtgcaggagggggagcgggtggtgttcacctgccaggccacagccaaccctgagatcctgggctaccgctgggccaagggcggcttcctgattgaagatgcccacgagagccgctatgagaccaacgtggactacagcttcttcacagagcctgtgtcctgtgaggtgcacaacaaggtgggcagcaccaacgtgtccaccctggtgaatgtgcactttgccccccgcatcgtggtggaccccaagcccaccaccacagacattggaagtgatgtgaccctgacctgtgtgtgggtgggcaacccccccctgaccctgacctggaccaagaaggacagcaacatggtgctgagcaacagcaaccagctgctgctgaagtctgtgacccaggctgatgctggcacctacacctgccgggccatcgtgccccgcatcggcgtggccgagcgggaggtgcccctgtatgtgaatggcccccccatcatcagcagcgaggccgtgcagtatgctgtgagaggagatggcggcaaggtggagtgcttcatcggcagcaccccacctccagaccgcatcgcctgggcctggaaggagaacttcctggaggtgggcaccctggagcgctacacagtggagaggaccaacagcggcagcggcgtgctgagcaccctgaccatcaacaacgtgatggaggccgacttccagacccactacaactgcacagcctggaacagctttggacctggaacagccatcatccagctggaggagcgggaggtgctgcctgtgggcatcatcgccggggccaccatcggggccagcatcctgctgatcttcttcttcatcgccctggtgttcttcctgtacagaagaaggaagggcagcaggaaggatgtgaccctgaggaagctggacatcaaggtggagaccgtgaaccgggagcccctgaccatgcacagcgacagagaagatgacacagcctctgtgtccacagccaccagggtgatgaaggccatctacagcagcttcaaggatgatgtggacctgaagcaggacctgcgctgtgacaccatcgacacccgggaggagtatgagatgaaggaccccaccaacggctactacaacgtgcgggcccacgaggaccggcccagcagcagagctgtgctgtatgctgactaccgggcccctggccctgccaggtttgatggccggcccagcagccggctgagccacagcagcggctacgcccagctgaacacctacagccggggccctgccagtgactatggccctgagcccaccccacctggccctgctgccccagctggaacagacaccaccagccagctgtcctatgaaaattatgagaagttcaacagccaccccttccctggagctgctggctaccccacctaccgcctgggctacccccaggccccacccagcggcctggagaggaccccctatgaggcctatgaccccatcggcaagtatgccacagccacccgcttctcctacaccagccagcacagcgactatggccagcgcttccagcagaggatgcagacccacgtgtag

SEQ ID NO: 34927 - DNA, 1782 bp, Artificial Sequence
  Description of Artificial Sequence: Synthetic coding sequence
atgggccagggcctgaaggcctggccccgctacagagtggtgggcagcgcagatgctggccagtacaacctggagatcacagatgctgagctgagtgatgatgccagctatgagtgccaggccacagaggccgccctgcggagcagaagagccaagctgactgtgctgaacccccccaccgtgaccctgagcattgagccccagacagtgcaggagggggagcgggtggtgttcacctgccaggccacagccaaccctgagatcctgggctaccgctgggccaagggcggcttcctgattgaagatgcccacgagagccgctatgagaccaacgtggactacagcttcttcacagagcctgtgtcctgtgaggtgcacaacaaggtgggcagcaccaacgtgtccaccctggtgaatgtgcactttgccccccgcatcgtggtggaccccaagcccaccaccacagacattggaagtgatgtgaccctgacctgtgtgtgggtgggcaacccccccctgaccctgacctggaccaagaaggacagcaacatggtgctgagcaacagcaaccagctgctgctgaagtctgtgacccaggctgatgctggcacctacacctgccgggccatcgtgccccgcatcggcgtggccgagcgggaggtgcccctgtatgtgaatggcccccccatcatcagcagcgaggccgtgcagtatgctgtgagaggagatggcggcaaggtggagtgcttcatcggcagcaccccacctccagaccgcatcgcctgggcctggaaggagaacttcctggaggtgggcaccctggagcgctacacagtggagaggaccaacagcggcagcggcgtgctgagcaccctgaccatcaacaacgtgatggaggccgacttccagacccactacaactgcacagcctggaacagctttggacctggaacagccatcatccagctggaggagcgggaggtgctgcctgtgggcatcatcgccggggccaccatcggggccagcatcctgctgatcttcttcttcatcgccctggtgttcttcctgtacagaagaaggaagggcagcaggaaggatgtgaccctgaggaagctggacatcaaggtggagaccgtgaaccgggagcccctgaccatgcacagcgacagagaagatgacacagcctctgtgtccacagccaccagggtgatgaaggccatctacagcagcttcaaggatgatgtggacctgaagcaggacctgcgctgtgacaccatcgacacccgggaggagtatgagatgaaggaccccaccaacggctactacaacgtgcgggcccacgaggaccggcccagcagcagagctgtgctgtatgctgactaccgggcccctggccctgccaggtttgatggccggcccagcagccggctgagccacagcagcggctacgcccagctgaacacctacagccggggccctgccagtgactatggccctgagcccaccccacctggccctgctgccccagctggaacagacaccaccagccagctgtcctatgaaaattatgagaagttcaacagccaccccttccctggagctgctggctaccccacctaccgcctgggctacccccaggccccacccagcggcctggagaggaccccctatgaggcctatgaccccatcggcaagtatgccacagccacccgcttctcctacaccagccagcacagcgactatggccagcgcttccagcagaggatgcagacccacgtgtag

SEQ ID NO: 34928 - DNA, 2322 bp, Artificial Sequence
  Description of Artificial Sequence: Synthetic coding sequence
atgctgagcctgctggtgtggatcctgaccctgagtgacaccttcagccagggcacccagacccgcttcagccaggagcctgctgaccagacagtggtggccggccagagagctgtgctgccctgtgtgctgctgaactacagcggcatcgtgcagtggaccaaggatggcctggccctgggcatgggccagggcctgaaggcctggccccgctacagagtggtgggcagcgcagatgctggccagtacaacctggagatcacagatgctgagctgagtgatgatgccagctatgagtgccaggccacagaagctgccctgcggagccggcgggccaagctgactgtgctgatccccccagaggacaccagaattgatggcggccctgtgatcctgctgcaggccggcaccccccacaacctgacctgccgggccttcaatgccaagccagctgccaccatcatctggttcagagatggcacccagcaggagggcgctgtggccagcacagagctgctgaaggatggcaagcgggagaccaccgtgtcccagctgctgatcaaccccacagacctggacatcggccgggtcttcacctgccgctccatgaatgaggccatccccagcggcaaggagaccagcattgagctggatgtgcaccacccccccaccgtgaccctgagcattgagccccagacagtgcaggagggggagcgggtggtgttcacctgccaggccacagccaaccctgagatcctgggctaccgctgggccaagggcggcttcctgattgaagatgcccacgagagccgctatgagaccaacgtggactacagcttcttcacagagcctgtgtcctgtgaggtgcacaacaaggtgggcagcaccaacgtgtccaccctggtgaatgtgcactttgccccccgcatcgtggtggaccccaagcccaccaccacagacattggaagtgatgtgaccctgacctgtgtgtgggtgggcaacccccccctgaccctgacctggaccaagaaggacagcaacatgggcccccggcccccaggcagccccccagaggccgccctgagcgcccaggtgctgagcaacagcaaccagctgctgctgaagtctgtgacccaggctgatgctggcacctacacctgccgggccatcgtgccccgcatcggcgtggccgagcgggaggtgcccctgtatgtgaatggcccccccatcatcagcagcgaggccgtgcagtatgctgtgagaggagatggcggcaaggtggagtgcttcatcggcagcaccccacctccagaccgcatcgcctgggcctggaaggagaacttcctggaggtgggcaccctggagcgctacacagtggagaggaccaacagcggcagcggcgtgctgagcaccctgaccatcaacaacgtgatggaggccgacttccagacccactacaactgcacagcctggaacagctttggacctggaacagccatcatccagctggaggagcgggaggtgctgcctgtgggcatcatcgccggggccaccatcggggccagcatcctgctgatcttcttcttcatcgccctggtgttcttcctgtacagaagaaggaagggcagcaggaaggatgtgaccctgaggaagctggacatcaaggtggagaccgtgaaccgggagcccctgaccatgcacagcgacagagaagatgacacagcctctgtgtccacagccaccagggtgatgaaggccatctacagcagcttcaaggatgatgtggacctgaagcaggacctgcgctgtgacaccatcgacacccgggaggagtatgagatgaaggaccccaccaacggctactacaacgtgcgggcccacgaggaccggcccagcagcagagctgtgctgtatgctgactaccgggcccctggccctgccaggtttgatggccggcccagcagccggctgagccacagcagcggctacgcccagctgaacacctacagccggggccctgccagtgactatggccctgagcccaccccacctggccctgctgccccagctggaacagacaccaccagccagctgtcctatgaaaattatgagaagttcaacagccaccccttccctggagctgctggctaccccacctaccgcctgggctacccccaggccccacccagcggcctggagaggaccccctatgaggcctatgaccccatcggcaagtatgccacagccacccgcttctcctacaccagccagcacagcgactatggccagcgcttccagcagaggatgcagacccacgtgtag

SEQ ID NO: 34929 - DNA, 1965 bp, Artificial Sequence
  Description of Artificial Sequence: Synthetic coding sequence
atgctgagcctgctggtgtggatcctgaccctgagtgacaccttcagccagggcacccagacccgcttcagccaggagcctgctgaccagacagtggtggccggccagagagctgtgctgccctgtgtgctgctgaactacagcggcatcgtgcagtggaccaaggatggcctggccctgggcatgggccagggcctgaaggcctggccccgctacagagtggtgggcagcgcagatgctggccagtacaacctggagatcacagatgctgagctgagtgatgatgccagctatgagtgccaggccacagaagctgccctgcggagccggcgggccaagctgactgtgctgaaccccccaacagtgaccctgagcattgagccccagacagtgcaggagggggagcgggtggtgttcacctgccaggccacagccaaccctgagatcctgggctaccgctgggccaagggcggcttcctgattgaagatgcccacgagagccgctatgagaccaacgtggactacagcttcttcacagagcctgtgtcctgtgaggtgcacaacaaggtgggcagcaccaacgtgtccaccctggtgaatgtgcactttgcccccagaattgtggtggaccccaagcccaccaccacagacatcggcagtgatgtgaccctgacctgtgtgtgggtgggcaacccccccctgaccctgacctggaccaagaaggacagcaacatggtgctgagcaacagcaaccagctgctgctgaagtctgtgacccaggctgatgctggcacctacacctgccgggccatcgtgcccagaattggagtggccgagcgggaggtgcccctgtatgtgaatggaccacccatcatcagcagcgaggccgtgcagtatgctgtgagaggagatggcggcaaggtggagtgcttcatcggcagcaccccacctccagacagaattgcctgggcctggaaggagaacttcctggaggtgggcaccctggagcgctacacagtggagaggaccaacagcggcagcggcgtgctgagcaccctgaccatcaacaacgtgatggaggccgacttccagacccactacaactgcacagcctggaacagctttggacctggaacagccatcatccagctggaggagcgggaggtgctgcctgtgggcatcatcgccggggccaccatcggggccagcatcctgctgatcttcttcttcatcgccctggtgttcttcctgtacagaagaaggaagggcagcaggaaggatgtgaccctgaggaagctggacatcaaggtggagaccgtgaaccgggagcccctgaccatgcacagcgaccgggaggatgacacagcctctgtgtccacagccaccagggtgatgaaggccatctacagcagcttcaaggatgatgtggacctgaagcaggacctgcgctgtgacaccatcgacacccgggaggagtatgagatgaaggaccccaccaacggctactacaacgtgcgggcccatgaagatcggcccagcagcagagctgtgctgtatgctgactaccgggcccctggccctgccaggtttgatggccggcccagcagccggctgagccacagcagcggctacgcccagctgaacacctacagccggggccctgccagtgactatggccctgagcccaccccacctggccctgctgccccagctggaacagacaccaccagccagctgtcctatgagaactatgagaagttcaacagccaccccttccctggagctgctggctaccccacctaccgcctgggctacccccaggcccctccttctggcctggagaggaccccctatgaggcctatgaccccatcggcaagtatgccacagccacccgcttctcctacaccagccagcacagcgactatggccagcgcttccagcagaggatgcagacccacgtgtag

SEQ ID NO: 34930 - DNA, 1974 bp, Artificial Sequence
  Description of Artificial Sequence: Synthetic coding sequence
atgctgagcctgctggtgtggatcctgaccctgagtgacaccttcagccaggtgcccccagaggacaccagaattgatggcggccctgtgatcctgctgcaggccggcaccccccacaacctgacctgccgggccttcaatgccaagccagctgccaccatcatctggttcagagatggcacccagcaggagggcgctgtggccagcacagagctgctgaaggatggcaagcgggagaccaccgtgtcccagctgctgatcaaccccacagacctggacatcggccgggtcttcacctgccgctccatgaatgaggccatccccagcggcaaggagaccagcattgagctggatgtgcaccacccccccaccgtgaccctgagcattgagccccagacagtgcaggagggggagcgggtggtgttcacctgccaggccacagccaaccctgagatcctgggctaccgctgggccaagggcggcttcctgattgaagatgcccacgagagccgctatgagaccaacgtggactacagcttcttcacagagcctgtgtcctgtgaggtgcacaacaaggtgggcagcaccaacgtgtccaccctggtgaatgtgcactttgccccccgcatcgtggtggaccccaagcccaccaccacagacattggaagtgatgtgaccctgacctgtgtgtgggtgggcaacccccccctgaccctgacctggaccaagaaggacagcaacatggtgctgagcaacagcaaccagctgctgctgaagtctgtgacccaggctgatgctggcacctacacctgccgggccatcgtgccccgcatcggcgtggccgagcgggaggtgcccctgtatgtgaatggcccccccatcatcagcagcgaggccgtgcagtatgctgtgagaggagatggcggcaaggtggagtgcttcatcggcagcaccccacctccagaccgcatcgcctgggcctggaaggagaacttcctggaggtgggcaccctggagcgctacacagtggagaggaccaacagcggcagcggcgtgctgagcaccctgaccatcaacaacgtgatggaggccgacttccagacccactacaactgcacagcctggaacagctttggacctggaacagccatcatccagctggaggagcgggaggtgctgcctgtgggcatcatcgccggggccaccatcggggccagcatcctgctgatcttcttcttcatcgccctggtgttcttcctgtacagaagaaggaagggcagcaggaaggatgtgaccctgaggaagctggacatcaaggtggagaccgtgaaccgggagcccctgaccatgcacagcgacagagaagatgacacagcctctgtgtccacagccaccagggtgatgaaggccatctacagcagcttcaaggatgatgtggacctgaagcaggacctgcgctgtgacaccatcgacacccgggaggagtatgagatgaaggaccccaccaacggctactacaacgtgcgggcccacgaggaccggcccagcagcagagctgtgctgtatgctgactaccgggcccctggccctgccaggtttgatggccggcccagcagccggctgagccacagcagcggctacgcccagctgaacacctacagccggggccctgccagtgactatggccctgagcccaccccacctggccctgctgccccagctggaacagacaccaccagccagctgtcctatgaaaattatgagaagttcaacagccaccccttccctggagctgctggctaccccacctaccgcctgggctacccccaggccccacccagcggcctggagaggaccccctatgaggcctatgaccccatcggcaagtatgccacagccacccgcttctcctacaccagccagcacagcgactatggccagcgcttccagcagaggatgcagacccacgtgtag

SEQ ID NO: 34931 - DNA, 5316 bp, Artificial Sequence
  Description of Artificial Sequence: Synthetic coding sequence
atgtctgtgctgatcagccagagcgtcatcaactacgtggaggaggagaacatcccagccctgaaggccctgctggagaagtgcaaggatgtggatgaaagaaatgaatgtggccagacccccctgatgattgctgctgagcagggcaacctggagatcgtgaaggagctgatcaagaatggagccaactgcaacctggaggacctggacaactggacagccctgatcagcgccagcaaggagggccacgtgcacatcgtggaggagctgctgaagtgtggggtgaacctggagcaccgggacatgggcggctggacagccctgatgtgggcctgctacaagggccgcacagatgtggtggagctgctgctgagccacggggccaaccccagcgtgacaggcctgtacagcgtgtaccccatcatctgggccgccggccggggccacgccgacatcgtgcacctgctgctgcagaatggagccaaggtgaactgcagcgacaagtatggcaccacccccctggtgtgggccgccaggaagggccacctggagtgtgtgaagcacctgctggccatgggcgcagatgtggaccaggagggcgccaacagcatgacagccctgattgtggccgtgaagggcggctacacccagagcgtgaaggagatcctgaagaggaaccccaacgtgaacctgacagacaaggatggcaacacagccctgatgattgccagcaaggagggccacacagaaattgtgcaggacctgctggatgctggcacctacgtgaacatcccagacagaagtggggacacagtgctgattggagctgtgcggggcggccacgtggagatcgtgcgggccctgctgcagaagtatgctgacatcgacatccggggccaggacaacaagacagccctgtactgggccgtggagaagggaaatgccaccatggtgcgggacatcctgcagtgcaacccagacacagagatctgcaccaaggatggagagacccccctcatcaaggccaccaagatgaggaacatcgaggtggtggagctgctgctggacaagggggccaaggtgtctgctgtggacaagaagggggacacccccctgcacatcgccatccggggccgcagcaggaagctggccgagctgctgctgaggaaccccaaggatggccgcctgctgtaccggcccaacaaggccggggagaccccctacaacatcgactgcagccaccagaagagcatcctgacccagatctttggagcccggcacctgagccccacagaaacagatggagacatgctgggctatgacctgtacagcagcgccctggccgacatcctgtctgagcccaccatgcagccccccatctgtgtgggcctgtatgcccagtggggcagcggcaagagcttcctgctgaagaagctggaggatgagatgaagacctttgctggccagcagatcgagcccctcttccagttctcctggctgattgtgttcctgaccctgctgctgtgtggcggcctgggcctgctgtttgccttcaccgtgcaccccaacctgggcattgctgtgtccctgtccttcctggccctgctgtacatcttcttcatcgtcatctactttggaggccggcgggagggggagagctggaactgggcctgggtgctgagcacccggctggcccggcacatcggctacctggagctgctgctgaagctgatgtttgtgaaccccccagagctgcctgagcagaccaccaaggccctgcctgtgcgcttcctgttcacagactacaaccggctgagctctgtgggcggggagaccagcctggccgagatgattgccaccctgagtgatgcctgtgagcgggagtttggcttcctggccaccaggctcttccgggtcttcaagacagaggacacccagggcaagaagaagtggaagaagacctgctgcctgcccagctttgtgatcttcctgttcatcatcggctgcatcatcagcggcatcaccctgctggccatcttccgggtggaccccaagcacctgactgtgaatgctgtgctgatcagcatcgcctctgtggtgggcctggcctttgtgctgaactgcaggacctggtggcaggtgctggacagcctgctgaacagccagaggaagaggctgcacaatgctgccagcaagctgcacaagctgaagtctgagggcttcatgaaggtgctgaagtgtgaggtggagctgatggccaggatggccaagaccatcgacagcttcacccagaaccagacccggctggtggtgatcattgatggcctggatgcctgtgagcaggacaaggtgctgcagatgctggacacagtgcgggtgctcttcagcaagggccccttcatcgccatctttgccagtgacccccacatcatcatcaaggccatcaaccagaacctgaacagcgtgctgcgggacagcaacatcaatggacatgactacatgagaaatattgtgcacctgcctgtgttcctgaacagccggggcctgagcaatgccaggaagttcctggtgaccagcgccaccaatggagatgtgccctgcagcgacaccaccggcatccaggaggatgctgacagaagagtgtcccagaacagcctgggggagatgaccaagctgggcagcaagacagccctgaacagaagagacacctacagaagacggcagatgcagaggaccatcacccggcagatgagctttgacctgaccaagctgctggtgacagaggactggttcagtgacatcagcccccagaccatgaggcggctgctgaacatcgtgtctgtgacaggccgcctgctgcgggccaaccagatctccttcaactgggaccggctggcctcctggatcaacctgacagagcagtggccctaccgcacctcctggctgatcctgtacctggaggagacagagggcatcccagaccagatgaccctgaagaccatctatgaaagaatcagcaagaacatccccaccaccaaggatgtggagcccctgctggagattgatggagacatccggaactttgaggtgttcctgagcagcaggacccctgtgctggtggccagagatgtgaaggtgttcctgccctgcaccgtgaacctggaccccaagctgcgggagatcatcgcagatgtgcgggccgcccgggagcagatcagcatcggcggcctggcctacccacccctgcccctgcacgagggccccccccgggcccccagcggctacagccagccccccagcgtgtgcagcagcaccagcttcaacggcccctttgctgggggcgtggtgagcccccagccccacagcagctactacagcggcatgacaggcccccagcaccccttctacaaccggcccttctttgccccctacctgtacaccccccgctactacccaggcggcagccagcacctgatcagccggcccagcgtgaagaccagcctgccccgggaccagaacaacggcctggaggtgatcaaggaggatgctgctgagggcctgagcagccccacagacagcagccggggcagcggccctgcccctggccctgtggtgctgctgaacagcctgaatgtggatgctgtgtgtgagaagctgaagcagatcgagggcctggaccagagcatgctgccccagtactgcaccaccatcaagaaggccaacatcaatggccgggtgctggcccagtgcaacattgatgagctgaagaaggagatgaacatgaactttggagactggcacctgttccgcagcacagtgctggagatgagaaatgctgagagccacgtggtgcctgaggacccccgcttcctgtctgagagcagcagcggccctgcccctcatggagagcccgcccggcgggccagccacaatgagctgccccacacagagctgagcagccagaccccctacaccctgaacttctcctttgaggagctgaacaccctgggcctggatgaaggagcccccaggcacagcaacctgtcctggcagagccagaccaggaggacccccagcctgagcagcctgaacagccaggacagcagcattgagatcagcaagctgacagacaaggtgcaggccgagtacagagatgcctaccgggagtacatcgcccagatgagccagctggagggcggccctggcagcaccaccatcagcggccgcagcagcccccacagcacctactacatgggccagagcagcagcggcggcagcatccacagcaacctggagcaggagaagggcaaggacagcgagcccaagccagatgatggcaggaagagcttcctgatgaagagaggagatgtgattgactacagcagcagtggagtgtccaccaatgatgccagccccctggaccccatcacagaagaagatgagaagagtgaccagagcggcagcaagctgctgcccgggaagaagagcagcgagaggagcagcctcttccagacagacctgaagctgaagggcagcggcctgcgctaccagaagctgcccagtgatgaagatgagagcggcacagaggagagtgacaacacccccctgctgaaggatgacaaggacaggaaggccgagggcaaggtggagcgggtgcccaagagccctgagcacagcgctgagcccatccgcaccttcatcaaggccaaggagtacctgagtgatgccctgctggacaagaaggacagcagtgacagcggcgtgcgcagcagcgagagcagccccaaccacagcctgcacaatgaggtggctgatgacagccagctggagaaggccaacctgattgagctggaggatgacagccacagcggcaagaggggcatcccccacagcctgagcggcctgcaggaccccatcatcgccaggatgagcatctgcagcgaggacaagaagagccccagtgaatgttccctgattgccagcagccctgaggagaactggccagcctgccagaaggcctacaacctgaacagaacacccagcacagtgaccctgaacaacaacagcgccccagccaacagagccaaccagaactttgatgagatggagggcatccgggagaccagccaggtgatcctgcggcccagcagcagccccaaccccaccaccatccagaatgaaaacctgaagtccatgacccacaagaggagccagaggagcagctacacccggctgagcaaggaccccccagagctgcacgccgccgccagcagcgagagcactggatttggagaggagcgggagagcatcctgtag

SEQ ID NO: 34932 - DNA, 3096 bp, Artificial Sequence
  Description of Artificial Sequence: Synthetic coding sequence
atgtctgtgctgatcagccagagcgtcatcaactacgtggaggaggagaacatcccagccctgaaggccctgctggagaagtgcaaggatgtggatgaaagaaatgaatgtggccagacccccctgatgattgctgctgagcagggcaacctggagatcgtgaaggagctgatcaagaatggagccaactgcaacctggaggacctggacaactggacagccctgatcagcgccagcaaggagggccacgtgcacatcgtggaggagctgctgaagtgtggggtgaacctggagcaccgggacatgggcggctggacagccctgatgtgggcctgctacaagggccgcacagatgtggtggagctgctgctgagccacggggccaaccccagcgtgacaggcctgcagtacagcgtgtaccccatcatctgggccgccggccggggccatgctgacatcgtgcacctgctgctgcagaatggagccaaggtgaactgcagcgacaagtatggcaccacccccctggtgtgggccgccaggaagggccacctggagtgtgtgaagcacctgctggccatgggcgcagatgtggaccaggagggcgccaacagcatgacagccctgattgtggccgtgaagggcggctacacccagagcgtgaaggagatcctgaagaggaaccccaacgtgaacctgacagacaaggatggcaacacagccctgatgattgccagcaaggagggccacacagagatcgtgcaggacctgctggatgctggcacctacgtgaacatcccagacagaagtggggacacagtgctgattggagctgtgcggggcggccacgtggagatcgtgcgggccctgctgcagaagtatgctgacatcgacatccggggccaggacaacaagacagccctgtactgggccgtggagaagggaaatgccaccatggtgcgggacatcctgcagtgcaacccagacacagagatctgcaccaaggatggagagacccccctcatcaaggccaccaagatgagaaatattgaggtggtggagctgctgctggacaagggggccaaggtgtctgctgtggacaagaagggggacacccccctgcacatcgccatccggggccgcagcaggaagctggccgagctgctgctgaggaaccccaaggatggccgcctgctgtaccggcccaacaaggccggggagaccccctacaacatcgactgcagccaccagaagagcatcctgacccagatctttggagcccggcacctgagccccacagaaacagatggagacatgctgggctatgacctgtacagcagcgccctggccgacatcctgtctgagcccaccatgcagccccccatctgtgtgggcctgtatgcccagtggggcagcggcaagagcttcctgctgaagaagctggaggatgagatgaagacctttgctggccagcagatcgagcccctcttccagttctcctggctgattgtgttcctgaccctgctgctgtgtggcggcctgggcctgctgtttgccttcaccgtgcaccccaacctgggcattgctgtgtccctgtccttcctggccctgctgtacatcttcttcatcgtcatctactttggaggaagaagagaaggagagagctggaactgggcctgggtgctgagcacccggctggcccggcacatcggctacctggagctgctgctgaagctgatgtttgtgaaccccccagagctgcctgagcagaccaccaaggccctgcctgtgcgcttcctgttcacagactacaaccggctgagctctgtgggcggggagaccagcctggccgagatgattgccaccctgagtgatgcctgtgagcgggagtttggcttcctggccaccaggctcttccgggtcttcaagacagaggacacccagggcaagaagaagtggaagaagacctgctgcctgcccagctttgtgatcttcctgttcatcatcggctgcatcatcagcggcatcaccctgctggccatcttccgggtggaccccaagcacctgactgtgaatgctgtgctgatcagcatcgcctctgtggtgggcctggcctttgtgctgaactgcaggacctggtggcaggtgctggacagcctgctgaacagccagaggaagaggctgcacaatgctgccagcaagctgcacaagctgaagtctgagggcttcatgaaggtgctgaagtgtgaggtggagctgatggccaggatggccaagaccatcgacagcttcacccagaaccagacccggctggtggtgatcattgatggcctggatgcctgtgagcaggacaaggtgctgcagatgctggacacagtgcgggtgctcttcagcaagggccccttcatcgccatctttgccagtgacccccacatcatcatcaaggccatcaaccagaacctgaacagcgtgctgcgggacagcaacatcaatggacatgactacatgaggaacatcgtgcacctgcccgtcttcctgaacagccggggcctgagcaatgccaggaagttcctggtgaccagcgccaccaatggagatgtgccctgcagcgacaccaccggcatccaggaggatgctgaccggcgggtgtcccagaacagcctgggggagatgaccaagctgggcagcaagacagccctgaacagaagagacacctacagaagacggcagatgcagaggaccatcacccggcagatgagctttgacctgaccaagctgctggtgacagaggactggttcagtgacatcagcccccagaccatgaggcggctgctgaacatcgtgtctgtgacaggccgcctgctgcgggccaaccagatctccttcaactgggaccggctggcctcctggatcaacctgacagagcagtggccctaccgcacctcctggctgatcctgtacctggaggagacagagggcatcccagaccagatgaccctgaagaccatctatgagcgctgctgcggggctgacagctgtgaccgggacagaattggcatcagcaagtctgtgctggtggccatgctgatggagagctag

SEQ ID NO: 34933 - DNA, 5019 bp, Artificial Sequence
  Description of Artificial Sequence: Synthetic coding sequence
atgattgctgctgagcagggcaacctggagatcgtgaaggagctgatcaagaatggagccaactgcaacctggaggacctggacaactggacagccctgatcagcgccagcaaggagggccacgtgcacatcgtggaggagctgctgaagtgtggggtgaacctggagcaccgggacatgggcggctggacagccctgatgtgggcctgctacaagggccgcacagatgtggtggagctgctgctgagccacggggccaaccccagcgtgacaggcctgtacagcgtgtaccccatcatctgggccgccggccggggccacgccgacatcgtgcacctgctgctgcagaatggagccaaggtgaactgcagcgacaagtatggcaccacccccctggtgtgggccgccaggaagggccacctggagtgtgtgaagcacctgctggccatgggcgcagatgtggaccaggagggcgccaacagcatgacagccctgattgtggccgtgaagggcggctacacccagagcgtgaaggagatcctgaagaggaaccccaacgtgaacctgacagacaaggatggcaacacagccctgatgattgccagcaaggagggccacacagaaattgtgcaggacctgctggatgctggcacctacgtgaacatcccagacagaagtggggacacagtgctgattggagctgtgcggggcggccacgtggagatcgtgcgggccctgctgcagaagtatgctgacatcgacatccggggccaggacaacaagacagccctgtactgggccgtggagaagggaaatgccaccatggtgcgggacatcctgcagtgcaacccagacacagagatctgcaccaaggatggagagacccccctcatcaaggccaccaagatgaggaacatcgaggtggtggagctgctgctggacaagggggccaaggtgtctgctgtggacaagaagggggacacccccctgcacatcgccatccggggccgcagcaggaagctggccgagctgctgctgaggaaccccaaggatggccgcctgctgtaccggcccaacaaggccggggagaccccctacaacatcgactgcagccaccagaagagcatcctgacccagatctttggagcccggcacctgagccccacagaaacagatggagacatgctgggctatgacctgtacagcagcgccctggccgacatcctgtctgagcccaccatgcagccccccatctgtgtgggcctgtatgcccagtggggcagcggcaagagcttcctgctgaagaagctggaggatgagatgaagacctttgctggccagcagatcgagcccctcttccagttctcctggctgattgtgttcctgaccctgctgctgtgtggcggcctgggcctgctgtttgccttcaccgtgcaccccaacctgggcattgctgtgtccctgtccttcctggccctgctgtacatcttcttcatcgtcatctactttggaggccggcgggagggggagagctggaactgggcctgggtgctgagcacccggctggcccggcacatcggctacctggagctgctgctgaagctgatgtttgtgaaccccccagagctgcctgagcagaccaccaaggccctgcctgtgcgcttcctgttcacagactacaaccggctgagctctgtgggcggggagaccagcctggccgagatgattgccaccctgagtgatgcctgtgagcgggagtttggcttcctggccaccaggctcttccgggtcttcaagacagaggacacccagggcaagaagaagtggaagaagacctgctgcctgcccagctttgtgatcttcctgttcatcatcggctgcatcatcagcggcatcaccctgctggccatcttccgggtggaccccaagcacctgactgtgaatgctgtgctgatcagcatcgcctctgtggtgggcctggcctttgtgctgaactgcaggacctggtggcaggtgctggacagcctgctgaacagccagaggaagaggctgcacaatgctgccagcaagctgcacaagctgaagtctgagggcttcatgaaggtgctgaagtgtgaggtggagctgatggccaggatggccaagaccatcgacagcttcacccagaaccagacccggctggtggtgatcattgatggcctggatgcctgtgagcaggacaaggtgctgcagatgctggacacagtgcgggtgctcttcagcaagggccccttcatcgccatctttgccagtgacccccacatcatcatcaaggccatcaaccagaacctgaacagcgtgctgcgggacagcaacatcaatggacatgactacatgagaaatattgtgcacctgcctgtgttcctgaacagccggggcctgagcaatgccaggaagttcctggtgaccagcgccaccaatggagatgtgccctgcagcgacaccaccggcatccaggaggatgctgacagaagagtgtcccagaacagcctgggggagatgaccaagctgggcagcaagacagccctgaacagaagagacacctacagaagacggcagatgcagaggaccatcacccggcagatgagctttgacctgaccaagctgctggtgacagaggactggttcagtgacatcagcccccagaccatgaggcggctgctgaacatcgtgtctgtgacaggccgcctgctgcgggccaaccagatctccttcaactgggaccggctggcctcctggatcaacctgacagagcagtggccctaccgcacctcctggctgatcctgtacctggaggagacagagggcatcccagaccagatgaccctgaagaccatctatgaaagaatcagcaagaacatccccaccaccaaggatgtggagcccctgctggagattgatggagacatccggaactttgaggtgttcctgagcagcaggacccctgtgctggtggccagagatgtgaaggtgttcctgccctgcaccgtgaacctggaccccaagctgcgggagatcatcgcagatgtgcgggccgcccgggagcagatcagcatcggcggcctggcctacccacccctgcccctgcacgagggccccccccgggcccccagcggctacagccagccccccagcgtgtgcagcagcaccagcttcaacggcccctttgctgggggcgtggtgagcccccagccccacagcagctactacagcggcatgacaggcccccagcaccccttctacaacagaggcagcggccctgcccctggccctgtggtgctgctgaacagcctgaatgtggatgctgtgtgtgagaagctgaagcagatcgagggcctggaccagagcatgctgccccagtactgcaccaccatcaagaaggccaacatcaatggccgggtgctggcccagtgcaacattgatgagctgaagaaggagatgaacatgaactttggagactggcacctgttccgcagcacagtgctggagatgagaaatgctgagagccacgtggtgcctgaggacccccgcttcctgtctgagagcagcagcggccctgccccccacggggagcccgcccggcgggccagccacaatgagctgccccacacagagctgagcagccagaccccctacaccctgaacttctcctttgaggagctgaacaccctgggcctggatgagggcgcccccaggcacagcaacctgtcctggcagagccagaccaggaggacccccagcctgagcagcctgaacagccaggacagcagcattgagatcagcaagctgacagacaaggtgcaggccgagtacagagatgcctaccgggagtacatcgcccagatgagccagctggagggcggccctggcagcaccaccatcagcggccgcagcagcccccacagcacctactacatgggccagagcagcagcggcggcagcatccacagcaacctggagcaggagaagggcaaggacagcgagcccaagccagatgatggcaggaagagcttcctgatgaagagaggagatgtgattgactacagcagcagcggcgtgtccaccaatgatgccagccccctggaccccatcacagaggaggatgagaagagtgaccagagcggcagcaagctgctgcccgggaagaagagcagcgagaggagcagcctcttccagacagacctgaagctgaagggcagcggcctgcgctaccagaagctgcccagtgatgaagatgaaagtggcacagaggagagtgacaacacccccctgctgaaggatgacaaggacaggaaggccgagggcaaggtggagcgggtgcccaagagccctgagcacagcgctgagcccatccgcaccttcatcaaggccaaggagtacctgagtgatgccctgctggacaagaaggacagcagtgacagcggcgtgcgcagcagcgagagcagccccaaccacagcctgcacaatgaggtggctgatgacagccagctggagaaggccaacctgattgagctggaggatgacagccacagcggcaagaggggcatcccccacagcctgagcggcctgcaggaccccatcatcgccaggatgagcatctgcagcgaggacaagaagagccccagcgagtgcagcctcatcgccagcagccctgaggagaactggccagcctgccagaaggcctacaacctgaacagaacacccagcacagtgaccctgaacaacaacagcgccccagccaacagagccaaccagaactttgatgagatggagggcatccgggagaccagccaggtgatcctgcggcccagcagcagccccaaccccaccaccatccagaatgaaaacctgaagtccatgacccacaagaggagccagaggagcagctacacccggctgagcaaggaccccccagagctgcatgctgctgccagcagcgagagcacaggctttggagaggagcgggagagcatcctgtag

SEQ ID NO: 34934 - DNA, 5259 bp, Artificial Sequence
  Description of Artificial Sequence: Synthetic coding sequence
atgtctgtgctgatcagccagagcgtcatcaactacgtggaggaggagaacatcccagccctgaaggccctgctggagaagtgcaaggatgtggatgaaagaaatgaatgtggccagacccccctgatgattgctgctgagcagggcaacctggagatcgtgaaggagctgatcaagaatggagccaactgcaacctggaggacctggacaactggacagccctgatcagcgccagcaaggagggccacgtgcacatcgtggaggagctgctgaagtgtggggtgaacctggagcaccgggacatgggcggctggacagccctgatgtgggcctgctacaagggccgcacagatgtggtggagctgctgctgagccacggggccaaccccagcgtgacaggcctgtacagcgtgtaccccatcatctgggccgccggccggggccacgccgacatcgtgcacctgctgctgcagaatggagccaaggtgaactgcagcgacaagtatggcaccacccccctggtgtgggccgccaggaagggccacctggagtgtgtgaagcacctgctggccatgggcgcagatgtggaccaggagggcgccaacagcatgacagccctgattgtggccgtgaagggcggctacacccagagcgtgaaggagatcctgaagaggaaccccaacgtgaacctgacagacaaggatggcaacacagccctgatgattgccagcaaggagggccacacagaaattgtgcaggacctgctggatgctggcacctacgtgaacatcccagacagaagtggggacacagtgctgattggagctgtgcggggcggccacgtggagatcgtgcgggccctgctgcagaagtatgctgacatcgacatccggggccaggacaacaagacagccctgtactgggccgtggagaagggaaatgccaccatggtgcgggacatcctgcagtgcaacccagacacagagatctgcaccaaggatggagagacccccctcatcaaggccaccaagatgaggaacatcgaggtggtggagctgctgctggacaagggggccaaggtgtctgctgtggacaagaagggggacacccccctgcacatcgccatccggggccgcagcaggaagctggccgagctgctgctgaggaaccccaaggatggccgcctgctgtaccggcccaacaaggccggggagaccccctacaacatcgactgcagccaccagaagagcatcctgacccagatctttggagcccggcacctgagccccacagaaacagatggagacatgctgggctatgacctgtacagcagcgccctggccgacatcctgtctgagcccaccatgcagccccccatctgtgtgggcctgtatgcccagtggggcagcggcaagagcttcctgctgaagaagctggaggatgagatgaagacctttgctggccagcagatcgagcccctcttccagttctcctggctgattgtgttcctgaccctgctgctgtgtggcggcctgggcctgctgtttgccttcaccgtgcaccccaacctgggcattgctgtgtccctgtccttcctggccctgctgtacatcttcttcatcgtcatctactttggaggccggcgggagggggagagctggaactgggcctgggtgctgagcacccggctggcccggcacatcggctacctggagctgctgctgaagctgatgtttgtgaaccccccagagctgcctgagcagaccaccaaggccctgcctgtgcgcttcctgttcacagactacaaccggctgagctctgtgggcggggagaccagcctggccgagatgattgccaccctgagtgatgcctgtgagcgggagtttggcttcctggccaccaggctcttccgggtcttcaagacagaggacacccagggcaagaagaagtggaagaagacctgctgcctgcccagctttgtgatcttcctgttcatcatcggctgcatcatcagcggcatcaccctgctggccatcttccgggtggaccccaagcacctgactgtgaatgctgtgctgatcagcatcgcctctgtggtgggcctggcctttgtgctgaactgcaggacctggtggcaggtgctggacagcctgctgaacagccagaggaagaggctgcacaatgctgccagcaagctgcacaagctgaagtctgagggcttcatgaaggtgctgaagtgtgaggtggagctgatggccaggatggccaagaccatcgacagcttcacccagaaccagacccggctggtggtgatcattgatggcctggatgcctgtgagcaggacaaggtgctgcagatgctggacacagtgcgggtgctcttcagcaagggccccttcatcgccatctttgccagtgacccccacatcatcatcaaggccatcaaccagaacctgaacagcgtgctgcgggacagcaacatcaatggacatgactacatgagaaatattgtgcacctgcctgtgttcctgaacagccggggcctgagcaatgccaggaagttcctggtgaccagcgccaccaatggagatgtgccctgcagcgacaccaccggcatccaggaggatgctgacagaagagtgtcccagaacagcctgggggagatgaccaagctgggcagcaagacagccctgaacagaagagacacctacagaagacggcagatgcagaggaccatcacccggcagatgagctttgacctgaccaagctgctggtgacagaggactggttcagtgacatcagcccccagaccatgaggcggctgctgaacatcgtgtctgtgacaggccgcctgctgcgggccaaccagatctccttcaactgggaccggctggcctcctggatcaacctgacagagcagtggccctaccgcacctcctggctgatcctgtacctggaggagacagagggcatcccagaccagatgaccctgaagaccatctatgaaagaatcagcaagaacatccccaccaccaaggatgtggagcccctgctggagattgatggagacatccggaactttgaggtgttcctgagcagcaggacccctgtgctggtggccagagatgtgaaggtgttcctgccctgcaccgtgaacctggaccccaagctgcgggagatcatcgcagatgtgcgggccgcccgggagcagatcagcatcggcggcctggcctacccacccctgcccctgcacgagggccccccccgggcccccagcggctacagccagccccccagcgtgtgcagcagcaccagcttcaacggcccctttgctgggggcgtggtgagcccccagccccacagcagctactacagcggcatgacaggcccccagcaccccttctacaaccggcccttctttgccccctacctgtacaccccccgctactacccaggcggcagccagcacctgatcagccggcccagcgtgaagaccagcctgccccgggaccagaacaacggcctgggcagcggccctgcccctggccctgtggtgctgctgaacagcctgaatgtggatgctgtgtgtgagaagctgaagcagatcgagggcctggaccagagcatgctgccccagtactgcaccaccatcaagaaggccaacatcaatggccgggtgctggcccagtgcaacattgatgagctgaagaaggagatgaacatgaactttggagactggcacctgttccgcagcacagtgctggagatgagaaatgctgagagccacgtggtgcctgaggacccccgcttcctgtctgagagcagcagcggccctgccccccacggggagcccgcccggcgggccagccacaatgagctgccccacacagagctgagcagccagaccccctacaccctgaacttctcctttgaggagctgaacaccctgggcctggatgagggcgcccccaggcacagcaacctgtcctggcagagccagaccaggaggacccccagcctgagcagcctgaacagccaggacagcagcattgagatcagcaagctgacagacaaggtgcaggccgagtacagagatgcctaccgggagtacatcgcccagatgagccagctggagggcggccctggcagcaccaccatcagcggccgcagcagcccccacagcacctactacatgggccagagcagcagcggcggcagcatccacagcaacctggagcaggagaagggcaaggacagcgagcccaagccagatgatggcaggaagagcttcctgatgaagagaggagatgtgattgactacagcagcagcggcgtgtccaccaatgatgccagccccctggaccccatcacagaggaggatgagaagagtgaccagagcggcagcaagctgctgcccgggaagaagagcagcgagaggagcagcctcttccagacagacctgaagctgaagggcagcggcctgcgctaccagaagctgcccagtgatgaagatgaaagtggcacagaggagagtgacaacacccccctgctgaaggatgacaaggacaggaaggccgagggcaaggtggagcgggtgcccaagagccctgagcacagcgctgagcccatccgcaccttcatcaaggccaaggagtacctgagtgatgccctgctggacaagaaggacagcagtgacagcggcgtgcgcagcagcgagagcagccccaaccacagcctgcacaatgaggtggctgatgacagccagctggagaaggccaacctgattgagctggaggatgacagccacagcggcaagaggggcatcccccacagcctgagcggcctgcaggaccccatcatcgccaggatgagcatctgcagcgaggacaagaagagccccagcgagtgcagcctcatcgccagcagccctgaggagaactggccagcctgccagaaggcctacaacctgaacagaacacccagcacagtgaccctgaacaacaacagcgccccagccaacagagccaaccagaactttgatgagatggagggcatccgggagaccagccaggtgatcctgcggcccagcagcagccccaaccccaccaccatccagaatgaaaacctgaagtccatgacccacaagaggagccagaggagcagctacacccggctgagcaaggaccccccagagctgcatgctgctgccagcagcgagagcacaggctttggagaggagcgggagagcatcctgtag

SEQ ID NO: 34935 - DNA, 5259 bp, Artificial Sequence; identical to SEQ ID NO: 34934
  Description of Artificial Sequence: Synthetic coding sequence

SEQ ID NO: 34936 - DNA, 2985 bp, Artificial Sequence
  Description of Artificial Sequence: Synthetic coding sequence
atggtgcgggacatcctgcagtgcaacccagacacagagatctgcaccaaggatggagagacccccctcatcaaggccaccaagatgaggaacatcgaggtggtggagctgctgctggacaagggggccaaggtgtctgctgtggacaagaagggggacacccccctgcacatcgccatccggggccgcagcaggaagctggccgagctgctgctgaggaaccccaaggatggccgcctgctgtaccggcccaacaaggccggggagaccccctacaacatcgactgcagccaccagaagagcatcctgacccagatctttggagcccggcacctgagccccacagaaacagatggagacatgctgggctatgacctgtacagcagcgccctggccgacatcctgtctgagcccaccatgcagccccccatctgtgtgggcctgtatgcccagtggggcagcggcaagagcttcctgctgaagaagctggaggatgagatgaagacctttgctggccagcagatcgagcccctcttccagttctcctggctgattgtgttcctgaccctgctgctgtgtggcggcctgggcctgctgtttgccttcaccgtgcaccccaacctgggcattgctgtgtccctgtccttcctggccctgctgtacatcttcttcatcgtcatctactttggaggccggcgggagggggagagctggaactgggcctgggtgctgagcacccggctggcccggcacatcggctacctggagctgctgctgaagctgatgtttgtgaaccccccagagctgcctgagcagaccaccaaggccctgcctgtgcgcttcctgttcacagactacaaccggctgagctctgtgggcggggagaccagcctggccgagatgattgccaccctgagtgatgcctgtgagcgggagtttggcttcctggccaccaggctcttccgggtcttcaagacagaggacacccagggcaagaagaagtggaagaagacctgctgcctgcccagctttgtgatcttcctgttcatcatcggctgcatcatcagcggcatcaccctgctggccatcttccgggtggaccccaagcacctgactgtgaatgctgtgctgatcagcatcgcctctgtggtgggcctggcctttgtgctgaactgcaggacctggtggcaggtgctggacagcctgctgaacagccagaggaagaggctgcacaatgctgccagcaagctgcacaagctgaagtctgagggcttcatgaaggtgctgaagtgtgaggtggagctgatggccaggatggccaagaccatcgacagcttcacccagaaccagacccggctggtggtgatcattgatggcctggatgcctgtgagcaggacaaggtgctgcagatgctggacacagtgcgggtgctcttcagcaagggccccttcatcgccatctttgccagtgacccccacatcatcatcaaggccatcaaccagaacctgaacagcgtgctgcgggacagcaacatcaatggacatgactacatgagaaatattgtgcacctgcctgtgttcctgaacagccggggcctgagcaatgccaggaagttcctggtgaccagcgccaccaatggagatgtgccctgcagcgacaccaccggcatccaggaggatgctgacagaagagtgtcccagaacagcctgggggagatgaccaagctgggcagcaagacagccctgaacagaagagacacctacagaagacggcagatgcagaggaccatcacccggcagatgagctttgacctgaccaagctgctggtgacagaggactggttcagtgacatcagcccccagaccatgaggcggctgctgaacatcgtgtctgtgacaggccgcctgctgcgggccaaccagatctccttcaactgggaccggctggcctcctggatcaacctgacagagcagtggccctaccgcacctcctggctgatcctgtacctggaggagacagagggcatcccagaccagatgaccctgaagaccatctatgaaagaatcagcaagaacatccccaccaccaaggatgtggagcccctgctggagattgatggagacatccggaactttgaggtgttcctgagcagcaggacccctgtgctggtggccagagatgtgaaggtgttcctgccctgcaccgtgaacctggaccccaagctgcgggagatcatcgcagatgtgcgggccgcccgggagcagatcagcatcggcggcctggcctacccacccctgcccctgcacgagggccccccccgggcccccagcggctacagccagccccccagcgtgtgcagcagcaccagcttcaacggcccctttgctgggggcgtggtgagcccccagccccacagcagctactacagcggcatgacaggcccccagcaccccttctacaacagaggcagcggccctgcccctggccctgtggtgctgctgaacagcctgaatgtggatgctgtgtgtgagaagctgaagcagatcgagggcctggaccagagcatgctgccccagtactgcaccaccatcaagaaggccaacatcaatggccgggtgctggcccagtgcaacattgatgagctgaagaaggagatgaacatgaactttggagactggcacctgttccgcagcacagtgctggagatgagaaatgctgagagccacgtggtgcctgaggacccccgcttcctgtctgagagcagcagcggccctgccccccacggggagcccgcccggcgggccagccacaatgagctgccccacacagagctgagcagccagaccccctacaccctgaacttctcctttgaggagctgaacaccctgggcctggatgagggcgcccccaggcacagcaacctgtcctggcaggaggagaatgccggcctggagattgacagcagcagtgaagatcctgactag

SEQ ID NO: 34937 - DNA, 3954 bp, Artificial Sequence
  Description of Artificial Sequence: Synthetic coding sequence
atggcctctgtgaaggtggccgtgcgggtgcggcccatgaacagaagagagaaggacctggaggccaagttcatcatccagatggagaagagcaagaccaccatcaccaacctgaagatccctgagggcggcactggagacagcggccgggagaggaccaagaccttcacctatgacttctccttctacagcgctgacaccaagagcccagactatgtgtcccaggagatggtgttcaagaccctgggcacagatgtggtgaagagcgcctttgagggctacaatgcctgtgtgtttgcctacggccagacaggcagcggcaagagctacaccatgatgggcaacagcggggacagcggcctcatcccccgcatctgtgagggcctcttcagccgcatcaatgagaccacccgctgggatgaggccagcttcagaacagaggtgtcctacctggagatctacaatgaaagagtgcgggacctgctgcggaggaagagcagcaagaccttcaacctgcgggtgcgggagcaccccaaggagggcccctacgtggaggacctgagcaagcacctggtgcagaactatggagatgtggaggagctgatggatgctggcaacatcaacagaaccacagctgccaccggcatgaatgatgtgagcagccgcagccacgccatcttcaccatcaagttcacccaggccaagtttgacagcgagatgccctgtgagaccgtgtccaagatccacctggtggacctggccggcagcgagcgggcagatgccaccggggccactggagtgcggctgaaggagggcggcaacatcaacaagagcctggtgaccctgggcaatgtcatcagcgccctggccgacctgagccaggatgctgccaacaccctggccaagaagaagcaggtgtttgtgccctacagagattctgtgctgacctggctgctgaaggacagcctgggcggcaacagcaagaccatcatgattgccaccatcagccctgcagatgtgaactacggggagaccctgagcaccctgcgctatgccaacagagccaagaacatcatcaacaagcccaccatcaatgaagatgccaacgtgaagctgatccgggagctgcgggcagagatcgcccggctgaagaccctgctggcccagggcaaccagatcgccctgctggacagccccacagccctgtccatggaggagaagctgcagcagaatgaggcccgggtgcaggagctgaccaaggagtggaccaacaagtggaatgagacccagaacatcctgaaggagcagaccctggccctgaggaaggagggcattggagtggtgctggacagcgagctgccccacctgattggaattgatgatgacctgctgagcacaggcatcatcctgtaccacctgaaggagggccagacctacgtgggcagagatgatgccagcacagagcaggacatcgtgctgcacggcctggacctggagagcgagcactgcatctttgagaacatcggcggcaccgtgaccctcatccccctgagcggcagccagtgcagcgtgaatggagtgcagatcgtggaggccacccacctgaaccagggcgctgtgatcctgctgggccgcaccaacatgttccgcttcaaccaccccaaggaggccgccaagctgcgggagaagaggaagagcggcctgctgagcagcttcagcctgtccatgacagacctgagcaagagccgggagaacctgtctgctgtgatgctgtacaaccctggcctggagtttgagcggcagcagcgggaggagctggagaagctggagagcaagaggaagctgattgaggagatggaggagaagcagaagagtgacaaggccgagctggagaggatgcagcaggaggtggagacccagaggaaggagacagagatcgtgcagctgcagatcaggaagcaggaggagagcctgaagaggaggagcttccacatcgagaacaagctgaaggacctgctggccgagaaggagaagtttgaggaggagcggctgcgggagcagcaggagattgagctgcagaagaagaggcaggaggaggagaccttcctgcgggtgcaggaggagctgcagaggctgaaggagctgaacaacaatgagaaggccgagaagttccagatcttccaggagctggaccagctgcagaaggagaaggatgagcagtatgccaagctggagctggagaagaagaggctggaggagcaggagaaggagcaggtgatgctggtggcccacctggaggagcagctgcgggagaagcaggagatgatccagctgctgcggcggggggaggtgcagtgggtggaggaggagaagagggacctggagggcatccgggagagcctgctgcgggtgaaggaggcccgggctggaggagatgaagatggagaggagctggagaaggcccagctgcgcttctttgagttcaagaggcggcagctggtgaagctggtgaacctggagaaggacctggtgcagcagaaggacatcctgaagaaggaggtgcaggaggagcaggagatcctggagtgcctgaagtgtgaacatgacaaggagagccggctgctggagaagcatgatgaatctgtgacagatgtgacagaggtgccccaggactttgagaagatcaagcctgtggagtaccgcctgcagtacaaggagcggcagctgcagtacctgctgcagaaccacctgcccaccctgctggaggagaagcagagggcctttgagatcctggaccggggccccctgagcctggacaacaccctgtaccaggtggagaaggagatggaggagaaggaggagcagctggcccagtaccaggccaatgccaaccagctgcagaagctgcaggccacctttgagttcaccgccaacatcgcccggcaggaggagaaggtgaggaagaaggagaaggagatcctggagagccgggagaagcagcagcgggaggccctggagcgggccctggcccggctggagcggcggcacagcgccctgcagaggcacagcaccctgggcatggagattgaggagcagaggcagaagctggccagcctgaacagcggcagccgggagcagagcggcctgcaggccagcctggaggccgagcaggaggccctggagaaggaccaggagcggctggagtatgagatccagcagctgaagcagaagatctatgaggtggatggagtgcagaaggaccaccacggcaccctggagggcaaggtggccagcagcagcctgcctgtgtctgctgagaagagccacctggtgcccctgatggatgcccgcatcaatgcctacatcgaggaggaggtgcagaggcggctgcaggacctgcacagggtcatcagcgagggctgcagcaccagcgctgacaccatgaaggacaatgagaagctgcacaacggcaccatccagaggaagctgaagtatgaaagaatggtgagccgcagcctgggcgccaacccagatgacctgaaggaccccatcaagatcagcatccccaggtatgtgctgtgtggccagggcaaggatgcccactttgaatttgaggtgaagatcaccgtgctggatgagacctggacagtgttccgccgctacagccgcttccgggagatgcacaagaccctgaagctgaagtatgcagagctggccgccctggagttcccccccaagaagctgtttggaaacaaggatgagcgggtgattgctgagcggcgcagccacctggagaagtacctgcgggacttcttctctgtgatgctgcagagcgccaccagccccctgcacatcaacaaggtgggcctgaccctgagcaagcacaccatctgtgagttcagccccttcttcaagaagggcgtgtttgactacagcagccacggcaccggctag

SEQ ID NO: 34938 - DNA, 3864 bp, Artificial Sequence
  Description of Artificial Sequence: Synthetic coding sequence
atggcctctgtgaaggtggccgtgcgggtgcggcccatgaacagaagagagaaggacctggaggccaagttcatcatccagatggagaagagcaagaccaccatcaccaacctgaagatccctgagggcggcactggagacagcggccgggagaggaccaagaccttcacctatgacttctccttctacagcgctgacaccaagagcccagactatgtgtcccaggagatggtgttcaagaccctgggcacagatgtggtgaagagcgcctttgagggctacaatgcctgtgtgtttgcctacggccagacaggcagcggcaagagctacaccatgatgggcaacagcggggacagcggcctcatcccccgcatctgtgagggcctcttcagccgcatcaatgagaccacccgctgggatgaggccagcttcagaacagaggtgtcctacctggagatctacaatgaaagagtgcgggacctgctgcggaggaagagcagcaagaccttcaacctgcgggtgcgggagcaccccaaggagggcccctacgtggaggacctgagcaagcacctggtgcagaactatggagatgtggaggagctgatggatgctggcaacatcaacagaaccacagctgccaccggcatgaatgatgtgagcagccgcagccacgccatcttcaccatcaagttcacccaggccaagtttgacagcgagatgccctgtgagaccgtgtccaagatccacctggtggacctggccggcagcgagcgggcagatgccaccggggccactggagtgcggctgaaggagggcggcaacatcaacaagagcctggtgaccctgggcaatgtcatcagcgccctggccgacctgagccaggatgctgccaacaccctggccaagaagaagcaggtgtttgtgccctacagagattctgtgctgacctggctgctgaaggacagcctgggcggcaacagcaagaccatcatgattgccaccatcagccctgcagatgtgaactacggggagaccctgagcaccctgcgctatgccaacagagccaagaacatcatcaacaagcccaccatcaatgaagatgccaacgtgaagctgatccgggagctgcgggcagagatcgcccggctgaagaccctgctggcccagggcaaccagatcgccctgctggacagccccacagccctgtccatggaggagaagctgcagcagaatgaggcccgggtgcaggagctgaccaaggagtggaccaacaagtggaatgagacccagaacatcctgaaggagcagaccctggccctgaggaaggagggcattggagtggtgctggacagcgagctgccccacctgattggaattgatgatgacctgctgagcacaggcatcatcctgtaccacctgaaggagggccagacctacgtgggcagagatgatgccagcacagagcaggacatcgtgctgcacggcctggacctggagagcgagcactgcatctttgagaacatcggcggcaccgtgaccctcatccccctgagcggcagccagtgcagcgtgaatggagtgcagatcgtggaggccacccacctgaaccagggcgctgtgatcctgctgggccgcaccaacatgttccgcttcaaccaccccaaggaggccgccaagctgcgggagaagaggaagagcggcctgctgagcagcttcagcctgtccatgacagacctgagcaagagccgggagaacctgtctgctgtgatgctgtacaaccctggcctggagtttgagcggcagcagcgggaggagctggagaagctggagagcaagaggaagctgattgaggagatggaggagaagcagaagagtgacaaggccgagctggagaggatgcagcaggaggtggagacccagaggaaggagacagagatcgtgcagctgcagatcaggaagcaggaggagagcctgaagaggaggagcttccacatcgagaacaagctgaaggacctgctggccgagaaggagaagtttgaggaggagcggctgcgggagcagcaggagattgagctgcagaagaagaggcaggaggaggagaccttcctgcgggtgcaggaggagctgcagaggctgaaggagctgaacaacaatgagaaggccgagaagttccagatcttccaggagctggaccagctgcagaaggagaaggatgagcagtatgccaagctggagctggagaagaagaggctggaggagcaggagaaggagcaggtgatgctggtggcccacctggaggagcagctgcgggagaagcaggagatgatccagctgctgcggcggggggaggtgcagtgggtggaggaggagaagagggacctggagggcatccgggagagcctgctgcgggtgaaggaggcccgggctggaggagatgaagatggagaggagctggagaaggcccagctgcgcttctttgagttcaagaggcggcagctggtgaagctggtgaacctggagaaggacctggtgcagcagaaggacatcctgaagaaggaggtgcaggaggagcaggagatcctggagtgcctgaagtgtgaacatgacaaggagagccggctgctggagaagcatgatgaatctgtgacagatgtgacagaggtgccccaggactttgagaagatcaagcctgtggagtaccgcctgcagtacaaggagcggcagctgcagtacctgctgcagaaccacctgcccaccctgctggaggagaagcagagggcctttgagatcctggaccggggccccctgagcctggacaacaccctgtaccaggtggagaaggagatggaggagaaggaggagcagctggcccagtaccaggccaatgccaaccagctgcagaagctgcaggccacctttgagttcaccgccaacatcgcccggcaggaggagaaggtgaggaagaaggagaaggagatcctggagagccgggagaagcagcagcgggaggccctggagcgggccctggcccggctggagcggcggcacagcgccctgcagaggcacagcaccctgggcatggagattgaggagcagaggcagaagctggccagcctgaacagcggcagccgggagcagagcggcctgcaggccagcctggaggccgagcaggaggccctggagaaggaccaggagcggctggagtatgagatccagcagctgaagcagaagatctatgaggtggatggagtgcagaaggaccaccacggcaccctggagggcaaggtggccagcagcagcctgcctgtgtctgctgagaagagccacctggtgcccctgatggatgcccgcatcaatgcctacatcgaggaggaggtgcagaggcggctgcaggacctgcacagggtcatcagcgagggctgcagcaccagcgctgacaccatgaaggacaatgagaagctgcacaacggcaccatccagaggaagctgaagtatgaaagaatggtgagccgcagcctgggcgccaacccagatgacctgaaggaccccatcaagatcagcatccccaggtatgtgctgtgtggccagggcaaggatgcccactttgaatttgaggtgaagctggccgccctggagttcccccccaagaagctgtttggaaacaaggatgagcgggtgattgctgagcggcgcagccacctggagaagtacctgcgggacttcttctctgtgatgctgcagagcgccaccagccccctgcacatcaacaaggtgggcctgaccctgagcaagcacaccatctgtgagttcagccccttcttcaagaagggcgtgtttgactacagcagccacggcaccggctag

SEQ ID NO: 34939 - DNA, 3486 bp, Artificial Sequence
  Description of Artificial Sequence: Synthetic coding sequence
atggcctctgtgaaggtggccgtgcgggtgcggcccatgaacagaagagagaaggacctggaggccaagttcatcatccagatggagaagagcaagaccaccatcaccaacctgaagatccctgagggcggcactggagacagcggccgggagaggaccaagaccttcacctatgacttctccttctacagcgctgacaccaagagcccagactatgtgtcccaggagatggtgttcaagaccctgggcacagatgtggtgaagagcgcctttgagggctacaatgcctgtgtgtttgcctacggccagacaggcagcggcaagagctacaccatgatgggcaacagcggggacagcggcctcatcccccgcatctgtgagggcctcttcagccgcatcaatgagaccacccgctgggatgaggccagcttcagaacagaggtgtcctacctggagatctacaatgaaagagtgcgggacctgctgcggaggaagagcagcaagaccttcaacctgcgggtgcgggagcaccccaaggagggcccctacgtggaggacctgagcaagcacctggtgcagaactatggagatgtggaggagctgatggatgctggcaacatcaacagaaccacagctgccaccggcatgaatgatgtgagcagccgcagccacgccatcttcaccatcaagttcacccaggccaagtttgacagcgagatgccctgtgagaccgtgtccaagatccacctggtggacctggccggcagcgagcgggcagatgccaccggggccactggagtgcggctgaaggagggcggcaacatcaacaagagcctggtgaccctgggcaatgtcatcagcgccctggccgacctgagccaggatgctgccaacaccctggccaagaagaagcaggtgtttgtgccctacagagattctgtgctgacctggctgctgaaggacagcctgggcggcaacagcaagaccatcatgattgccaccatcagccctgcagatgtgaactacggggagaccctgagcaccctgcgctatgccaacagagccaagaacatcatcaacaagcccaccatcaatgaagatgccaacgtgaagctgatccgggagctgcgggcagagatcgcccggctgaagaccctgctggcccagggcaaccagatcgccctgctggacagccccacagccctgtccatggaggagaagctgcagcagaatgaggcccgggtgcaggagctgaccaaggagtggaccaacaagtggaatgagacccagaacatcctgaaggagcagaccctggccctgaggaaggagggcattggagtggtgctggacagcgagctgccccacctgattggaattgatgatgacctgctgagcacaggcatcatcctgtaccacctgaaggagggccagacctacgtgggcagagatgatgccagcacagagcaggacatcgtgctgcacggcctggacctggagagcgagcactgcatctttgagaacatcggcggcaccgtgaccctcatccccctgagcggcagccagtgcagcgtgaatggagtgcagatcgtggaggccacccacctgaaccagggcgctgtgatcctgctgggccgcaccaacatgttccgcttcaaccaccccaaggaggccgccaagctgcgggagaagaggaagagcggcctgctgagcagcttcagcctgtccatgacagacctgagcaagagccgggagaacctgtctgctgtgatgctgtacaaccctggcctggagtttgagcggcagcagcgggaggagctggagaagctggagagcaagaggaagctgattgaggagatggaggagaagcagaagagtgacaaggccgagctggagaggatgcagcaggaggtggagacccagaggaaggagacagagatcgtgcagctgcagatcaggaagcaggaggagagcctgaagaggaggagcttccacatcgagaacaagctgaaggacctgctggccgagaaggagaagtttgaggaggagcggctgaaggacctggtgcagcagaaggacatcctgaagaaggaggtgcaggaggagcaggagatcctggagtgcctgaagtgtgaacatgacaaggagagccggctgctggagaagcatgatgaatctgtgacagatgtgacagaggtgccccaggactttgagaagatcaagcctgtggagtaccgcctgcagtacaaggagcggcagctgcagtacctgctgcagaaccacctgcccaccctgctggaggagaagcagagggcctttgagatcctggaccggggccccctgagcctggacaacaccctgtaccaggtggagaaggagatggaggagaaggaggagcagctggcccagtaccaggccaatgccaaccagctgcagaagctgcaggccacctttgagttcaccgccaacatcgcccggcaggaggagaaggtgaggaagaaggagaaggagatcctggagagccgggagaagcagcagcgggaggccctggagcgggccctggcccggctggagcggcggcacagcgccctgcagaggcacagcaccctgggcatggagattgaggagcagaggcagaagctggccagcctgaacagcggcagccgggagcagagcggcctgcaggccagcctggaggccgagcaggaggccctggagaaggaccaggagcggctggagtatgagatccagcagctgaagcagaagatctatgaggtggatggagtgcagaaggaccaccacggcaccctggagggcaaggtggccagcagcagcctgcctgtgtctgctgagaagagccacctggtgcccctgatggatgcccgcatcaatgcctacatcgaggaggaggtgcagaggcggctgcaggacctgcacagggtcatcagcgagggctgcagcaccagcgctgacaccatgaaggacaatgagaagctgcacaacggcaccatccagaggaagctgaagtatgaaagaatggtgagccgcagcctgggcgccaacccagatgacctgaaggaccccatcaagatcagcatccccaggtatgtgctgtgtggccagggcaaggatgcccactttgaatttgaggtgaagatcaccgtgctggatgagacctggacagtgttccgccgctacagccgcttccgggagatgcacaagaccctgaagctgaagtatgcagagctggccgccctggagttcccccccaagaagctgtttggaaacaaggatgagcgggtgattgctgagcggcgcagccacctggagaagtacctgcgggacttcttctctgtgatgctgcagagcgccaccagccccctgcacatcaacaaggtgggcctgaccctgagcaagcacaccatctgtgagttcagccccttcttcaagaagggcgtgtttgactacagcagccacggcaccggctag

SEQ ID NO: 34940 - DNA, 1509 bp, Artificial Sequence
  Description of Artificial Sequence: Synthetic coding sequence
atgatccagctgctgcggcggggggaggtgcagtgggtggaggaggagaagagggacctggagggcatccgggagagcctgctgcgggtgaaggaggcccgggctggaggagatgaagatggagaggagctggagaaggcccagctgcgcttctttgagttcaagaggcggcagctggtgaagctggtgaacctggagaaggacctggtgcagcagaaggacatcctgaagaaggaggtgcaggaggagcaggagatcctggagtgcctgaagtgtgaacatgacaaggagagccggctgctggagaagcatgatgaatctgtgacagatgtgacagaggtgccccaggactttgagaagatcaagcctgtggagtaccgcctgcagtacaaggagcggcagctgcagtacctgctgcagaaccacctgcccaccctgctggaggagaagcagagggcctttgagatcctggaccggggccccctgagcctggacaacaccctgtaccaggtggagaaggagatggaggagaaggaggagcagctggcccagtaccaggccaatgccaaccagctgcagaagctgcaggccacctttgagttcaccgccaacatcgcccggcaggaggagaaggtgaggaagaaggagaaggagatcctggagagccgggagaagcagcagcgggaggccctggagcgggccctggcccggctggagcggcggcacagcgccctgcagaggcacagcaccctgggcatggagattgaggagcagaggcagaagctggccagcctgaacagcggcagccgggagcagagcggcctgcaggccagcctggaggccgagcaggaggccctggagaaggaccaggagcggctggagtatgagatccagcagctgaagcagaagatctatgaggtggatggagtgcagaaggaccaccacggcaccctggagggcaaggtggccagcagcagcctgcctgtgtctgctgagaagagccacctggtgcccctgatggatgcccgcatcaatgcctacatcgaggaggaggtgcagaggcggctgcaggacctgcacagggtcatcagcgagggctgcagcaccagcgctgacaccatgaaggacaatgagaagctgcacaacggcaccatccagaggaagctgaagtatgagatcaccgtgctggatgagacctggacagtgttccgccgctacagccgcttccgggagatgcacaagaccctgaagctgaagtatgcagagctggccgccctggagttcccccccaagaagctgtttggaaacaaggatgagcgggtgattgctgagaggaggagccacctggagaagtacctgcgggacttcttctctgtgatgctgcagagcgccaccagccccctgcacatcaacaaggtgggcctgaccctgagcaagcacaccatctgtgagttcagccccttcttcaagaagggcgtgtttgactacagcagccatggaactggatag

SEQ ID NO: 34941 - DNA, 4179 bp, Artificial Sequence
  Description of Artificial Sequence: Synthetic coding sequence
atggcctctgtgaaggtggccgtgcgggtgcggcccatgaacagaagagagaaggacctggaggccaagttcatcatccagatggagaagagcaagaccaccatcaccaacctgaagatccctgagggcggcactggagacagcggccgggagaggaccaagaccttcacctatgacttctccttctacagcgctgacaccaagagcccagactatgtgtcccaggagatggtgttcaagaccctgggcacagatgtggtgaagagcgcctttgagggctacaatgcctgtgtgtttgcctacggccagacaggcagcggcaagagctacaccatgatgggcaacagcggggacagcggcctcatcccccgcatctgtgagggcctcttcagccgcatcaatgagaccacccgctgggatgaggccagcttcagaacagaggtgtcctacctggagatctacaatgaaagagtgcgggacctgctgcggaggaagagcagcaagaccttcaacctgcgggtgcgggagcaccccaaggagggcccctacgtggaggacctgagcaagcacctggtgcagaactatggagatgtggaggagctgatggatgctggcaacatcaacagaaccacagctgccaccggcatgaatgatgtgagcagccgcagccacgccatcttcaccatcaagttcacccaggccaagtttgacagcgagatgccctgtgagaccgtgtccaagatccacctggtggacctggccggcagcgagcgggcagatgccaccggggccactggagtgcggctgaaggagggcggcaacatcaacaagagcctggtgaccctgggcaatgtcatcagcgccctggccgacctgagccaggatgctgccaacaccctggccaagaagaagcaggtgtttgtgccctacagagattctgtgctgacctggctgctgaaggacagcctgggcggcaacagcaagaccatcatgattgccaccatcagccctgcagatgtgaactacggggagaccctgagcaccctgcgctatgccaacagagccaagaacatcatcaacaagcccaccatcaatgaagatgccaacgtgaagctgatccgggagctgcgggcagagatcgcccggctgaagaccctgctggcccagggcaaccagatcgccctgctggacagccccacagccctgtccatggaggagaagctgcagcagaatgaggcccgggtgcaggagctgaccaaggagtggaccaacaagtggaatgagacccagaacatcctgaaggagcagaccctggccctgaggaaggagggcattggagtggtgctggacagcgagctgccccacctgattggaattgatgatgacctgctgagcacaggcatcatcctgtaccacctgaaggagggccagacctacgtgggcagagatgatgccagcacagagcaggacatcgtgctgcacggcctggacctggagagcgagcactgcatctttgagaacatcggcggcaccgtgaccctcatccccctgagcggcagccagtgcagcgtgaatggagtgcagatcgtggaggccacccacctgaaccagggcgctgtgatcctgctgggccgcaccaacatgttccgcttcaaccaccccaaggaggccgccaagctgcgggagaagaggaagagcggcctgctgagcagcttcagcctgtccatgacagacctgagcaagagccgggagaacctgtctgctgtgatgctgtacaaccctggcctggagtttgagcggcagcagcgggaggagctggagaagctggagagcaagaggaagctgattgaggagatggaggagaagcagaagagtgacaaggccgagctggagaggatgcagcaggaggtggagacccagaggaaggagacagagatcgtgcagctgcagatcaggaagcaggaggagagcctgaagaggaggagcttccacatcgagaacaagctgaaggacctgctggccgagaaggagaagtttgaggaggagcggctgcgggagcagcaggagattgagctgcagaagaagaggcaggaggaggagaccttcctgcgggtgcaggaggagctgcagaggctgaaggagctgaacaacaatgagaaggccgagaagttccagatcttccaggagctggaccagctgcagaaggagaaggatgagcagtatgccaagctggagctggagaagaagaggctggaggagcaggagaaggagcaggtgatgctggtggcccacctggaggagcagctgcgggagaagcaggagatgatccagctgctgcggcggggggaggtgcagtgggtggaggaggagaagagggacctggagggcatccgggagagcctgctgcgggtgaaggaggcccgggctggaggagatgaagatggagaggagctggagaaggcccagctgcgcttctttgagttcaagaggcggcagctggtgaagctggtgaacctggagaaggacctggtgcagcagaaggacatcctgaagaaggaggtgcaggaggagcaggagatcctggagtgcctgaagtgtgaacatgacaaggagagccggctgctggagaagcatgatgaatctgtgacagatgtgacagaggtgccccaggactttgagaagatcaagcctgtggagtaccgcctgcagtacaaggagcggcagctgcagtacctgctgcagaaccacctgcccaccctgctggaggagaagcagagggcctttgagatcctggaccggggccccctgagcctggacaacaccctgtaccaggtggagaaggagatggaggagaaggaggagcagctggcccagtaccaggccaatgccaaccagctgcagaagctgcaggccacctttgagttcaccgccaacatcgcccggcaggaggagaaggtgaggaagaaggagaaggagatcctggagagccgggagaagcagcagcgggaggccctggagcgggccctggcccggctggagcggcggcacagcgccctgcagaggcacagcaccctgggcatggagattgaggagcagaggcagaagctggccagcctgaacagcggcagccgggagcagagcggcctgcaggccagcctggaggccgagcaggaggccctggagaaggaccaggagcggctggagtatgagatccagcagctgaagcagaagatctatgaggtggatggagtgcagaaggaccaccacggcaccctggagggcaaggtggccagcagcagcctgcctgtgtctgctgagaagagccacctggtgcccctgatggatgcccgcatcaatgcctacatcgaggaggaggtgcagaggcggctgcaggacctgcacagggtcatcagcgagggctgcagcaccagcgctgacaccatgaaggacaatgagaagctgcacaacggcaccatccagaggaagctgaagtatgagctgtgccgggacctgctgtgtgtgctgatgcctgagccagatgctgctgcctgtgccaaccaccccctgctgcagcaggacctggtgcagctgagcctggactggaagacagagatcccagacctggtgctgcccaacggggtgcaggtgagcagcaagttccagaccaccctggtggacatgatctacttcctgcacggcaacatggaggtgaatgtgcccagcctggccgaggtgcagctgctgctgtacaccaccgtgaaggtgatgggagacagcggccatgaccagtgccagagcctggtgctgctgaacacccacatcgccctggtgaaggaggactgtgtgttctacccccgcatccgcagcaggaacatccccccacctggggcccagtttgatgtgatcaagtgccacgccctgtctgagttccgctgtgtggtggtgcctgagaagaagaatgtgtccacagtggagctggtgttcctgcagaagctgaagcccagcgtgggcagcaggaacagccccccagagcacctgcaggaggccccaaatgtgcagctgttcaccacccccctgtacctgcagggcagccagaatgtggcccctgaggtgtggaagctgaccttcaacagccaggatgaggccctgtggctgatcagccacctgacccggctgtag

SEQ ID NO: 34942 - DNA, 2697 bp, Artificial Sequence
  Description of Artificial Sequence: Synthetic coding sequence
atgtctgtgacagaggaggacctgtgccaccacatgaaggtggtggtgcgggtgcggcctgagaacaccaaggagaaggccgccggcttccacaaggtggtgcacgtggtggacaagcacatcctggtgtttgaccccaagcaggaggaggtgtccttcttccacggcaagaagaccaccaaccagaatgtcatcaagaagcagaacaaggacctgaagtttgtgtttgatgctgtgtttgatgagaccagcacccagagcgaggtgtttgagcacaccaccaagcccatcctgcggagcttcctgaatggctacaactgcaccgtgctggcctacggggccactggagctgggaagacccacaccatgctgggcagcgcagatgagcccggggtgatgtacctgaccatgctgcacctgtacaagtgcatggatgagatcaaggaggagaagatctgcagcacagctgtgtcctacctggaggtgtacaatgagcagatccgggacctgctggtgaacagcggccccctggccgtgcgggaggacacccagaagggcgtggtggtgcacggcctgaccctgcaccagcccaagagcagcgaggagatcctgcacctgctggacaatggaaacaagaacagaacccagcaccccacagacatgaatgccaccagcagccgcagccatgctgtgttccagatctacctgcggcagcaggacaagacagccagcatcaaccagaatgtgagaattgccaagatgagcctgattgacctggccggcagcgagcgggccagcaccagcggggccaagggcaccaggtttgtggagggcaccaacatcaacagaagcctgctggccctgggcaatgtcatcaatgccctggccgacagcaagaggaagaaccagcacatcccctacagaaacagcaagctgacccggctgctgaaggacagcctgggcggcaactgccagaccatcatgattgctgctgtgagccccagcagcgtcttctatgatgacacctacaacaccctgaagtatgccaacagagccaaggacatcaagagcagcctgaagagcaatgtgctgaatgtgaacaaccacatcacccagtatgtgaagatctgcaatgagcagaaggccgagatcctgctgctgaaggagaagctgaaggcctatgaggagcagaaggccttcaccaatgaaaatgaccaggccaagctgatgatcagcaacccccaggagaaggagattgagcgcttccaggagatcctgaactgcctcttccagaaccgggaggagatccggcaggagtacctgaagctggagatgctgctgaaggaaaatgagctgaagagcttctaccagcagcagtgccacaagcagatcgagatgatgtgcagcgaggacaaggtggagaaggccaccgggaagagggaccaccggctggccatgctgaagacccggcgcagctacctggagaagagaagagaggaggagctgaagcagtttgatgagaacaccaactggctgcaccgggtggagaaggagatgggcctgctgagccagaatggccacatccccaaggagctgaagaaggacctgcactgccaccacctgcacctgcagaacaaggacctgaaggcccagatccgccacatgatggacctggcctgcctgcaggagcagcagcaccggcagacagaagctgtgctgaatgccctgctgcccaccctgaggaagcagtactgcaccctgaaggaggccggcctgagcaatgctgcctttgaaagtgacttcaaggagattgagcacctggtggagaggaagaaggtggtggtgtgggccgaccagacagctgagcagcccaagcagaatgacctgcccggcatctctgtgctgatgaccttcccccagctgggccctgtgcagcccatcccctgctgcagcagcagcggcggcaccaacctggtgaagatccccacagagaagaggaccaggaggaagctgatgcccagccccctgaagggccagcacaccctgaagagcccccccagccagagcgtgcagctgaatgacagcctgagcaaggagctgcagcccatcgtgtacaccccagaggactgcaggaaggccttccagaaccccagcacagtgaccctgatgaagcccagcagcttcaccaccagcttccaggccatcagcagcaacatcaacagcgacaactgcctgaagatgctgtgtgaggtggccatcccccacaacagaagaaaagaatgtggccaggaggacctggacagcaccttcaccatctgtgaggacatcaagagcagcaagtgcaagctgcctgagcaggagagcctgcccaatgacaacaaggacatcctgcagaggctggaccccagcagcttcagcaccaagcacagcatgcctgtgcccagcatggtgcccagctacatggccatgaccacagctgccaagaggaagaggaagctgaccagcagcaccagcaacagcagcctgacagcagatgtgaacagcggctttgccaagagggtgcggcaggacaacagcagcgagaagcacctgcaggagaacaagcccaccatggagcacaagaggaacatctgcaagatcaaccccagcatggtgaggaagtttggaagaaacatcagcaagggcaacctgaggtag

SEQ ID NO: 34943 - DNA, 1479 bp, Artificial Sequence
  Description of Artificial Sequence: Synthetic coding sequence
atggcccctcctgctgcccggctggccctgctgtctgctgctgccctgaccctggccgcccggcctgcccccagccctggcctgggccctggccctgagtgcttcaccgccaacggggctgactaccggggcacccagaactggacagccctgcagggcggcaagccctgcctcttctggaatgagaccttccagcacccctacaacaccctgaagtacccaaatggagagggcggcctgggggagcacaactactgcagaaatccagatggagatgtgagcccctggtgctacgtggccgagcatgaagatggagtgtactggaagtactgtgagatcccagcctgccagatgcctggcaacctgggctgctacaaggaccacggcaaccccccacccctgaccggcaccagcaagaccagcaacaagctgaccatccagacctgcatctccttctgccgcagccagcgcttcaagtttgctggcatggagagcggctacgcctgcttctgtggcaacaacccagactactggaagtacggggaggccgccagcacagagtgcaacagcgtgtgctttggagaccacacccagccctgtggaggagatggccgcatcatcctgtttgacaccctggtgggcgcctgtggcggcaactacagcgccatgagctctgtggtgtacagcccagacttcccagacacctacgccaccggccgggtgtgctactggaccatccgggtgcctggggccagccacatccacttctccttccccctgtttgacatccgggacagcgctgacatggtggagctgctggatggctacacccaccgggtgctggcccgcttccacggccgcagccggccccccctgtccttcaacgtgtccctggactttgtgatcctgtacttcttcagtgaccgcatcaaccaggcccagggctttgctgtgctgtaccaggccgtgaaggaggagctgccccaggagaggcctgctgtgaaccagacagtggccgaggtgatcacagagcaggccaacctgtctgtgtctgctgcccggagcagcaaggtgctgtatgtgatcaccaccagccccagccaccccccccagacagtgcccggcagcaacagctgggccccacccatgggcgccggcagccaccgggtggagggctggacagtgtatggcctggccaccctgctgatcctgactgtgacagccatcgtggccaagatcctgctgcacgtgaccttcaagagccaccgggtgcctgccagcggggacctgcgggactgccaccagcccggcaccagcggggagatctggagcatcttctacaagcccagcaccagcatcagcatcttcaagaagaagctgaagggccagagccagcaggatgacaggaaccccctggccatccaggacagcgaggtgaccagcctcatctggagccagggccagcccaggagcatctag

SEQ ID NO: 34944 - DNA, 1377 bp, Artificial Sequence
  Description of Artificial Sequence: Synthetic coding sequence
atggcccctcctgctgcccggctggccctgctgtctgctgctgccctgaccctggccgcccggcctgcccccagccctggcctgggccctggccctgagtgcttcaccgccaacggggctgactaccggggcacccagaactggacagccctgcagggcggcaagccctgcctcttctggaatgagaccttccagcacccctacaacaccctgaagtacccaaatggagagggcggcctgggggagcacaactactgcagaaatccagatggagatgtgagcccctggtgctacgtggccgagcatgaagatggagtgtactggaagtactgtgagatcccagcctgccagatgcctggcaacctgggctgctacaaggaccacggcaaccccccacccctgaccggcaccagcaagaccagcaacaagctgaccatccagacctgcatctccttctgccgcagccagcgcttcaagtttgctggcatggagagcggctacgcctgcttctgtggcaacaacccagactactggaagtacggggaggccgccagcacagagtgcaacagcgtgtgctttggagaccacacccagccctgtggaggagatggccgcatcatcctgtttgacaccctggtgggcgcctgtggcggcaactacagcgccatgagctctgtggtgtacagcccagacttcccagacacctacgccaccggccgggtgtgctactggaccatccgggtgcctggggccagccacatccacttctccttccccctgtttgacatccgggacagcgctgacatggtggagctgctggatggctacacccaccgggtgctggcccgcttccacggccgcagccggccccccctgtccttcaacgtgtccctggactttgtgatcctgtacttcttcagtgaccgcatcaaccaggcccagggctttgctgtgctgtaccaggccgtgaaggaggagctgccccaggagaggcctgctgtgaaccagacagtggccgaggtgatcacagagcaggccaacctgtctgtgtctgctgcccggagcagcaaggtgctgtatgtgatcaccaccagccccagccaccccccccagacagtgcccggctggacagtgtatggcctggccaccctgctgatcctgactgtgacagccatcgtggccaagatcctgctgcacgtgaccttcaagagccaccgggtgcctgccagcggggacctgcgggactgccaccagcccggcaccagcggggagatctggagcatcttctacaagcccagcaccagcatcagcatcttcaagaagaagctgaagggccagagccagcaggatgacaggaaccccctggtgtctgactag

SEQ ID NO: 34945 - DNA, 1428 bp, Artificial Sequence
  Description of Artificial Sequence: Synthetic coding sequence
atggcccctcctgctgcccggctggccctgctgtctgctgctgccctgaccctggccgcccggcctgcccccagccctggcctgggccctggccctgagtgcttcaccgccaacggggctgactaccggggcacccagaactggacagccctgcagggcggcaagccctgcctcttctggaatgagaccttccagcacccctacaacaccctgaagtacccaaatggagagggcggcctgggggagcacaactactgcagaaatccagatggagatgtgagcccctggtgctacgtggccgagcatgaagatggagtgtactggaagtactgtgagatcccagcctgccagatgcctggcaacctgggctgctacaaggaccacggcaaccccccacccctgaccggcaccagcaagaccagcaacaagctgaccatccagacctgcatctccttctgccgcagccagcgcttcaagtttgctggcatggagagcggctacgcctgcttctgtggcaacaacccagactactggaagtacggggaggccgccagcacagagtgcaacagcgtgtgctttggagaccacacccagccctgtggaggagatggccgcatcatcctgtttgacaccctggtgggcgcctgtggcggcaactacagcgccatgagctctgtggtgtacagcccagacttcccagacacctacgccaccggccgggtgtgctactggaccatccgggtgcctggggccagccacatccacttctccttccccctgtttgacatccgggacagcgctgacatggtggagctgctggatggctacacccaccgggtgctggcccgcttccacggccgcagccggccccccctgtccttcaacgtgtccctggactttgtgatcctgtacttcttcagtgaccgcatcaaccaggcccagggctttgctgtgctgtaccaggccgtgaaggaggagctgccccaggagaggcctgctgtgaaccagacagtggccgaggtgatcacagagcaggccaacctgtctgtgtctgctgcccggagcagcaaggtgctgtatgtgatcaccaccagccccagccaccccccccagacagtgcccggcagcaacagctgggccccacccatgggcgccggcagccaccgggtggagggctggacagtgtatggcctggccaccctgctgatcctgactgtgacagccatcgtggccaagatcctgctgcacgtgaccttcaagagccaccgggtgcctgccagcggggacctgcgggactgccaccagcccggcaccagcggggagatctggagcatcttctacaagcccagcaccagcatcagcatcttcaagaagaagctgaagggccagagccagcaggatgacaggaaccccctggtgtctgactag

SEQ ID NO: 34946 - DNA, 1422 bp, Artificial Sequence
  Description of Artificial Sequence: Synthetic coding sequence
atggcccctcctgctgcccggctggccctgctgtctgctgctgccctgaccctggccgcccggcctgcccccagccctggcctgggccctgagtgcttcaccgccaacggggctgactaccggggcacccagaactggacagccctgcagggcggcaagccctgcctcttctggaatgagaccttccagcacccctacaacaccctgaagtacccaaatggagagggcggcctgggggagcacaactactgcagaaatccagatggagatgtgagcccctggtgctacgtggccgagcatgaagatggagtgtactggaagtactgtgagatcccagcctgccagatgcctggcaacctgggctgctacaaggaccacggcaaccccccacccctgaccggcaccagcaagaccagcaacaagctgaccatccagacctgcatctccttctgccgcagccagcgcttcaagtttgctggcatggagagcggctacgcctgcttctgtggcaacaacccagactactggaagtacggggaggccgccagcacagagtgcaacagcgtgtgctttggagaccacacccagccctgtggaggagatggccgcatcatcctgtttgacaccctggtgggcgcctgtggcggcaactacagcgccatgagctctgtggtgtacagcccagacttcccagacacctacgccaccggccgggtgtgctactggaccatccgggtgcctggggccagccacatccacttctccttccccctgtttgacatccgggacagcgctgacatggtggagctgctggatggctacacccaccgggtgctggcccgcttccacggccgcagccggccccccctgtccttcaacgtgtccctggactttgtgatcctgtacttcttcagtgaccgcatcaaccaggcccagggctttgctgtgctgtaccaggccgtgaaggaggagctgccccaggagaggcctgctgtgaaccagacagtggccgaggtgatcacagagcaggccaacctgtctgtgtctgctgcccggagcagcaaggtgctgtatgtgatcaccaccagccccagccaccccccccagacagtgcccggcagcaacagctgggccccacccatgggcgccggcagccaccgggtggagggctggacagtgtatggcctggccaccctgctgatcctgactgtgacagccatcgtggccaagatcctgctgcacgtgaccttcaagagccaccgggtgcctgccagcggggacctgcgggactgccaccagcccggcaccagcggggagatctggagcatcttctacaagcccagcaccagcatcagcatcttcaagaagaagctgaagggccagagccagcaggatgacaggaaccccctggtgtctgactag

SEQ ID NO: 34947 - DNA, 867 bp, Artificial Sequence
  Description of Artificial Sequence: Synthetic coding sequence
atggctgctgtgctgcagagggtggagcggctgagcaacagagtggtgcgggtgctgggctgcaaccctggccccatgaccctgcagggcaccaacacctacctggtgggcaccggcccccggcgcatcctgattgacacaggagagcccgccatccctgagtacatcagctgcctgaagcaggccctgacagagttcaacacagccatccaggagatcgtggtgacccactggcaccgggaccacagcggcggcatcggggacatctgcaagagcatcaacaatgacaccacctactgcatcaagaagctgcccaggaacccccagcgggaggagatcattggaaatggagagcagcagtatgtgtacctgaaggatggagatgtgatcaagacagagggcgccaccctgcgggtgctgtacaccccaggccacacagatgaccacatggccctgctgctggaggaggagaatgccatcttcagcggggactgcatcctgggggagggcaccaccgtgtttgaggacctgtatgactacatgaacagcctgaaggagctgctgaagatcaaggctgacatcatctacccaggccacggccctgtgatccacaatgctgaggccaagatccagcagtacatcagccacaggaacatccgggagcagcagatcctgaccctcttccgggagaactttgagaagagcttcaccgtgatggagctggtgaagatcatctacaagaacaccccagagaacctgcacgagatggccaagcacaacctgctgctgcacctgaagaagctggagaaggagggcaagatcttcagcaacacagatcctgacaagaagtggaaggcccacctgtag

SEQ ID NO: 34948 - DNA, 867 bp, Artificial Sequence; identical to SEQ ID NO: 34947
  Description of Artificial Sequence: Synthetic coding sequence

SEQ ID NO: 34949 - DNA, 1704 bp, Artificial Sequence
  Description of Artificial Sequence: Synthetic coding sequence
atgaagcctgtgtgggtggccaccctgctgtggatgctgctgctggtgccccggctgggcgccgccaggaagggcagccctgaggaggccagcttctactacggcaccttccccctgggcttctcctggggcgtgggcagcagcgcctaccagacagagggcgcctgggaccaggacggcaagggccccagcatctgggatgtgttcacccacagcggcaagggcaaggtgctgggcaatgaaacagcagatgtggcctgtgatggctactacaaggtgcaggaggacatcatcctgctgcgggagctgcacgtgaaccactaccgcttcagcctgtcctggccccggctgctgcccaccggcatccgggcagagcaggtgaacaagaagggcatcgagttctacagcgacctgattgatgccctgctgagcagcaacatcacccccatcgtgaccctgcaccactgggacctgccccagctgctgcaggtgaagtatggaggctggcagaatgtgtccatggccaactacttccgggactatgccaacctgtgctttgaggcctttggagacagagtgaagcactggatcaccttcagtgacccccgggccatggccgagaagggctatgagaccggccaccacgcccctggcctgaagctgcggggcaccggcctgtacaaggccgcccaccacatcatcaaggcccacgccaaggcctggcacagctacaacaccacctggaggagcaagcagcagggcctggtgggcatcagcctgaactgtgactggggcgagcctgtggacatcagcaaccccaaggacctggaggccgctgagcgctacctgcagttctgcctgggctggtttgccaaccccatctatgctggggactacccccaggtgatgaaggactacatcggcaggaagtctgctgagcagggcctggagatgagccggctgcccgtcttcagcctgcaggagaagagctacatcaagggcaccagtgacttcctgggcctgggccacttcaccacccgctacatcacagagaggaactaccccagccggcagggccccagctaccagaatgaccgggacctgattgagctggtggaccccaactggccagacctgggcagcaagtggctgtacagcgtgccctggggcttccggcggctgctgaactttgcccagacccagtacggggacccccccatctacgtgatggagaatggagccagccagaagttccactgcacccagctgtgtgatgagtggaggatccagtacctgaagggctacatcaatgagatgctgaaggccatcaaggatggagccaacatcaagggctacacctcctggagcctgctggacaagtttgagtgggagaagggctacagcgacagatatggcttctactacgtggagttcaatgacaggaacaagccccgctaccccaaggcctctgtgcagtactacaagaagatcatcatcgccaacggcttccccaacccccgggaggtggagagctggtacctgaaggccctggagacctgcagcatcaacaaccagatgctggccgctgagcccctgctgagccacatgcagatggtgacagagatcgtggtgcccaccgtgtgcagcctgtgtgtgctgatcacagctgtgctgctgatgctgctgctgcggcggcagagctag

SEQ ID NO: 34950 - DNA, 1185 bp, Artificial Sequence
  Description of Artificial Sequence: Synthetic coding sequence
atggccaactacttccgggactatgccaacctgtgctttgaggccttcggggacagagtgaagcactggatcaccttcagtgacccccgggccatggccgagaagggctatgaaacaggccaccacgcccctggcctgaagctgcggggcaccggcctgtacaaggccgcccaccacatcatcaaggcccacgccaaggcctggcacagctacaacaccacctggaggagcaagcagcagggcctggtgggcatcagcctgaactgtgactggggcgagcctgtggacatcagcaaccccaaggacctggaggccgctgagcgctacctgcagttctgcctgggctggtttgccaaccccatctatgctggggactacccccaggtgatgaaggactacatcggcaggaagtctgctgagcagggcctggagatgagccggctgcctgtgttcagcctgcaggagaagagctacatcaagggcaccagtgacttcctgggcctgggccacttcaccacccgctacatcacagaaagaaactaccccagccggcagggccccagctaccagaatgaccgggacctgattgagctggtggaccccaactggccagacctgggcagcaagtggctgtacagcgtgccctggggcttccggcggctgctgaactttgcccagacccagtatggagacccccccatctacgtgatggagaatggagccagccagaagttccactgcacccagctgtgtgatgagtggaggatccagtacctgaagggctacatcaatgagatgctgaaggccatcaaggatggagccaacatcaagggctacacctcctggagcctgctggacaagtttgagtgggagaagggctacagcgacagatatggcttctactacgtggagttcaatgacaggaacaagccccgctaccccaaggcctctgtgcagtactacaagaagatcatcatcgccaacggcttccccaacccccgggaggtggagagctggtacctgaaggccctggagacctgcagcatcaacaaccagatgctggccgctgagcccctgctgagccacatgcagatggtgacagaaattgtggtgcccaccgtgtgcagcctgtgtgtgctgatcacagctgtgctgctgatgctgctgctgcggcggcagagctag

SEQ ID NO: 34951 - DNA, 1446 bp, Artificial Sequence
  Description of Artificial Sequence: Synthetic coding sequence
atggccgcctcctggagcctgctggtgaccctgcggcccctggcccagagccccctgcggggccgctgtgtgggctgtggggcctgggccgccgccctggcccccctggccacagcccctgggaagcccttctggaaggcctacacagtgcagaccagcgagagcatgacccccacagccaccagcgagacctacctgaaggccctggccgtgtgccacggccccctggaccactatgacttcctgatcaaggcccacgagctgaaggatgatgagcaccagaggagggtcatccagtgcctgcagaagctgcacgaggacctgaagggctacaacattgaagctgagggcctcttcagcaagctgttcagccgcagcaagccaccccggggcctgtatgtgtatggagatgtgggcaccgggaagaccatggtgatggacatgttctacgcctacgtggagatgaagaggaagaagagggtgcacttccacggcttcatgctggatgtgcacaagaggatccaccggctgaagcagagcctgcccaagaggaagccaggcttcatggccaagagctatgaccccatcgcccccatcgccgaggagatcagcgaggaggcctgcctgctgtgctttgatgagttccaggtgacagacattgctgatgccatgatcctgaagcagctgtttgaaaatctcttcaagaatggagtggtggtggtggccaccagcaacagacctccagaagatctctacaagaatggcctgcagagggccaactttgtgcccttcatcgctgtgctgaaggagtactgcaacacagtgcagctggacagcggcatcgactacaggaagcgggagctgcctgctgctgggaagctgtactacctgaccagcgaggctgatgtggaggccgtgatggacaagctgtttgatgagctggcccagaagcagaatgacctgacccggccccgcatcctgaaggtgcagggccgggagctgcggctgaacaaggcctgtggcaccgtggccgactgcacctttgaggagctgtgtgagcggcccctgggcgccagtgactacctggagctgagcaagaactttgacaccatcttcctgaggaacatcccccagttcaccctggccaacagaacccagggccgccgcttcatcaccctgattgacaacttctatgacctgaaggtgcgcatcatctgcagcgccagcacccccatcagcagcctcttcctgcaccagcaccatgattctgagctggagcagagccgcatcctgatggatgacctgggcctgagccaggacagcgctgagggcctgtccatgttcaccggggaggaggagatctttgccttccagaggaccatcagccggctgacagagatgcagacagagcagtactggaatgaaggagacaggaccaagaagtag

SEQ ID NO: 34952 - DNA, 486 bp, Artificial Sequence
  Description of Artificial Sequence: Synthetic coding sequence
atgggctgctgctacagcagtgaaaatgaagacagcgaccaggaccgggaggagaggaagctgctgctggaccccagcagcccccccaccaaggccctgaatggagctgagcccaactaccacagcctgcccagcgccaggacagatgagcaggccctgctgagcagcatcctggccaagacagccagcaacatcattgatgtgtctgctgctgacagccagggcatggagcagcacgagtacatggaccgggcccggcagtacagcacccggctggccgtgctgagcagcagcctgacccactggaagaagctgccccccctgcccagcctgaccagccagccccaccaggtgctggccagcgagcccatccccttcagtgacctgcagcaggtgtccagaattgctgcctatgcctacagcgccctgagccagatccgggtggatgccaaggaggagctggtggtgcagtttggcatcccctag

SEQ ID NO: 34953 - DNA, 453 bp, Artificial Sequence
  Description of Artificial Sequence: Synthetic coding sequence
atgctgcggcccaaggccctgacccaggtgctgagccaggccaacacaggaggagtgcagagcaccctgctgctgaacaatgaaggcagcctgctggcctacagcggctatggagacacagatgcccgggtgacagctgccatcgccagcaacatctgggccgcctatgacagaaatggaaaccaggccttcaatgaagacaacctgaagttcatcctgatggactgcatggagggccgggtggccatcaccagggtggccaacctgctgctgtgcatgtatgccaaggagaccgtgggcttcggcatgctgaaggccaaggctgtgtgtggcacagacctgtgcagccccagcgctggccctggctttggagctgtgcctggaggagccccccaccccagcggcggcatcctgacagccctggtggaggccggcgtgaggaaggagaagtag

SEQ ID NO: 34954 - DNA, 288 bp, Artificial Sequence
  Description of Artificial Sequence: Synthetic coding sequence
atgctgcggcccaaggccctgacccaggtgctgagccaggccaacacaggaggagtgcagagcaccctgctgctgaacaatgaaggcagcctgctggcctacagcggctatggagacacagatgcccgggtgacagctgccatcgccagcaacatctgggccgcctatgacagaaatggaaaccaggccttcaatgaagacaacctgaagttcatcctgatggactgcatggcccaggccctggtgcagtacctggaggagcccctgacccaggtggccgccagctag

SEQ ID NO: 34955 - DNA, 378 bp, Artificial Sequence
  Description of Artificial Sequence: Synthetic coding sequence
atgctgcggcccaaggccctgacccaggtgctgagccaggccaacacaggaggagtgcagagcaccctgctgctgaacaatgaaggcagcctgctggcctacagcggctatggagacacagatgcccgggtgacagctgccatcgccagcaacatctgggccgcctatgacagaaatggaaaccaggccttcaatgaagacaacctgaagttcatcctgatggactgcatggagggccgggtggccatcaccagggtggccaacctgctgctgtgcatgtatgccaaggagaccgtgggcttcggcatgctgaaggccaaggcccaggccctggtgcagtacctggaggagcccctgacccaggtggccgccagctag

SEQ ID NO: 34956 - DNA, 375 bp, Artificial Sequence
  Description of Artificial Sequence: Synthetic coding sequence
atggctgatgacctgaagcgcttcctgtacaagaagctgcccagcgtggagggcctgcacgccatcgtggtgtctgacagagatggagtgcctgtgatcaaggtggccaatgacaatgcccctgagcacgccctgcggcccggcttcctgagcacctttgccctggccacagaccagggcagcaagctgggcctgagcaagaacaagagcatcatctgctactacaacacctaccaggtggtgcagttcaaccggctgcccctggtggtgtccttcatcgccagcagcagcgccaacacaggcctgattgtgtccctggagaaggagctggcccccctgtttgaggagctgcggcaggtggtggaggtgtcctag

SEQ ID NO: 34957 - DNA, 4425 bp, Artificial Sequence
  Description of Artificial Sequence: Synthetic coding sequence
atggcccggctggccgctgtgctgtggaacctgtgtgtgacagctgtgctggtgaccagcgccacccagggcctgagccgggccggcctgcccttcggcctgatgaggcgggagctggcctgtgagggctaccccatcgagctgcgctgccccggcagtgatgtgatcatggtggagaatgccaactacggccgcacagatgacaagatctgtgatgctgaccccttccagatggagaatgtgcagtgctacctgcctgatgccttcaagatcatgagccagcgctgcaacaacagaacccagtgtgtggtggtggccggcagtgatgccttcccagacccctgccccggcacctacaagtacctggaggtgcagtatgactgtgtgccctacaaggtggagcagaaggtgtttgtgtgccccggcaccctgcagaaggtgctggagcccaccagcacccatgagagcgagcaccagagcggggcctggtgcaaggaccccctgcaggccggggaccgcatctacgtgatgccctggatcccctacagaacagacaccctgacagaatatgcctcctgggaggactatgtggccgcccggcacaccaccacctaccgcctgcccaacagagtggatggcaccggctttgtggtgtatgatggagctgtgttctacaacaaggagaggaccagaaatattgtgaagtatgacctgcggacccgcatcaagagcggggagaccgtcatcaacacagccaactaccatgacaccagcccctaccgctggggcggcaagacagacatcgacctggccgtggatgaaaatggcctgtgggtgatctatgccacagagggcaacaacggccgcctggtggtgtcccagctgaacccctacaccctgcgctttgagggcacctgggagaccggctatgacaagaggtctgccagcaatgccttcatggtgtgtggggtgctgtatgtgctgcggtctgtgtatgtggatgatgattctgaggccgccggcaacagagtggactatgccttcaacaccaatgccaaccgggaggagcctgtgtccctgaccttccccaacccctaccagttcatcagctctgtggactacaacccccgggacaaccagctgtatgtgtggaacaactactttgtggtgcgctacagcctggagtttggccccccagaccccagcgctggccctgccaccagcccccccctgagcaccaccaccacagcccggcccacccccctgaccagcacagccagccctgctgccaccacccccctgcggcgggcccccctgaccacccaccctgtgggcgccatcaaccagctgggccctgacctgcccccagccacagcccctgtgcccagcacccggcggcccccagcccccaacctgcacgtgtccccagagctgttctgtgagccccgggaggtgcggcgggtgcagtggccagccacccagcagggcatgctggtggagcggccctgccccaagggcacccggggcatcgccagcttccagtgcctgcctgccctgggcctgtggaacccccggggccctgacctgagcaactgcaccagcccctgggtgaaccaggtggcccagaagatcaagagcggggagaatgctgccaacatcgccagcgagctggcccggcacacccggggcagcatctatgctggagatgtgagcagctctgtgaagctgatggagcagctgctggacatcctggatgcccagctgcaggccctgcggcccatcgagcgggagagcgctgggaagaactacaacaagatgcacaagcgggagaggacctgcaaggactacatcaaggctgtggtggagaccgtggacaacctgctgcggcctgaggccctggagagctggaaggacatgaatgccacagagcaggtgcacacagccaccatgctgctggatgtgctggaggagggcgccttcctgctggccgacaacgtgcgggagcccgcccgcttcctggccgccaaggaaaatgtggtgctggaggtgacagtgctgaacacagagggccaggtgcaggagctggtgttcccccaggaggagtaccccaggaagaacagcatccagctgagcgccaagaccatcaagcagaacagcagaaatggagtggtgaaggtggtgttcatcctgtacaacaacctgggcctcttcctgagcacagaaaatgccaccgtgaagctggccggggaggccggccctgggggccctgggggcgccagcctggtggtgaacagccaggtgattgctgccagcatcaacaaggagagcagcagggtcttcctgatggaccccgtcatcttcaccgtggcccacctggaggacaagaaccacttcaatgccaactgcagcttctggaactacagcgagaggtccatgctgggctactggagcacccagggctgccgcctggtggagagcaacaagacccacaccacctgtgcctgcagccacctgaccaactttgctgtgctgatggcccaccgggagatctaccagggccgcatcaatgagctgctgctgagcgtcatcacctgggtgggcatcgtcatcagcctggtgtgcctggccatctgcatcagcaccttctgcttcctgcggggcctgcagacagacaggaacaccatccacaagaacctgtgcatcaacctcttcctggccgagctgctcttcctggtgggcatcgacaagacccagtatgaaattgcctgccccatctttgctggcctgctgcactacttcttcctggccgccttctcctggctgtgcctggagggcgtgcacctgtacctgctgctggtggaggtgtttgagagcgagtacagcaggaccaagtactactacctgggcggctactgcttccctgccctggtggtgggcattgctgctgccatcgactaccgctcctatggaacagagaaggcctgctggctgcgggtggacaactacttcatctggagcttcatcggccctgtgtcctttgtgattgtggtgaacctggtgttcctgatggtgaccctgcacaagatgatccgcagcagctctgtgctgaagccagacagcagccggctggacaacatcaagtcctgggccctgggcgccatcgccctgctcttcctgctgggcctgacctgggccttcggcctgctcttcatcaacaaggagagcgtggtgatggcctacctgttcaccaccttcaatgccttccagggcgtcttcatctttgtgttccactgtgccctgcagaagaaggtgcacaaggagtacagcaagtgcctgcggcacagctactgctgcatccgcagccccccaggcggcacccacggcagcctgaagaccagcgccatgaggagcaacacccgctactacacaggcacccagagccgcatccggaggatgtggaatgacacagtgaggaagcagacagagagcagcttcatggccggggacatcaacagcacccccaccctgaacagaggcaccatgggcaaccacctgctgaccaaccctgtgctgcagccccggggcggcaccagcccctacaacaccctgattgctgagagcgtgggcttcaaccccagcagcccccctgtgttcaacagccctggcagctaccgggagcccaagcaccccctgggcggccgggaggcctgtggcatggacaccctgcccctgaatggaaacttcaacaacagctacagcctgcggagcggggacttccccccaggagatggcggccctgagcccccccggggcaggaacctggctgatgctgctgcctttgagaagatgatcatcagcgagctggtgcacaacaacctgcggggcagcagcagcgctgccaagggccccccacctcctgagccccctgtgccccctgtgcctgggggcggcggggaggaggaggccggcggccctggaggagctgacagagctgagattgagctgctgtacaaggccctggaggagcccctgctgctgccccgggcccagagcgtgctgtaccagagcgacctggatgaaagtgagagctgcacagcagaagatggagccaccagccggcccctgagcagccccccaggccgggacagcctgtatgccagcggggccaacctgcgggacagccccagctacccagacagcagccctgagggccccagcgaggccctgcccccacctcctccagcccctcctggccccccagagatctactacaccagccggcccccagccctggtggccaggaaccccctgcagggctactaccaggtgcggcggcccagccatgagggctacctggccgcccctggcctggagggccctggcccagatggagatggccagatgcagctggtgaccagcctgtag

SEQ ID NO: 34958 - DNA, 4410 bp, Artificial Sequence
  Description of Artificial Sequence: Synthetic coding sequence
atggcccggctggccgctgtgctgtggaacctgtgtgtgacagctgtgctggtgaccagcgccacccagggcctgagccgggccggcctgcccttcggcctgatgaggcgggagctggcctgtgagggctaccccatcgagctgcgctgccccggcagtgatgtgatcatggtggagaatgccaactacggccgcacagatgacaagatctgtgatgctgaccccttccagatggagaatgtgcagtgctacctgcctgatgccttcaagatcatgagccagcgctgcaacaacagaacccagtgtgtggtggtggccggcagtgatgccttcccagacccctgccccggcacctacaagtacctggaggtgcagtatgactgtgtgccctacatctttgtgtgccccggcaccctgcagaaggtgctggagcccaccagcacccatgaaagtgagcaccagagcggggcctggtgcaaggaccccctgcaggccggggaccgcatctacgtgatgccctggatcccctacagaacagacaccctgacagaatatgcctcctgggaggactatgtggccgcccggcacaccaccacctaccgcctgcccaacagagtggatggcactggatttgtggtgtatgatggagctgtgttctacaacaaggagaggaccaggaacatcgtgaagtatgacctgcggacccgcatcaagtctggagagaccgtcatcaacacagccaactaccatgacaccagcccctaccgctggggcggcaagacagacatcgacctggccgtggatgaaaatggcctgtgggtgatctatgccacagagggcaacaacggccgcctggtggtgtcccagctgaacccctacaccctgcgctttgagggcacctgggagaccggctatgacaagaggtctgccagcaatgccttcatggtgtgtggggtgctgtatgtgctgcggtctgtgtatgtggatgatgacagcgaggccgccggcaacagagtggactatgccttcaacaccaatgccaaccgggaggagcctgtgtccctgaccttccccaacccctaccagttcatcagctctgtggactacaacccccgggacaaccagctgtatgtgtggaacaactactttgtggtgcgctacagcctggagtttggacctccagaccccagcgctggccctgccaccagcccccccctgagcaccaccaccacagcccggcccacccccctgaccagcacagccagccctgctgccaccacccccctgcggcgggcccccctgaccacccaccctgtgggcgccatcaaccagctgggccctgacctgcccccagccacagcccctgtgcccagcacccggcggcccccagcccccaacctgcacgtgtccccagagctgttctgtgagccccgggaggtgagaagagtgcagtggccagccacccagcagggcatgctggtggagcggccctgccccaagggcacccggggcatcgccagcttccagtgcctgcctgccctgggcctgtggaacccccggggccctgacctgagcaactgcaccagcccctgggtgaaccaggtggcccagaagatcaagtctggagaaaatgctgccaacatcgccagcgagctggcccggcacacccggggcagcatctatgctggagatgtgagcagctctgtgaagctgatggagcagctgctggacatcctggatgcccagctgcaggccctgcggcccatcgagcgggagagcgctgggaagaactacaacaagatgcacaagcgggagaggacctgcaaggactacatcaaggctgtggtggagaccgtggacaacctgctgcggcctgaggccctggagagctggaaggacatgaatgccacagagcaggtgcacacagccaccatgctgctggatgtgctggaggagggcgccttcctgctggccgacaacgtgcgggagcccgcccgcttcctggccgccaaggaaaatgtggtgctggaggtgacagtgctgaacacagagggccaggtgcaggagctggtgttcccccaggaggagtaccccaggaagaacagcatccagctgagcgccaagaccatcaagcagaacagcagaaatggagtggtgaaggtggtgttcatcctgtacaacaacctgggcctcttcctgagcacagaaaatgccaccgtgaagctggccggggaggccggccctgggggccctggaggagccagcctggtggtgaacagccaggtgattgctgccagcatcaacaaggagagcagcagggtcttcctgatggaccctgtgatcttcaccgtggcccacctggaggacaagaaccacttcaatgccaactgcagcttctggaactacagcgagaggtccatgctgggctactggagcacccagggctgccgcctggtggagagcaacaagacccacaccacctgtgcctgcagccacctgaccaactttgctgtgctgatggcccaccgggagatctaccagggccgcatcaatgagctgctgctgagcgtcatcacctgggtgggcatcgtcatcagcctggtgtgcctggccatctgcatcagcaccttctgcttcctgcggggcctgcagacagacaggaacaccatccacaagaacctgtgcatcaacctcttcctggccgagctgctcttcctggtgggcatcgacaagacccagtatgagatcgcctgccccatctttgctggcctgctgcactacttcttcctggccgccttctcctggctgtgcctggagggcgtgcacctgtacctgctgctggtggaggtgtttgaaagtgagtacagcaggaccaagtactactacctgggcggctactgcttccctgccctggtggtgggcattgctgctgccatcgactaccgctcctatggaacagagaaggcctgctggctgcgggtggacaactacttcatctggagcttcatcggccctgtgtcctttgtgattgtggtgaacctggtgttcctgatggtgaccctgcacaagatgatccgcagcagctctgtgctgaagccagacagcagccggctggacaacatcaagtcctgggccctgggcgccatcgccctgctcttcctgctgggcctgacctgggccttcggcctgctcttcatcaacaaggagagcgtggtgatggcctacctgttcaccaccttcaatgccttccagggcgtcttcatctttgtgttccactgtgccctgcagaagaaggtgcacaaggagtacagcaagtgcctgcggcacagctactgctgcatccgcagccccccaggcggcacccacggcagcctgaagaccagcgccatgaggagcaacacccgctactacacaggcacccagagccgcatccggaggatgtggaatgacacagtgaggaagcagacagagagcagcttcatggccggggacatcaacagcacccccaccctgaacagaggcaccatgggcaaccacctgctgaccaaccctgtgctgcagccccggggcggcaccagcccctacaacaccctgattgctgagagcgtgggcttcaaccccagcagcccccctgtgttcaacagccctggcagctaccgggagcccaagcaccccctgggcggccgggaggcctgtggcatggacaccctgcccctgaatggaaacttcaacaacagctacagcctgcggagcggggacttccccccaggagatggcggccctgagcccccccggggcaggaacctggctgatgctgctgcctttgagaagatgatcatcagcgagctggtgcacaacaacctgcggggcagcagcagcgctgccaagggccccccacctcctgagccccctgtgccccctgtgcctgggggcggcggggaggaggaggccggcggccctgggggcgctgacagagctgagattgagctgctgtacaaggccctggaggagcccctgctgctgccccgggcccagagcgtgctgtaccagagcgacctggatgagagcgagagctgcacagcagaagatggagccaccagccggcccctgagcagccccccaggccgggacagcctgtatgccagcggggccaacctgcgggacagccccagctacccagacagcagccctgagggccccagcgaggccctgcccccacctcctccagcccctcctggccccccagagatctactacaccagccggcccccagccctggtggccaggaaccccctgcagggctactaccaggtgagaagacccagccatgagggctacctggccgcccctggcctggagggccctggcccagatggagatggccagatgcagctggtgaccagcctgtag

SEQ ID NO: 34959 - DNA, 4296 bp, Artificial Sequence
  Description of Artificial Sequence: Synthetic coding sequence
atggtgagcagcggctgcaggatgaggagcctgtggttcatcatcgtcatctccttcctgcccaacacagagggcttcagcagagctgccctgcccttcggcctggtgagaagagagctgagctgtgagggctacagcattgacctgcgctgccccggcagtgatgtgatcatgattgaaagtgccaactacggccgcacagatgacaagatctgtgatgctgaccccttccagatggagaacacagactgctacctgcctgatgccttcaagatcatgacccagcgctgcaacaacagaacccagtgcatcgtggtgactggaagtgatgtgtttcctgacccctgccccggcacctacaagtacctggaggtgcagtatgaatgtgtgccctacatctttgtgtgccccggcaccctgaaggccatcgtggacagcccctgcatctatgaggccgagcagaaggccggggcctggtgcaaggaccccctgcaggccgctgacaagatctacttcatgccctggaccccctacagaacagacaccctcatcgagtatgccagcctggaggacttccagaacagccggcagaccaccacctacaagctgcccaacagagtggatggcaccggctttgtggtgtatgatggagctgtgttcttcaacaaggagaggaccagaaatattgtgaagtttgacctgcggacccgcatcaagagcggggaggccatcatcaactatgccaactaccatgacaccagcccctaccgctggggcggcaagacagacatcgacctggccgtggatgaaaatggcctgtgggtgatctatgccacagagcagaacaacggcatgatcgtcatcagccagctgaacccctacaccctgcgctttgaggccacctgggagaccgtgtatgacaagagagctgccagcaatgccttcatgatctgtggggtgctgtatgtggtgcgctctgtgtaccaggacaatgaaagtgaaacaggcaagaacagcattgactacatctacaacacccggctgaacagaggagaatatgtggatgtgcccttccccaaccagtaccagtacatcgctgctgtggactacaacccccgggacaaccagctgtatgtgtggaacaacaacttcatcctgcgctacagcctggagtttggccccccagaccctgcccaggtgcccaccacagctgtgaccatcaccagcagcgctgagctgttcaagaccatcatcagcaccaccagcaccaccagccagaagggccccatgagcaccaccgtggccggcagccaggagggcagcaagggcaccaagcccccacctgctgtgtccaccaccaagatcccccccatcaccaacatcttccccctgcctgagcgcttctgtgaggccctggacagcaagggcatcaagtggccccagacccagaggggcatgatggtggagcggccctgccccaagggcacccggggcacagccagctacctgtgcatgatcagcacaggcacctggaaccccaagggccctgacctgagcaactgcaccagccactgggtgaaccagctggcccagaagatccgctctggagaaaatgctgccagcctggccaatgagctggccaagcacaccaagggccctgtgtttgctggagatgtgagcagctctgtgcggctgatggagcagctggtggacatcctggatgcccagctgcaggagctgaagcccagcgagaaggacagcgctggccgcagctacaacaagctgcagaagcgggagaagacctgccgggcctacctgaaggccatcgtggacacagtggacaacctgctgcggcctgaggccctggagagctggaagcacatgaacagcagcgagcaggcccacacagccaccatgctgctggacaccctggaggagggcgcctttgtgctggccgacaacctgctggagcccaccagggtgtccatgcccacagagaacatcgtgctggaggtggccgtgctgagcacagagggccagatccaggacttcaagttccccctgggcatcaagggagctggcagcagcatccagctgagcgccaacacagtgaagcagaacagcagaaatggcctggccaagctggtgttcatcatctaccgcagcctgggccagttcctgagcacagaaaatgccaccatcaagctgggcgctgacttcatcggcaggaacagcaccatcgctgtgaacagccacgtgatctctgtgtccatcaacaaggagagcagccgggtgtacctgacagatcctgtgctcttcaccctgccccacatcgaccctgacaactacttcaatgccaactgcagcttctggaactacagcgagaggaccatgatgggctactggagcacccagggctgcaagctggtggacaccaacaagaccaggaccacctgtgcctgcagccacctgaccaactttgccatcctgatggcccaccgggagatcgcctacaaggatggagtgcatgagctgctgctgaccgtcatcacctgggtgggcatcgtcatcagcctggtgtgcctggccatctgcatcttcaccttctgcttcttccggggcctgcagagcgacaggaacaccatccacaagaacctgtgcatcaacctcttcatcgccgagttcatcttcctgattggaattgacaagaccaagtatgccatcgcctgccccatctttgctggcctgctgcacttcttcttcctggccgcctttgcctggatgtgcctggagggcgtgcagctgtacctgatgctggtggaggtgtttgaaagtgagtacagcaggaagaagtactactacgtggccggctacctgtttcctgccaccgtggtgggcgtgtctgctgccatcgactacaagagctatggaacagagaaggcctgctggctgcacgtggacaactacttcatctggagcttcatcggccctgtgaccttcatcatcctgctgaacatcatcttcctggtgatcaccctgtgcaagatggtgaagcacagcaacaccctgaagccagacagcagccggctggagaacatcaacaactacagagtgtgtgatggctactacaacacagacctgcccggctcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccagagccgcatccggaggatgtggaatgacacagtgaggaagcagagcgagagcagcttcatcagcggggacatcaacagcaccagcaccctgaaccagggccacagcctgaacaatgcccgggacaccagcgccatggacaccctgcccctgaatggaaacttcaacaacagctacagcctgcacaagggggactacaatgacagcgtgcaggtggtggactgtggcctgagcctgaatgacacagcctttgagaagatgatcatcagcgagctggtgcacaacaacctgcggggcagcagcaagacccacaacctggagctgaccctgcctgtgaagcctgtgattggaggcagcagcagtgaagatgatgccatcgtggctgatgccagcagcctgatgcacagcgacaaccctggcctggagctgcaccacaaggagctggaggcccccctcatcccccagaggacccacagcctgctgtaccagccccagaagaaggtgaagtctgagggcacagacagctatgtgtcccagctgacagctgaggccgaggaccacctgcagagccccaacagagacagcctgtacacctccatgcccaacctgcgggacagcccctacccagagagcagcccagacatggaggaggacctgagccccagccgccgctcagaaaatgaagacatctactacaagtccatgcccaacctgggcgccggccaccagctgcagatgtgctaccagatcagccggggcaacagtgatggctacatcatccccatcaacaaggagggctgcatcccagaaggagatgtgcgggagggccagatgcagctggtgaccagcctgtag

SEQ ID NO: 34960 - DNA, 4212 bp, Artificial Sequence
  Description of Artificial Sequence: Synthetic coding sequence
atggtgagcagcggctgcaggatgaggagcctgtggttcatcatcgtcatctccttcctgcccaacacagagggcttcagcagagctgccctgcccttcggcctggtgagaagagagctgagctgtgagggctacagcattgacctgcgctgccccggcagtgatgtgatcatgattgaaagtgccaactacggccgcacagatgacaagatctgtgatgctgaccccttccagatggagaacacagactgctacctgcctgatgccttcaagatcatgacccagcgctgcaacaacagaacccagtgcatcgtggtgactggaagtgatgtgtttcctgacccctgccccggcacctacaagtacctggaggtgcagtatgaatgtgtgccctacatctttgtgtgccccggcaccctgaaggccatcgtggacagcccctgcatctatgaggccgagcagaaggccggggcctggtgcaaggaccccctgcaggccgctgacaagatctacttcatgccctggaccccctacagaacagacaccctcatcgagtatgccagcctggaggacttccagaacagccggcagaccaccacctacaagctgcccaacagagtggatggcaccggctttgtggtgtatgatggagctgtgttcttcaacaaggagaggaccagaaatattgtgaagtttgacctgcggacccgcatcaagagcggggaggccatcatcaactatgccaactaccatgacaccagcccctaccgctggggcggcaagacagacatcgacctggccgtggatgaaaatggcctgtgggtgatctatgccacagagcagaacaacggcatgatcgtcatcagccagctgaacccctacaccctgcgctttgaggccacctgggagaccgtgtatgacaagagagctgccagcaatgccttcatgatctgtggggtgctgtatgtggtgcgctctgtgtaccaggacaatgaaagtgaaacaggcaagaacagcattgactacatctacaacacccggctgaacagaggagaatatgtggatgtgcccttccccaaccagtaccagtacatcgctgctgtggactacaacccccgggacaaccagctgtatgtgtggaacaacaacttcatcctgcgctacagcctggagtttggccccccagaccctgcccaggtgcccaccacagctgtgaccatcaccagcagcgctgagctgttcaagaccatcatcagcaccaccagcaccaccagccagaagggccccatgagcaccaccgtggccggcagccaggagggcagcaagggcaccaagcccccacctgctgtgtccaccaccaagatcccccccatcaccaacatcttccccctgcctgagcgcttctgtgaggccctggacagcaagggcatcaagtggccccagacccagaggggcatgatggtggagcggccctgccccaagggcacccggggcacagccagctacctgtgcatgatcagcacaggcacctggaaccccaagggccctgacctgagcaactgcaccagccactgggtgaaccagctggcccagaagatccgctctggagaaaatgctgccagcctggccaatgagctggccaagcacaccaagggccctgtgtttgctggagatgtgagcagctctgtgcggctgatggagcagctggtggacatcctggatgcccagctgcaggagctgaagcccagcgagaaggacagcgctggccgcagctacaacaaggccatcgtggacacagtggacaacctgctgcggcctgaggccctggagagctggaagcacatgaacagcagcgagcaggcccacacagccaccatgctgctggacaccctggaggagggcgcctttgtgctggccgacaacctgctggagcccaccagggtgtccatgcccacagaaaatattgtgctggaggtggccgtgctgagcacagagggccagatccaggacttcaagttccccctgggcatcaagggggccggcagcagcatccagctgagcgccaacacagtgaagcagaacagcagaaatggcctggccaagctggtgttcatcatctaccgcagcctgggccagttcctgagcacagaaaatgccaccatcaagctgggcgctgacttcatcggcaggaacagcaccatcgctgtgaacagccacgtgatctctgtgtccatcaacaaggagagcagccgggtgtacctgacagatcctgtgctcttcaccctgccccacattgatcctgacaactacttcaatgccaactgcagcttctggaactacagcgagaggaccatgatgggctactggagcacccagggctgcaagctggtggacaccaacaagaccaggaccacctgtgcctgcagccacctgaccaactttgccatcctgatggcccaccgggagatcgcctacaaggatggagtgcatgagctgctgctgaccgtcatcacctgggtgggcatcgtcatcagcctggtgtgcctggccatctgcatcttcaccttctgcttcttccggggcctgcagagcgacaggaacaccatccacaagaacctgtgcatcaacctcttcatcgccgagttcatcttcctgattggcatcgacaagaccaagtatgccatcgcctgccccatctttgctggcctgctgcacttcttcttcctggccgcctttgcctggatgtgcctggagggcgtgcagctgtacctgatgctggtggaggtgtttgagagcgagtacagcaggaagaagtactactacgtggccggctacctgtttcctgccaccgtggtgggcgtgtctgctgccatcgactacaagagctatggaacagagaaggcctgctggctgcacgtggacaactacttcatctggagcttcatcggccctgtgaccttcatcatcctgctgaacatcatcttcctggtgatcaccctgtgcaagatggtgaagcacagcaacaccctgaagccagacagcagccggctggagaacatcaagtcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccagagccgcatccggaggatgtggaatgacacagtgaggaagcagagcgagagcagcttcatcagcggggacatcaacagcaccagcaccctgaaccagggccacagcctgaacaatgcccgggacaccagcgccatggacaccctgcccctgaatggaaacttcaacaacagctacagcctgcacaagggggactacaatgacagcgtgcaggtggtggactgtggcctgagcctgaatgacacagcctttgagaagatgatcatcagcgagctggtgcacaacaacctgcggggcagcagcaagacccacaacctggagctgaccctgcctgtgaagcctgtgattggaggcagcagcagtgaagatgatgccatcgtggctgatgccagcagcctgatgcacagcgacaaccctggcctggagctgcaccacaaggagctggaggcccccctcatcccccagaggacccacagcctgctgtaccagccccagaagaaggtgaagtctgagggcacagacagctatgtgtcccagctgacagctgaggccgaggaccacctgcagagccccaacagagacagcctgtacacctccatgcccaacctgcgggacagcccctacccagagagcagcccagacatggaggaggacctgagccccagccgccgctcagaaaatgaagacatctactacaagtccatgcccaacctgggcgccggccaccagctgcagatgtgctaccagatcagccggggcaacagtgatggctacatcatccccatcaacaaggagggctgcatcccagaaggagatgtgcgggagggccagatgcagctggtgaccagcctgtag

SEQ ID NO: 34961 - DNA, 4251 bp, Artificial Sequence
  Description of Artificial Sequence: Synthetic coding sequence
atggtgagcagcggctgcaggatgaggagcctgtggttcatcatcgtcatctccttcctgcccaacacagagggcttcagcagagctgccctgcccttcggcctggtgagaagagagctgagctgtgagggctacagcattgacctgcgctgccccggcagtgatgtgatcatgattgaaagtgccaactacggccgcacagatgacaagatctgtgatgctgaccccttccagatggagaacacagactgctacctgcctgatgccttcaagatcatgacccagcgctgcaacaacagaacccagtgcatcgtggtgactggaagtgatgtgtttcctgacccctgccccggcacctacaagtacctggaggtgcagtatgaatgtgtgccctacatctttgtgtgccccggcaccctgaaggccatcgtggacagcccctgcatctatgaggccgagcagaaggccggggcctggtgcaaggaccccctgcaggccgctgacaagatctacttcatgccctggaccccctacagaacagacaccctcatcgagtatgccagcctggaggacttccagaacagccggcagaccaccacctacaagctgcccaacagagtggatggcaccggctttgtggtgtatgatggagctgtgttcttcaacaaggagaggaccagaaatattgtgaagtttgacctgcggacccgcatcaagagcggggaggccatcatcaactatgccaactaccatgacaccagcccctaccgctggggcggcaagacagacatcgacctggccgtggatgaaaatggcctgtgggtgatctatgccacagagcagaacaacggcatgatcgtcatcagccagctgaacccctacaccctgcgctttgaggccacctgggagaccgtgtatgacaagagagctgccagcaatgccttcatgatctgtggggtgctgtatgtggtgcgctctgtgtaccaggacaatgaaagtgaaacaggcaagaacagcattgactacatctacaacacccggctgaacagaggagaatatgtggatgtgcccttccccaaccagtaccagtacatcgctgctgtggactacaacccccgggacaaccagctgtatgtgtggaacaacaacttcatcctgcgctacagcctggagtttggccccccagaccctgcccaggtgcccaccacagctgtgaccatcaccagcagcgctgagctgttcaagaccatcatcagcaccaccagcaccaccagccagaagggccccatgagcaccaccgtggccggcagccaggagggcagcaagggcaccaagcccccacctgctgtgtccaccaccaagatcccccccatcaccaacatcttccccctgcctgagcgcttctgtgaggccctggacagcaagggcatcaagtggccccagacccagaggggcatgatggtggagcggccctgccccaagggcacccggggcacagccagctacctgtgcatgatcagcacaggcacctggaaccccaagggccctgacctgagcaactgcaccagccactgggtgaaccagctggcccagaagatccgctctggagaaaatgctgccagcctggccaatgagctggccaagcacaccaagggccctgtgtttgctggagatgtgagcagctctgtgcggctgatggagcagctggtggacatcctggatgcccagctgcaggagctgaagcccagcgagaaggacagcgctggccgcagctacaacaagctgcagaagcgggagaagacctgccgggcctacctgaaggccatcgtggacacagtggacaacctgctgcggcctgaggccctggagagctggaagcacatgaacagcagcgagcaggcccacacagccaccatgctgctggacaccctggaggagggcgcctttgtgctggccgacaacctgctggagcccaccagggtgtccatgcccacagagaacatcgtgctggaggtggccgtgctgagcacagagggccagatccaggacttcaagttccccctgggcatcaagggagctggcagcagcatccagctgagcgccaacacagtgaagcagaacagcagaaatggcctggccaagctggtgttcatcatctaccgcagcctgggccagttcctgagcacagaaaatgccaccatcaagctgggcgctgacttcatcggcaggaacagcaccatcgctgtgaacagccacgtgatctctgtgtccatcaacaaggagagcagccgggtgtacctgacagatcctgtgctcttcaccctgccccacatcgaccctgacaactacttcaatgccaactgcagcttctggaactacagcgagaggaccatgatgggctactggagcacccagggctgcaagctggtggacaccaacaagaccaggaccacctgtgcctgcagccacctgaccaactttgccatcctgatggcccaccgggagatcgcctacaaggatggagtgcatgagctgctgctgaccgtcatcacctgggtgggcatcgtcatcagcctggtgtgcctggccatctgcatcttcaccttctgcttcttccggggcctgcagagcgacaggaacaccatccacaagaacctgtgcatcaacctcttcatcgccgagttcatcttcctgattggaattgacaagaccaagtatgccatcgcctgccccatctttgctggcctgctgcacttcttcttcctggccgcctttgcctggatgtgcctggagggcgtgcagctgtacctgatgctggtggaggtgtttgaaagtgagtacagcaggaagaagtactactacgtggccggctacctgtttcctgccaccgtggtgggcgtgtctgctgccatcgactacaagagctatggaacagagaaggcctgctggctgcacgtggacaactacttcatctggagcttcatcggccctgtgaccttcatcatcctgctgaacatcatcttcctggtgatcaccctgtgcaagatggtgaagcacagcaacaccctgaagccagacagcagccggctggagaacatcaagtcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccagagccgcatccggaggatgtggaatgacacagtgaggaagcagagcgagagcagcttcatcagcggggacatcaacagcaccagcaccctgaaccagggccacagcctgaacaatgcccgggacaccagcgccatggacaccctgcccctgaatggaaacttcaacaacagctacagcctgcacaagggggactacaatgattctgtgcaggtggtggactgtggcctgagcctgaatgacacagcctttgagaagatgatcatcagcgagctggtgcacaacaacctgcggggcagcagcaagacccacaacctggagctgaccctgcctgtgaagcctgtgattggaggcagcagcagtgaagatgatgccatcgtggctgatgccagcagcctgatgcacagcgacaaccctggcctggagctgcaccacaaggagctggaggcccccctcatcccccagaggacccacagcctgctgtaccagccccagaagaaggtgaagtctgagggcacagacagctatgtgtcccagctgacagctgaggccgaggaccacctgcagagccccaacagagacagcctgtacacctccatgcccaacctgcgggacagcccctacccagagagcagcccagacatggaggaggacctgagccccagcagaagaagtgaaaatgaagacatctactacaagtccatgcccaacctgggcgccggccaccagctgcagatgtgctaccagatcagccggggcaacagtgatggctacatcatccccatcaacaaggagggctgcatcccagaaggagatgtgcgggagggccagatgcagctggtgaccagcctgtag

SEQ ID NO: 34962 - DNA, 4212 bp, Artificial Sequence; identical to SEQ ID NO: 34960
  Description of Artificial Sequence: Synthetic coding sequence

SEQ ID NO: 34963 - DNA, 3372 bp, Artificial Sequence
  Description of Artificial Sequence: Synthetic coding sequence
atggtgagcagcggctgcaggatgaggagcctgtggttcatcatcgtcatctccttcctgcccaacacagagggcttcagcagagctgccctgcccttcggcctggtgagaagagagctgagctgtgagggctacagcattgacctgcgctgccccggcagtgatgtgatcatgattgaaagtgccaactacggccgcacagatgacaagatctgtgatgctgaccccttccagatggagaacacagactgctacctgcctgatgccttcaagatcatgacccagcgctgcaacaacagaacccagtgcatcgtggtgactggaagtgatgtgtttcctgacccctgccccggcacctacaagtacctggaggtgcagtatgaatgtgtgccctacatctttgtgtgccccggcaccctgaaggccatcgtggacagcccctgcatctatgaggccgagcagaaggccggggcctggtgcaaggaccccctgcaggccgctgacaagatctacttcatgccctggaccccctacagaacagacaccctcatcgagtatgccagcctggaggacttccagaacagccggcagaccaccacctacaagctgcccaacagagtggatggcaccggctttgtggtgtatgatggagctgtgttcttcaacaaggagaggaccagaaatattgtgaagtttgacctgcggacccgcatcaagagcggggaggccatcatcaactatgccaactaccatgacaccagcccctaccgctggggcggcaagacagacatcgacctggccgtggatgaaaatggcctgtgggtgatctatgccacagagcagaacaacggcatgatcgtcatcagccagctgaacccctacaccctgcgctttgaggccacctgggagaccgtgtatgacaagagagctgccagcaatgccttcatgatctgtggggtgctgtatgtggtgcgctctgtgtaccaggacaatgaaagtgaaacaggcaagaacagcattgactacatctacaacacccggctgaacagaggagaatatgtggatgtgcccttccccaaccagtaccagtacatcgctgctgtggactacaacccccgggacaaccagctgtatgtgtggaacaacaacttcatcctgcgctacagcctggagtttggccccccagaccctgcccaggtgcccaccacagctgtgaccatcaccagcagcgctgagctgttcaagaccatcatcagcaccaccagcaccaccagccagaagggccccatgagcaccaccgtggccggcagccaggagggcagcaagggcaccaagcccccacctgctgtgtccaccaccaagatcccccccatcaccaacatcttccccctgcctgagcgcttctgtgaggccctggacagcaagggcatcaagtggccccagacccagaggggcatgatggtggagcggccctgccccaagggcacccggggcacagccagctacctgtgcatgatcagcacaggcacctggaaccccaagggccctgacctgagcaactgcaccagccactgggtgaaccagctggcccagaagatccgctctggagaaaatgctgccagcctggccaatgagctggccaagcacaccaagggccctgtgtttgctggagatgtgagcagctctgtgcggctgatggagcagctggtggacatcctggatgcccagctgcaggagctgaagcccagcgagaaggacagcgctggccgcagctacaacaaggccatcgtggacacagtggacaacctgctgcggcctgaggccctggagagctggaagcacatgaacagcagcgagcaggcccacacagccaccatgctgctggacaccctggaggagggcgcctttgtgctggccgacaacctgctggagcccaccagggtgtccatgcccacagaaaatattgtgctggaggtggccgtgctgagcacagagggccagatccaggacttcaagttccccctgggcatcaagggggccggcagcagcatccagctgagcgccaacacagtgaagcagaacagcagaaatggcctggccaagctggtgttcatcatctaccgcagcctgggccagttcctgagcacagaaaatgccaccatcaagctgggcgctgacttcatcggcaggaacagcaccatcgctgtgaacagccacgtgatctctgtgtccatcaacaaggagagcagccgggtgtacctgacagatcctgtgctcttcaccctgccccacattgatcctgacaactacttcaatgccaactgcagcttctggaactacagcgagaggaccatgatgggctactggagcacccagggctgcaagctggtggacaccaacaagaccaggaccacctgtgcctgcagccacctgaccaactttgccatcctgatggcccaccgggagatcgcctacaaggatggagtgcatgagctgctgctgaccgtcatcacctgggtgggcatcgtcatcagcctggtgtgcctggccatctgcatcttcaccttctgcttcttccggggcctgcagagcgacaggaacaccatccacaagaacctgtgcatcaacctcttcatcgccgagttcatcttcctgattggcatcgacaagaccaagtatgccatcgcctgccccatctttgctggcctgctgcacttcttcttcctggccgcctttgcctggatgtgcctggagggcgtgcagctgtacctgatgctggtggaggtgtttgagagcgagtacagcaggaagaagtactactacgtggccggctacctgtttcctgccaccgtggtgggcgtgtctgctgccatcgactacaagagctatggaacagagaaggcctgctggctgcacgtggacaactacttcatctggagcttcatcggccctgtgaccttcatcatcctgctgaacatcatcttcctggtgatcaccctgtgcaagatggtgaagcacagcaacaccctgaagccagacagcagccggctggagaacatcaagtcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccaggacatccactag

SEQ ID NO: 34964 - DNA, 3534 bp, Artificial Sequence
  Description of Artificial Sequence: Synthetic coding sequence
atggtgagcagcggctgcaggatgaggagcctgtggttcatcatcgtcatctccttcctgcccaacacagagggcttcagcagagctgccctgcccttcggcctggtgagaagagagctgagctgtgagggctacagcattgacctgcgctgccccggcagtgatgtgatcatgattgaaagtgccaactacggccgcacagatgacaagatctgtgatgctgaccccttccagatggagaacacagactgctacctgcctgatgccttcaagatcatgacccagcgctgcaacaacagaacccagtgcatcgtggtgactggaagtgatgtgtttcctgacccctgccccggcacctacaagtacctggaggtgcagtatgaatgtgtgccctacatctttgtgtgccccggcaccctgaaggccatcgtggacagcccctgcatctatgaggccgagcagaaggccggggcctggtgcaaggaccccctgcaggccgctgacaagatctacttcatgccctggaccccctacagaacagacaccctcatcgagtatgccagcctggaggacttccagaacagccggcagaccaccacctacaagctgcccaacagagtggatggcaccggctttgtggtgtatgatggagctgtgttcttcaacaaggagaggaccagaaatattgtgaagtttgacctgcggacccgcatcaagagcggggaggccatcatcaactatgccaactaccatgacaccagcccctaccgctggggcggcaagacagacatcgacctggccgtggatgaaaatggcctgtgggtgatctatgccacagagcagaacaacggcatgatcgtcatcagccagctgaacccctacaccctgcgctttgaggccacctgggagaccgtgtatgacaagagagctgccagcaatgccttcatgatctgtggggtgctgtatgtggtgcgctctgtgtaccaggacaatgaaagtgaaacaggcaagaacagcattgactacatctacaacacccggctgaacagaggagaatatgtggatgtgcccttccccaaccagtaccagtacatcgctgctgtggactacaacccccgggacaaccagctgtatgtgtggaacaacaacttcatcctgcgctacagcctggagtttggccccccagaccctgcccaggtgcccaccacagctgtgaccatcaccagcagcgctgagctgttcaagaccatcatcagcaccaccagcaccaccagccagaagggccccatgagcaccaccgtggccggcagccaggagggcagcaagggcaccaagcccccacctgctgtgtccaccaccaagatcccccccatcaccaacatcttccccctgcctgagcgcttctgtgaggccctggacagcaagggcatcaagtggccccagacccagaggggcatgatggtggagcggccctgccccaagggcacccggggcacagccagctacctgtgcatgatcagcacaggcacctggaaccccaagggccctgacctgagcaactgcaccagccactgggtgaaccagctggcccagaagatccgctctggagaaaatgctgccagcctggccaatgagctggccaagcacaccaagggccctgtgtttgctggagatgtgagcagctctgtgcggctgatggagcagctggtggacatcctggatgcccagctgcaggagctgaagcccagcgagaaggacagcgctggccgcagctacaacaaggccatcgtggacacagtggacaacctgctgcggcctgaggccctggagagctggaagcacatgaacagcagcgagcaggcccacacagccaccatgctgctggacaccctggaggagggcgcctttgtgctggccgacaacctgctggagcccaccagggtgtccatgcccacagaaaatattgtgctggaggtggccgtgctgagcacagagggccagatccaggacttcaagttccccctgggcatcaagggggccggcagcagcatccagctgagcgccaacacagtgaagcagaacagcagaaatggcctggccaagctggtgttcatcatctaccgcagcctgggccagttcctgagcacagaaaatgccaccatcaagctgggcgctgacttcatcggcaggaacagcaccatcgctgtgaacagccacgtgatctctgtgtccatcaacaaggagagcagccgggtgtacctgacagatcctgtgctcttcaccctgccccacattgatcctgacaactacttcaatgccaactgcagcttctggaactacagcgagaggaccatgatgggctactggagcacccagggctgcaagctggtggacaccaacaagaccaggaccacctgtgcctgcagccacctgaccaactttgccatcctgatggcccaccgggagatcgcctacaaggatggagtgcatgagctgctgctgaccgtcatcacctgggtgggcatcgtcatcagcctggtgtgcctggccatctgcatcttcaccttctgcttcttccggggcctgcagagcgacaggaacaccatccacaagaacctgtgcatcaacctcttcatcgccgagttcatcttcctgattggcatcgacaagaccaagtatgccatcgcctgccccatctttgctggcctgctgcacttcttcttcctggccgcctttgcctggatgtgcctggagggcgtgcagctgtacctgatgctggtggaggtgtttgagagcgagtacagcaggaagaagtactactacgtggccggctacctgtttcctgccaccgtggtgggcgtgtctgctgccatcgactacaagagctatggaacagagaaggcctgctggctgcacgtggacaactacttcatctggagcttcatcggccctgtgaccttcatcatcctgctgaacatcatcttcctggtgatcaccctgtgcaagatggtgaagcacagcaacaccctgaagccagacagcagccggctggagaacatcaagtcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccagagccgcatccggaggatgtggaatgacacagtgaggaagcagagcgagagcagcttcatcagcggggacatcaacagcaccagcaccctgaaccagggcctgaccagccacggcctgcgggcccacctgcaggacctgtaccacctggagctgctgctgggccagatcgcctag

SEQ ID NO: 34965 - DNA, 4425 bp, Artificial Sequence
  Description of Artificial Sequence: Synthetic coding sequence
atggtgagcagcggctgcaggatgaggagcctgtggttcatcatcgtcatctccttcctgcccaacacagagggcttcagcagagctgccctgcccttcggcctggtgagaagagagctgagctgtgagggctacagcattgacctgcgctgccccggcagtgatgtgatcatgattgaaagtgccaactacggccgcacagatgacaagatctgtgatgctgaccccttccagatggagaacacagactgctacctgcctgatgccttcaagatcatgacccagcgctgcaacaacagaacccagtgcatcgtggtgactggaagtgatgtgtttcctgacccctgccccggcacctacaagtacctggaggtgcagtatgaatgtgtgccctacatctttgtgtgccccggcaccctgaaggccatcgtggacagcccctgcatctatgaggccgagcagaaggccggggcctggtgcaaggaccccctgcaggccgctgacaagatctacttcatgccctggaccccctacagaacagacaccctcatcgagtatgccagcctggaggacttccagaacagccggcagaccaccacctacaagctgcccaacagagtggatggcaccggctttgtggtgtatgatggagctgtgttcttcaacaaggagaggaccagaaatattgtgaagtttgacctgcggacccgcatcaagagcggggaggccatcatcaactatgccaactaccatgacaccagcccctaccgctggggcggcaagacagacatcgacctggccgtggatgaaaatggcctgtgggtgatctatgccacagagcagaacaacggcatgatcgtcatcagccagctgaacccctacaccctgcgctttgaggccacctgggagaccgtgtatgacaagagagctgccagcaatgccttcatgatctgtggggtgctgtatgtggtgcgctctgtgtaccaggacaatgaaagtgaaacaggcaagaacagcattgactacatctacaacacccggctgaacagaggagaatatgtggatgtgcccttccccaaccagtaccagtacatcgctgctgtggactacaacccccgggacaaccagctgtatgtgtggaacaacaacttcatcctgcgctacagcctggagtttggccccccagaccctgcccaggtgcccaccacagctgtgaccatcaccagcagcgctgagctgttcaagaccatcatcagcaccaccagcaccaccagccagaagggccccatgagcaccaccgtggccggcagccaggagggcagcaagggcaccaagcccccacctgctgtgtccaccaccaagatcccccccatcaccaacatcttccccctgcctgagcgcttctgtgaggccctggacagcaagggcatcaagtggccccagacccagaggggcatgatggtggagcggccctgccccaagggcacccggggcacagccagctacctgtgcatgatcagcacaggcacctggaaccccaagggccctgacctgagcaactgcaccagccactgggtgaaccagctggcccagaagatccgctctggagaaaatgctgccagcctggccaatgagctggccaagcacaccaagggccctgtgtttgctggagatgtgagcagctctgtgcggctgatggagcagctggtggacatcctggatgcccagctgcaggagctgaagcccagcgagaaggacagcgctggccgcagctacaacaagctgcagaagcgggagaagacctgccgggcctacctgaaggccatcgtggacacagtggacaacctgctgcggcctgaggccctggagagctggaagcacatgaacagcagcgagcaggcccacacagccaccatgctgctggacaccctggaggagggcgcctttgtgctggccgacaacctgctggagcccaccagggtgtccatgcccacagagaacatcgtgctggaggtggccgtgctgagcacagagggccagatccaggacttcaagttccccctgggcatcaagggagctggcagcagcatccagctgagcgccaacacagtgaagcagaacagcagaaatggcctggccaagctggtgttcatcatctaccgcagcctgggccagttcctgagcacagaaaatgccaccatcaagctgggcgctgacttcatcggcaggaacagcaccatcgctgtgaacagccacgtgatctctgtgtccatcaacaaggagagcagccgggtgtacctgacagatcctgtgctcttcaccctgccccacatcgaccctgacaactacttcaatgccaactgcagcttctggaactacagcgagaggaccatgatgggctactggagcacccagggctgcaagctggtggacaccaacaagaccaggaccacctgtgcctgcagccacctgaccaactttgccatcctgatggcccaccgggagatcgcctacaaggatggagtgcatgagctgctgctgaccgtcatcacctgggtgggcatcgtcatcagcctggtgtgcctggccatctgcatcttcaccttctgcttcttccggggcctgcagagcgacaggaacaccatccacaagaacctgtgcatcaacctcttcatcgccgagttcatcttcctgattggaattgacaagaccaagtatgccatcgcctgccccatctttgctggcctgctgcacttcttcttcctggccgcctttgcctggatgtgcctggagggcgtgcagctgtacctgatgctggtggaggtgtttgaaagtgagtacagcaggaagaagtactactacgtggccggctacctgtttcctgccaccgtggtgggcgtgtctgctgccatcgactacaagagctatggaacagagaaggcctgctggctgcacgtggacaactacttcatctggagcttcatcggccctgtgaccttcatcatcctgctgaacatcatcttcctggtgatcaccctgtgcaagatggtgaagcacagcaacaccctgaagccagacagcagccggctggagaacatcaacaactacagagtgtgtgatggctactacaacacagacctgcccggctcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccagagccgcatccggaggatgtggaatgacacagtgaggaagcagagcgagagcagcttcatcagcggggacatcaacagcaccagcaccctgaaccagggcatgactggaaactacctgctgaccaaccccctgctgcggccccacggcaccaacaacccctacaacaccctgctggccgagaccgtggtgtgcaatgcccccagcgcccctgtgttcaacagccctggccacagcctgaacaatgcccgggacaccagcgccatggacaccctgcccctgaatggaaacttcaacaacagctacagcctgcacaagggggactacaatgattctgtgcaggtggtggactgtggcctgagcctgaatgacacagcctttgagaagatgatcatcagcgagctggtgcacaacaacctgcggggcagcagcaagacccacaacctggagctgaccctgcctgtgaagcctgtgattggaggcagcagcagtgaagatgatgccatcgtggctgatgccagcagcctgatgcacagcgacaaccctggcctggagctgcaccacaaggagctggaggcccccctcatcccccagaggacccacagcctgctgtaccagccccagaagaaggtgaagtctgagggcacagacagctatgtgtcccagctgacagctgaggccgaggaccacctgcagagccccaacagagacagcctgtacacctccatgcccaacctgcgggacagcccctacccagagagcagcccagacatggaggaggacctgagccccagcagaagaagtgaaaatgaagacatctactacaagtccatgcccaacctgggcgccggccaccagctgcagatgtgctaccagatcagccggggcaacagtgatggctacatcatccccatcaacaaggagggctgcatcccagaaggagatgtgcgggagggccagatgcagctggtgaccagcctgtag

SEQ ID NO: 34966 - DNA, 4155 bp, Artificial Sequence
  Description of Artificial Sequence: Synthetic coding sequence
atggtgagcagcggctgcaggatgaggagcctgtggttcatcatcgtcatctccttcctgcccaacacagagggcttcagcagagctgccctgcccttcggcctggtgagaagagagctgagctgtgagggctacagcattgacctgcgctgccccggcagtgatgtgatcatgattgaaagtgccaactacggccgcacagatgacaagatctgtgatgctgaccccttccagatggagaacacagactgctacctgcctgatgccttcaagatcatgacccagcgctgcaacaacagaacccagtgcatcgtggtgactggaagtgatgtgtttcctgacccctgccccggcacctacaagtacctggaggtgcagtatgaatgtgtgccctacatggagcagaaggtgtttgtgtgccccggcaccctgaaggccatcgtggacagcccctgcatctatgaggccgagcagaaggccggggcctggtgcaaggaccccctgcaggccgctgacaagatctacttcatgccctggaccccctacagaacagacaccctcatcgagtatgccagcctggaggacttccagaacagccggcagaccaccacctacaagctgcccaacagagtggatggcaccggctttgtggtgtatgatggagctgtgttcttcaacaaggagaggaccagaaatattgtgaagtttgacctgcggacccgcatcaagagcggggaggccatcatcaactatgccaactaccatgacaccagcccctaccgctggggcggcaagacagacatcgacctggccgtggatgaaaatggcctgtgggtgatctatgccacagagcagaacaacggcatgatcgtcatcagccagctgaacccctacaccctgcgctttgaggccacctgggagaccgtgtatgacaagagagctgccagcaatgccttcatgatctgtggggtgctgtatgtggtgcgctctgtgtaccaggacaatgaaagtgaaacaggcaagaacagcattgactacatctacaacacccggctgaacagaggagaatatgtggatgtgcccttccccaaccagtaccagtacatcgctgctgtggactacaacccccgggacaaccagctgtatgtgtggaacaacaacttcatcctgcgctacagcctggagtttggccccccagaccctgcccaggagcgcttctgtgaggccctggacagcaagggcatcaagtggccccagacccagaggggcatgatggtggagcggccctgccccaagggcacccggggcacagccagctacctgtgcatgatcagcacaggcacctggaaccccaagggccctgacctgagcaactgcaccagccactgggtgaaccagctggcccagaagatccgctctggagaaaatgctgccagcctggccaatgagctggccaagcacaccaagggccctgtgtttgctggagatgtgagcagctctgtgcggctgatggagcagctggtggacatcctggatgcccagctgcaggagctgaagcccagcgagaaggacagcgctggccgcagctacaacaaggccatcgtggacacagtggacaacctgctgcggcctgaggccctggagagctggaagcacatgaacagcagcgagcaggcccacacagccaccatgctgctggacaccctggaggagggcgcctttgtgctggccgacaacctgctggagcccaccagggtgtccatgcccacagaaaatattgtgctggaggtggccgtgctgagcacagagggccagatccaggacttcaagttccccctgggcatcaagggggccggcagcagcatccagctgagcgccaacacagtgaagcagaacagcagaaatggcctggccaagctggtgttcatcatctaccgcagcctgggccagttcctgagcacagaaaatgccaccatcaagctgggcgctgacttcatcggcaggaacagcaccatcgctgtgaacagccacgtgatctctgtgtccatcaacaaggagagcagccgggtgtacctgacagatcctgtgctcttcaccctgccccacattgatcctgacaactacttcaatgccaactgcagcttctggaactacagcgagaggaccatgatgggctactggagcacccagggctgcaagctggtggacaccaacaagaccaggaccacctgtgcctgcagccacctgaccaactttgccatcctgatggcccaccgggagatcgcctacaaggatggagtgcatgagctgctgctgaccgtcatcacctgggtgggcatcgtcatcagcctggtgtgcctggccatctgcatcttcaccttctgcttcttccggggcctgcagagcgacaggaacaccatccacaagaacctgtgcatcaacctcttcatcgccgagttcatcttcctgattggcatcgacaagaccaagtatgccatcgcctgccccatctttgctggcctgctgcacttcttcttcctggccgcctttgcctggatgtgcctggagggcgtgcagctgtacctgatgctggtggaggtgtttgagagcgagtacagcaggaagaagtactactacgtggccggctacctgtttcctgccaccgtggtgggcgtgtctgctgccatcgactacaagagctatggaacagagaaggcctgctggctgcacgtggacaactacttcatctggagcttcatcggccctgtgaccttcatcatcctgctgaacatcatcttcctggtgatcaccctgtgcaagatggtgaagcacagcaacaccctgaagccagacagcagccggctggagaacatcaagtcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccagagccgcatccggaggatgtggaatgacacagtgaggaagcagagcgagagcagcttcatcagcggggacatcaacagcaccagcaccctgaaccagggcatgactggaaactacctgctgaccaaccccctgctgcggccccacggcaccaacaacccctacaacaccctgctggccgagaccgtggtgtgcaatgcccccagcgcccctgtgttcaacagccctggccacagcctgaacaatgcccgggacaccagcgccatggacaccctgcccctgaatggaaacttcaacaacagctacagcctgcacaagggggactacaatgattctgtgcaggtggtggactgtggcctgagcctgaatgacacagcctttgagaagatgatcatcagcgagctggtgcacaacaacctgcggggcagcagcaagacccacaacctggagctgaccctgcctgtgaagcctgtgattggaggcagcagcagtgaagatgatgccatcgtggctgatgccagcagcctgatgcacagcgacaaccctggcctggagctgcaccacaaggagctggaggcccccctcatcccccagaggacccacagcctgctgtaccagccccagaagaaggtgaagtctgagggcacagacagctatgtgtcccagctgacagctgaggccgaggaccacctgcagagccccaacagagacagcctgtacacctccatgcccaacctgcgggacagcccctacccagagagcagcccagacatggaggaggacctgagccccagcagaagaagtgaaaatgaagacatctactacaagtccatgcccaacctgggcgccggccaccagctgcagatgtgctaccagatcagccggggcaacagtgatggctacatcatccccatcaacaaggagggctgcatcccagaaggagatgtgcgggagggccagatgcagctggtgaccagcctgtag

SEQ ID NO: 34967 - DNA, 4386 bp, Artificial Sequence
  Description of Artificial Sequence: Synthetic coding sequence
atggtgagcagcggctgcaggatgaggagcctgtggttcatcatcgtcatctccttcctgcccaacacagagggcttcagcagagctgccctgcccttcggcctggtgagaagagagctgagctgtgagggctacagcattgacctgcgctgccccggcagtgatgtgatcatgattgaaagtgccaactacggccgcacagatgacaagatctgtgatgctgaccccttccagatggagaacacagactgctacctgcctgatgccttcaagatcatgacccagcgctgcaacaacagaacccagtgcatcgtggtgactggaagtgatgtgtttcctgacccctgccccggcacctacaagtacctggaggtgcagtatgaatgtgtgccctacatctttgtgtgccccggcaccctgaaggccatcgtggacagcccctgcatctatgaggccgagcagaaggccggggcctggtgcaaggaccccctgcaggccgctgacaagatctacttcatgccctggaccccctacagaacagacaccctcatcgagtatgccagcctggaggacttccagaacagccggcagaccaccacctacaagctgcccaacagagtggatggcaccggctttgtggtgtatgatggagctgtgttcttcaacaaggagaggaccagaaatattgtgaagtttgacctgcggacccgcatcaagagcggggaggccatcatcaactatgccaactaccatgacaccagcccctaccgctggggcggcaagacagacatcgacctggccgtggatgaaaatggcctgtgggtgatctatgccacagagcagaacaacggcatgatcgtcatcagccagctgaacccctacaccctgcgctttgaggccacctgggagaccgtgtatgacaagagagctgccagcaatgccttcatgatctgtggggtgctgtatgtggtgcgctctgtgtaccaggacaatgaaagtgaaacaggcaagaacagcattgactacatctacaacacccggctgaacagaggagaatatgtggatgtgcccttccccaaccagtaccagtacatcgctgctgtggactacaacccccgggacaaccagctgtatgtgtggaacaacaacttcatcctgcgctacagcctggagtttggccccccagaccctgcccaggtgcccaccacagctgtgaccatcaccagcagcgctgagctgttcaagaccatcatcagcaccaccagcaccaccagccagaagggccccatgagcaccaccgtggccggcagccaggagggcagcaagggcaccaagcccccacctgctgtgtccaccaccaagatcccccccatcaccaacatcttccccctgcctgagcgcttctgtgaggccctggacagcaagggcatcaagtggccccagacccagaggggcatgatggtggagcggccctgccccaagggcacccggggcacagccagctacctgtgcatgatcagcacaggcacctggaaccccaagggccctgacctgagcaactgcaccagccactgggtgaaccagctggcccagaagatccgctctggagaaaatgctgccagcctggccaatgagctggccaagcacaccaagggccctgtgtttgctggagatgtgagcagctctgtgcggctgatggagcagctggtggacatcctggatgcccagctgcaggagctgaagcccagcgagaaggacagcgctggccgcagctacaacaaggccatcgtggacacagtggacaacctgctgcggcctgaggccctggagagctggaagcacatgaacagcagcgagcaggcccacacagccaccatgctgctggacaccctggaggagggcgcctttgtgctggccgacaacctgctggagcccaccagggtgtccatgcccacagaaaatattgtgctggaggtggccgtgctgagcacagagggccagatccaggacttcaagttccccctgggcatcaagggggccggcagcagcatccagctgagcgccaacacagtgaagcagaacagcagaaatggcctggccaagctggtgttcatcatctaccgcagcctgggccagttcctgagcacagaaaatgccaccatcaagctgggcgctgacttcatcggcaggaacagcaccatcgctgtgaacagccacgtgatctctgtgtccatcaacaaggagagcagccgggtgtacctgacagatcctgtgctcttcaccctgccccacattgatcctgacaactacttcaatgccaactgcagcttctggaactacagcgagaggaccatgatgggctactggagcacccagggctgcaagctggtggacaccaacaagaccaggaccacctgtgcctgcagccacctgaccaactttgccatcctgatggcccaccgggagatcgcctacaaggatggagtgcatgagctgctgctgaccgtcatcacctgggtgggcatcgtcatcagcctggtgtgcctggccatctgcatcttcaccttctgcttcttccggggcctgcagagcgacaggaacaccatccacaagaacctgtgcatcaacctcttcatcgccgagttcatcttcctgattggcatcgacaagaccaagtatgccatcgcctgccccatctttgctggcctgctgcacttcttcttcctggccgcctttgcctggatgtgcctggagggcgtgcagctgtacctgatgctggtggaggtgtttgagagcgagtacagcaggaagaagtactactacgtggccggctacctgtttcctgccaccgtggtgggcgtgtctgctgccatcgactacaagagctatggaacagagaaggcctgctggctgcacgtggacaactacttcatctggagcttcatcggccctgtgaccttcatcatcctgctgaacatcatcttcctggtgatcaccctgtgcaagatggtgaagcacagcaacaccctgaagccagacagcagccggctggagaacatcaacaactacagagtgtgtgatggctactacaacacagacctgcccggctcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccagagccgcatccggaggatgtggaatgacacagtgaggaagcagagcgagagcagcttcatcagcggggacatcaacagcaccagcaccctgaaccagggcatgacaggcaactacctgctgaccaaccccctgctgcggccccacggcaccaacaacccctacaacaccctgctggccgagaccgtggtgtgcaatgcccccagcgcccctgtgttcaacagccctggccacagcctgaacaatgcccgggacaccagcgccatggacaccctgcccctgaatggaaacttcaacaacagctacagcctgcacaagggggactacaatgacagcgtgcaggtggtggactgtggcctgagcctgaatgacacagcctttgagaagatgatcatcagcgagctggtgcacaacaacctgcggggcagcagcaagacccacaacctggagctgaccctgcctgtgaagcctgtgattggaggcagcagcagtgaagatgatgccatcgtggctgatgccagcagcctgatgcacagcgacaaccctggcctggagctgcaccacaaggagctggaggcccccctcatcccccagaggacccacagcctgctgtaccagccccagaagaaggtgaagtctgagggcacagacagctatgtgtcccagctgacagctgaggccgaggaccacctgcagagccccaacagagacagcctgtacacctccatgcccaacctgcgggacagcccctacccagagagcagcccagacatggaggaggacctgagccccagccgccgctcagaaaatgaagacatctactacaagtccatgcccaacctgggcgccggccaccagctgcagatgtgctaccagatcagccggggcaacagtgatggctacatcatccccatcaacaaggagggctgcatcccagaaggagatgtgcgggagggccagatgcagctggtgaccagcctgtag

SEQ ID NO: 34968 - DNA, 4425 bp, Artificial Sequence; identical to SEQ ID NO: 34965
  Description of Artificial Sequence: Synthetic coding sequence

SEQ ID NO: 34969 - DNA, 4296 bp, Artificial Sequence; identical to SEQ ID NO: 34959
  Description of Artificial Sequence: Synthetic coding sequence

SEQ ID NO: 34970 - DNA, 4380 bp, Artificial Sequence
  Description of Artificial Sequence: Synthetic coding sequence
atggtgagcagcggctgcaggatgaggagcctgtggttcatcatcgtcatctccttcctgcccaacacagagggcttcagcagagctgccctgcccttcggcctggtgagaagagagctgagctgtgagggctacagcattgacctgcgctgccccggcagtgatgtgatcatgattgaaagtgccaactacggccgcacagatgacaagatctgtgatgctgaccccttccagatggagaacacagactgctacctgcctgatgccttcaagatcatgacccagcgctgcaacaacagaacccagtgcatcgtggtgactggaagtgatgtgtttcctgacccctgccccggcacctacaagtacctggaggtgcagtatgaatgtgtgccctacatctttgtgtgccccggcaccctgaaggccatcgtggacagcccctgcatctatgaggccgagcagaaggccggggcctggtgcaaggaccccctgcaggccgctgacaagatctacttcatgccctggaccccctacagaacagacaccctcatcgagtatgccagcctggaggacttccagaacagccggcagaccaccacctacaagctgcccaacagagtggatggcaccggctttgtggtgtatgatggagctgtgttcttcaacaaggagaggaccagaaatattgtgaagtttgacctgcggacccgcatcaagagcggggaggccatcatcaactatgccaactaccatgacaccagcccctaccgctggggcggcaagacagacatcgacctggccgtggatgaaaatggcctgtgggtgatctatgccacagagcagaacaacggcatgatcgtcatcagccagctgaacccctacaccctgcgctttgaggccacctgggagaccgtgtatgacaagagagctgccagcaatgccttcatgatctgtggggtgctgtatgtggtgcgctctgtgtaccaggacaatgaaagtgaaacaggcaagaacagcattgactacatctacaacacccggctgaacagaggagaatatgtggatgtgcccttccccaaccagtaccagtacatcgctgctgtggactacaacccccgggacaaccagctgtatgtgtggaacaacaacttcatcctgcgctacagcctggagtttggccccccagaccctgcccaggtgcccaccacagctgtgaccatcaccagcagcgctgagctgttcaagaccatcatcagcaccaccagcaccaccagccagaagggccccatgagcaccaccgtggccggcagccaggagggcagcaagggcaccaagcccccacctgctgtgtccaccaccaagatcccccccatcaccaacatcttccccctgcctgagcgcttctgtgaggccctggacagcaagggcatcaagtggccccagacccagaggggcatgatggtggagcggccctgccccaagggcacccggggcacagccagctacctgtgcatgatcagcacaggcacctggaaccccaagggccctgacctgagcaactgcaccagccactgggtgaaccagctggcccagaagatccgctctggagaaaatgctgccagcctggccaatgagctggccaagcacaccaagggccctgtgtttgctggagatgtgagcagctctgtgcggctgatggagcagctggtggacatcctggatgcccagctgcaggagctgaagcccagcgagaaggacagcgctggccgcagctacaacaagctgcagaagcgggagaagacctgccgggcctacctgaaggccatcgtggacacagtggacaacctgctgcggcctgaggccctggagagctggaagcacatgaacagcagcgagcaggcccacacagccaccatgctgctggacaccctggaggagggcgcctttgtgctggccgacaacctgctggagcccaccagggtgtccatgcccacagagaacatcgtgctggaggtggccgtgctgagcacagagggccagatccaggacttcaagttccccctgggcatcaagggagctggcagcagcatccagctgagcgccaacacagtgaagcagaacagcagaaatggcctggccaagctggtgttcatcatctaccgcagcctgggccagttcctgagcacagaaaatgccaccatcaagctgggcgctgacttcatcggcaggaacagcaccatcgctgtgaacagccacgtgatctctgtgtccatcaacaaggagagcagccgggtgtacctgacagatcctgtgctcttcaccctgccccacatcgaccctgacaactacttcaatgccaactgcagcttctggaactacagcgagaggaccatgatgggctactggagcacccagggctgcaagctggtggacaccaacaagaccaggaccacctgtgcctgcagccacctgaccaactttgccatcctgatggcccaccgggagatcgcctacaaggatggagtgcatgagctgctgctgaccgtcatcacctgggtgggcatcgtcatcagcctggtgtgcctggccatctgcatcttcaccttctgcttcttccggggcctgcagagcgacaggaacaccatccacaagaacctgtgcatcaacctcttcatcgccgagttcatcttcctgattggaattgacaagaccaagtatgccatcgcctgccccatctttgctggcctgctgcacttcttcttcctggccgcctttgcctggatgtgcctggagggcgtgcagctgtacctgatgctggtggaggtgtttgaaagtgagtacagcaggaagaagtactactacgtggccggctacctgtttcctgccaccgtggtgggcgtgtctgctgccatcgactacaagagctatggaacagagaaggcctgctggctgcacgtggacaactacttcatctggagcttcatcggccctgtgaccttcatcatcctgctgaacatcatcttcctggtgatcaccctgtgcaagatggtgaagcacagcaacaccctgaagccagacagcagccggctggagaacatcaagtcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccagagccgcatccggaggatgtggaatgacacagtgaggaagcagagcgagagcagcttcatcagcggggacatcaacagcaccagcaccctgaaccagggcatgacaggcaactacctgctgaccaaccccctgctgcggccccacggcaccaacaacccctacaacaccctgctggccgagaccgtggtgtgcaatgcccccagcgcccctgtgttcaacagccctggccacagcctgaacaatgcccgggacaccagcgccatggacaccctgcccctgaatggaaacttcaacaacagctacagcctgcacaagggggactacaatgacagcgtgcaggtggtggactgtggcctgagcctgaatgacacagcctttgagaagatgatcatcagcgagctggtgcacaacaacctgcggggcagcagcaagacccacaacctggagctgaccctgcctgtgaagcctgtgattggaggcagcagcagtgaagatgatgccatcgtggctgatgccagcagcctgatgcacagcgacaaccctggcctggagctgcaccacaaggagctggaggcccccctcatcccccagaggacccacagcctgctgtaccagccccagaagaaggtgaagtctgagggcacagacagctatgtgtcccagctgacagctgaggccgaggaccacctgcagagccccaacagagacagcctgtacacctccatgcccaacctgcgggacagcccctacccagagagcagcccagacatggaggaggacctgagccccagccgccgctcagaaaatgaagacatctactacaagtccatgcccaacctgggcgccggccaccagctgcagatgtgctaccagatcagccggggcaacagtgatggctacatcatccccatcaacaaggagggctgcatcccagaaggagatgtgcgggagggccagatgcagctggtgaccagcctgtag

SEQ ID NO: 34971 - DNA, 4251 bp, Artificial Sequence; identical to SEQ ID NO: 34961
  Description of Artificial Sequence: Synthetic coding sequence

SEQ ID NO: 34972 - DNA, 4386 bp, Artificial Sequence; identical to SEQ ID NO: 34967
  Description of Artificial Sequence: Synthetic coding sequence

SEQ ID NO: 34973 - DNA, 1416 bp, Artificial Sequence
  Description of Artificial Sequence: Synthetic coding sequence
tgaatcaccctgtgcaagatggtgaagcacagcaacaccctgaagccagacagcagccggctggagaacatcaacaactacagagtgtgtgatggctactacaacacagacctgcccggctcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccagagccgcatccggaggatgtggaatgacacagtgaggaagcagagcgagagcagcttcatcagcggggacatcaacagcaccagcaccctgaaccagggcatgacaggcaactacctgctgaccaaccccctgctgcggccccacggcaccaacaacccctacaacaccctgctggccgagaccgtggtgtgcaatgcccccagcgcccctgtgttcaacagccctgccacctaccgggagaccaggcacagcctgaacaatgcccgggacaccagcgccatggacaccctgcccctgaatggaaacttcaacaacagctacagcctgcacaagggggactacaatgacagcgtgcaggtggtggactgtggcctgagcctgaatgacacagcctttgagaagatgatcatcagcgagctggtgcacaacaacctgcggggcagcagcaagacccacaacctggagctgaccctgcctgtgaagcctgtgattggaggcagcagcagtgaagatgatgccatcgtggctgatgccagcagcctgatgcacagcgacaaccctggcctggagctgcaccacaaggagctggaggcccccctcatcccccagaggacccacagcctgctgtaccagccccagaagaaggtgaagtctgagggcacagacagctatgtgtcccagctgacagctgaggccgaggaccacctgcagagccccaacagagacagcctgtacacctccatgcccaacctgcgggacagcccctacccagagagcagcccagacatggaggaggacctgagccccagccgccgctcagaaaatgaagacatctactacaagtccatgcccaacctgggcgccggccaccagctgcagatgtgctaccagatcagccggggcaacagtgatggctacatcatccccatcaacaaggagggctgcatcccagaaggagatgtgcgggagggccagatgcagctggtgaccagcctgtag

SEQ ID NO: 34974 - DNA, 4056 bp, Artificial Sequence
  Description of Artificial Sequence: Synthetic coding sequence
tgatttgtgtgccccggcaccctgaaggccatcgtggacagcccctgcatctatgaggccgagcagaaggccggggcctggtgcaaggaccccctgcaggccgctgacaagatctacttcatgccctggaccccctacagaacagacaccctcatcgagtatgccagcctggaggacttccagaacagccggcagaccaccacctacaagctgcccaacagagtggatggcaccggctttgtggtgtatgatggagctgtgttcttcaacaaggagaggaccagaaatattgtgaagtttgacctgcggacccgcatcaagagcggggaggccatcatcaactatgccaactaccatgacaccagcccctaccgctggggcggcaagacagacatcgacctggccgtggatgaaaatggcctgtgggtgatctatgccacagagcagaacaacggcatgatcgtcatcagccagctgaacccctacaccctgcgctttgaggccacctgggagaccgtgtatgacaagagagctgccagcaatgccttcatgatctgtggggtgctgtatgtggtgcgctctgtgtaccaggacaatgaaagtgaaacaggcaagaacagcattgactacatctacaacacccggctgaacagaggagaatatgtggatgtgcccttccccaaccagtaccagtacatcgctgctgtggactacaacccccgggacaaccagctgtatgtgtggaacaacaacttcatcctgcgctacagcctggagtttggccccccagaccctgcccaggtgcccaccacagctgtgaccatcaccagcagcgctgagctgttcaagaccatcatcagcaccaccagcaccaccagccagaagggccccatgagcaccaccgtggccggcagccaggagggcagcaagggcaccaagcccccacctgctgtgtccaccaccaagatcccccccatcaccaacatcttccccctgcctgagcgcttctgtgaggccctggacagcaagggcatcaagtggccccagacccagaggggcatgatggtggagcggccctgccccaagggcacccggggcacagccagctacctgtgcatgatcagcacaggcacctggaaccccaagggccctgacctgagcaactgcaccagccactgggtgaaccagctggcccagaagatccgctctggagaaaatgctgccagcctggccaatgagctggccaagcacaccaagggccctgtgtttgctggagatgtgagcagctctgtgcggctgatggagcagctggtggacatcctggatgcccagctgcaggagctgaagcccagcgagaaggacagcgctggccgcagctacaacaagctgcagaagcgggagaagacctgccgggcctacctgaaggccatcgtggacacagtggacaacctgctgcggcctgaggccctggagagctggaagcacatgaacagcagcgagcaggcccacacagccaccatgctgctggacaccctggaggagggcgcctttgtgctggccgacaacctgctggagcccaccagggtgtccatgcccacagagaacatcgtgctggaggtggccgtgctgagcacagagggccagatccaggacttcaagttccccctgggcatcaagggagctggcagcagcatccagctgagcgccaacacagtgaagcagaacagcagaaatggcctggccaagctggtgttcatcatctaccgcagcctgggccagttcctgagcacagaaaatgccaccatcaagctgggcgctgacttcatcggcaggaacagcaccatcgctgtgaacagccacgtgatctctgtgtccatcaacaaggagagcagccgggtgtacctgacagatcctgtgctcttcaccctgccccacatcgaccctgacaactacttcaatgccaactgcagcttctggaactacagcgagaggaccatgatgggctactggagcacccagggctgcaagctggtggacaccaacaagaccaggaccacctgtgcctgcagccacctgaccaactttgccatcctgatggcccaccgggagatcgcctacaaggatggagtgcatgagctgctgctgaccgtcatcacctgggtgggcatcgtcatcagcctggtgtgcctggccatctgcatcttcaccttctgcttcttccggggcctgcagagcgacaggaacaccatccacaagaacctgtgcatcaacctcttcatcgccgagttcatcttcctgattggaattgacaagaccaagtatgccatcgcctgccccatctttgctggcctgctgcacttcttcttcctggccgcctttgcctggatgtgcctggagggcgtgcagctgtacctgatgctggtggaggtgtttgaaagtgagtacagcaggaagaagtactactacgtggccggctacctgtttcctgccaccgtggtgggcgtgtctgctgccatcgactacaagagctatggaacagagaaggcctgctggctgcacgtggacaactacttcatctggagcttcatcggccctgtgaccttcatcatcctgctgaacatcatcttcctggtgatcaccctgtgcaagatggtgaagcacagcaacaccctgaagccagacagcagccggctggagaacatcaacaactacagagtgtgtgatggctactacaacacagacctgcccggctatgaggacaacaagcccttcatcaagtcctgggtgctgggcgcctttgccctgctgtgcctgctgggcctgacctggagctttggcctgctcttcatcaatgaggagaccatcgtgatggcctacctgttcaccatcttcaatgccttccagggcgtcttcatcttcatcttccactgtgccctgcagaagaaggtgaggaaggagtatggcaagtgcttccgccacagctactgctgcggcggcctgcccacagagagcccccacagctctgtgaaggccagcaccaccaggaccagcgcccgctacagcagcggcacccagagccgcatccggaggatgtggaatgacacagtgaggaagcagagcgagagcagcttcatcagcggggacatcaacagcaccagcaccctgaaccagggcatgacaggcaactacctgctgaccaaccccctgctgcggccccacggcaccaacaacccctacaacaccctgctggccgagaccgtggtgtgcaatgcccccagcgcccctgtgttcaacagccctggccacagcctgaacaatgcccgggacaccagcgccatggacaccctgcccctgaatggaaacttcaacaacagctacagcctgcacaagggggactacaatgacagcgtgcaggtggtggactgtggcctgagcctgaatgacacagcctttgagaagatgatcatcagcgagctggtgcacaacaacctgcggggcagcagcaagacccacaacctggagctgaccctgcctgtgaagcctgtgattggaggcagcagcagtgaagatgatgccatcgtggctgatgccagcagcctgatgcacagcgacaaccctggcctggagctgcaccacaaggagctggaggcccccctcatcccccagaggacccacagcctgctgtaccagccccagaagaaggtgaagtctgagggcacagacagctatgtgtcccagctgacagctgaggccgaggaccacctgcagagccccaacagagacagcctgtacacctccatgcccaacctgcgggacagcccctacccagagagcagcccagacatggaggaggacctgagccccagccgccgctcagaaaatgaagacatctactacaagtccatgcccaacctgggcgccggccaccagctgcagatgtgctaccagatcagccggggcaacagtgatggctacatcatccccatcaacaaggagggctgcatcccagaaggagatgtgcgggagggccagatgcagctggtgaccagcctgtag

SEQ ID NO: 34975 - DNA, 3723 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacagagtggaccagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaactatgaggacaaccggcccttcatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcaccggggacatcaacagcagcgccagcctgaaccgggagccctaccgggagacctccatgggcgtgaagctgaacatcgcctaccagattggagccagcgagcagtgccagggctacaagtgccacggctacagcaccacagagtggtag

SEQ ID NO: 34976 - DNA, 4344 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacagagtggaccagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgagagaaaatacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtgattgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgagagcgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcaccggggacatcaacagcagcgccagcctgaaccgggagggcctgctgaacaatgcccgggacacctctgtgatggacaccctgcccctgaatggaaatcatggcaacagctacagcatcgccagcggggagtacctgagcaactgtgtgcagatcatcgaccggggctacaaccacaatgaaacagccctggagaagaagatcctgaaggagctgaccagcaactacatccccagctacctgaacaaccacgagaggagcagcgagcagaacagaaacctgatgaacaagctggtgaacaacctgggcagcggccgggaggatgatgccatcgtgctggatgatgccaccagcttcaaccacgaggagagcctgggcctggagctgatccacgaggagagtgatgcccccctgctgcccccccgggtgtacagcacagagaaccaccagccccaccactacacccggcggcgcatcccccaggaccacagcgagagcttcttccccctgctgaccaatgagcacacagaggacctgcagagcccccaccgggacagcctgtacacctccatgcccaccctggccggcgtggccgccacagaatctgtgaccaccagcacccagacagagcccccaccagccaagtgtggagatgctgaagatgtgtactacaagtccatgcccaacctgggcagcaggaaccacgtgcaccagctgcacacctactaccagctgggccggggcagcagtgatggcttcatcgtgccccccaacaaggatggcaccccacctgagggcagcagcaagggccctgcccacctggtgaccagcctgtag

SEQ ID NO: 34977 - DNA, 2757 bp, Artificial Sequence
  Description of Artificial Sequence: Synthetic coding sequence
tgatacctgtgcctggccccagatggcatctgggacccccagggccctgacctgagcaactgcagcagcccctgggtgaaccacatcacccagaagctgaagtctggagaaacagctgccaacatcgcccgggagctggccgagcagaccaggaaccacctgaatgctggggacatcacctacagcgtgcgggccatggaccagctggtgggcctgctggatgtgcagctgaggaacctgacccctgggggcaaggacagcgctgcccggagcctgaacaaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcactggagacatcaacagcagcgccagcctgaaccgggagggcctgctgaacaatgcccgggacacctctgtgatggacaccctgcccctgaatggaaaccacggcaacagctacagcatcgccagcggggagtacctgagcaactgtgtgcagatcatcgaccggggctacaaccacaatgaaacagccctggagaagaagatcctgaaggagctgaccagcaactacatccccagctacctgaacaaccacgagaggagcagcgagcagaacagaaacctgatgaacaagctggtgaacaacctgggcagcggcagagaagatgatgccatcgtgctggatgatgccaccagcttcaaccacgaggagagcctgggcctggagctgattcatgaggagagtgatgcccccctgctgcccccccgggtgtacagcacagagaaccaccagccccaccactacacccggcggcgcatcccccaggaccacagcgagagcttcttccccctgctgaccaatgagcacacagaggacctgcagagcccccaccgggacagcctgtacacctccatgcccaccctggccggcgtggccgccacagagagcgtgaccaccagcacccagacagagcccccaccagccaagtgtggagatgctgaagatgtgtactacaagtccatgcccaacctgggcagcagaaatcatgtgcaccagctgcacacctactaccagctgggccggggcagcagtgatggcttcatcgtgccccccaacaaggatggcaccccacctgagggcagcagcaaaggacctgcccacctggtgaccagcctgtag

SEQ ID NO: 34978 - DNA, 3852 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaactatgaggacaaccggcccttcatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcaccggggacatcaacagcagcgccagcctgaacagaggagccatggccaaccacctgatcagcaatgccctgctgcggccccacggcaccaacaacccctacaacaccctgctgggggagcctgctgtgtgcaacaaccccagcgtgtccatgtacaatgcccaggagccctaccgggagacctccatgggcgtgaagctgaacatcgcctaccagatcggggccagcgagcagtgccagggctacaagtgccacggctacagcaccacagagtggtag

SEQ ID NO: 34979 - DNA, 3696 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcactggagacatcaacagcagcgccagcctgaaccgggagccctaccgggagacctccatgggcgtgaagctgaacatcgcctaccagatcggggccagcgagcagtgccagggctacaagtgccacggctacagcaccacagagtggtag

SEQ ID NO: 34980 - DNA, 4743 bp, Artificial Sequence
  Description of Artificial Sequence: Synthetic coding sequence
atgtggcccagccagctgctgatcttcatgatgctgctggcccccatcatccacggcggcaagcacagcgagcggcacccagccctggccgcccccctgcggcatgctgagaggagccctgggggcgccctgcccccaagacacctgctgcagcagcctgctgctgagaggacagctgcccaccggggccagggccccaggggggccacccggggcgtgcggggccctggggcccagggcgcccagattgctgcccaggccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaactatgaggacaaccggcccttcatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcaccggggacatcaacagcagcgccagcctgaacagaggagccatggccaaccacctgatcagcaatgccctgctgcggccccacggcaccaacaacccctacaacaccctgctgggggagcctgctgtgtgcaacaaccccagcgtgtccatgtacaatgcccaggagggcctgctgaacaatgcccgggacacctctgtgatggacaccctgcccctgaatggaaaccacggcaacagctacagcatcgccagcggggagtacctgagcaactgtgtgcagatcatcgaccggggctacaaccacaatgaaacagccctggagaagaagatcctgaaggagctgaccagcaactacatccccagctacctgaacaaccacgagaggagcagcgagcagaacagaaacctgatgaacaagctggtgaacaacctgggcagcggcagagaagatgatgccatcgtgctggatgatgccaccagcttcaaccacgaggagagcctgggcctggagctgattcatgaggagagtgatgcccccctgctgcccccccgggtgtacagcacagagaaccaccagccccaccactacacccggcggcgcatcccccaggaccacagcgagagcttcttccccctgctgaccaatgagcacacagaggacctgcagagcccccaccgggacagcctgtacacctccatgcccaccctggccggcgtggccgccacagagagcgtgaccaccagcacccagacagagcccccaccagccaagtgtggagatgctgaagatgtgtactacaagtccatgcccaacctgggcagcagaaatcatgtgcaccagctgcacacctactaccagctgggccggggcagcagtgatggcttcatcgtgccccccaacaaggatggcaccccacctgagggcagcagcaaaggacctgcccacctggtgaccagcctgtag

SEQ ID NO: 34981 - DNA, 4716 bp, Artificial Sequence
  Description of Artificial Sequence: Synthetic coding sequence
atgtggcccagccagctgctgatcttcatgatgctgctggcccccatcatccacggcggcaagcacagcgagcggcacccagccctggccgcccccctgcggcatgctgagaggagccctgggggcgccctgcccccaagacacctgctgcagcagcctgctgctgagaggacagctgcccaccggggccagggccccaggggggccacccggggcgtgcggggccctggggcccagggcgcccagattgctgcccaggccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcactggagacatcaacagcagcgccagcctgaacagaggagccatggccaaccacctgatcagcaatgccctgctgcggccccacggcaccaacaacccctacaacaccctgctgggggagcctgctgtgtgcaacaaccccagcgtgtccatgtacaatgcccaggagggcctgctgaacaatgcccgggacacctctgtgatggacaccctgcccctgaatggaaatcatggcaacagctacagcatcgccagcggggagtacctgagcaactgtgtgcagatcatcgaccggggctacaaccacaatgaaacagccctggagaagaagatcctgaaggagctgaccagcaactacatccccagctacctgaacaaccacgagaggagcagcgagcagaacagaaacctgatgaacaagctggtgaacaacctgggcagcggccgggaggatgatgccatcgtgctggatgatgccaccagcttcaaccacgaggagagcctgggcctggagctgatccacgaggagagtgatgcccccctgctgcccccccgggtgtacagcacagagaaccaccagccccaccactacacccggcggcgcatcccccaggaccacagcgagagcttcttccccctgctgaccaatgagcacacagaggacctgcagagcccccaccgggacagcctgtacacctccatgcccaccctggccggcgtggccgccacagaatctgtgaccaccagcacccagacagagcccccaccagccaagtgtggagatgctgaagatgtgtactacaagtccatgcccaacctgggcagcaggaaccacgtgcaccagctgcacacctactaccagctgggccggggcagcagtgatggcttcatcgtgccccccaacaaggatggcaccccacctgagggcagcagcaagggccctgcccacctggtgaccagcctgtag

SEQ ID NO: 34982 - DNA, 4029 bp, Artificial Sequence
  Description of Artificial Sequence: Synthetic coding sequence
atgtggcccagccagctgctgatcttcatgatgctgctggcccccatcatccacggcggcaagcacagcgagcggcacccagccctggccgcccccctgcggcatgctgagaggagccctgggggcgccctgcccccaagacacctgctgcagcagcctgctgctgagaggacagctgcccaccggggccagggccccaggggggccacccggggcgtgcggggccctggggcccagggcgcccagattgctgcccaggccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcactggagacatcaacagcagcgccagcctgaacagaggagccatggccaaccacctgatcagcaatgccctgctgcggccccacggcaccaacaacccctacaacaccctgctgggggagcctgctgtgtgcaacaaccccagcgtgtccatgtacaatgcccaggagccctaccgggagacctccatgggcgtgaagctgaacatcgcctaccagattggagccagcgagcagtgccagggctacaagtgccacggctacagcaccacagagtggtag

SEQ ID NO: 34983 - DNA, 4587 bp, Artificial Sequence
  Description of Artificial Sequence: Synthetic coding sequence
atgtggcccagccagctgctgatcttcatgatgctgctggcccccatcatccacggcggcaagcacagcgagcggcacccagccctggccgcccccctgcggcatgctgagaggagccctgggggcgccctgcccccaagacacctgctgcagcagcctgctgctgagaggacagctgcccaccggggccagggccccaggggggccacccggggcgtgcggggccctggggcccagggcgcccagattgctgcccaggccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcactggagacatcaacagcagcgccagcctgaaccgggagggcctgctgaacaatgcccgggacacctctgtgatggacaccctgcccctgaatggaaaccacggcaacagctacagcatcgccagcggggagtacctgagcaactgtgtgcagatcatcgaccggggctacaaccacaatgaaacagccctggagaagaagatcctgaaggagctgaccagcaactacatccccagctacctgaacaaccacgagaggagcagcgagcagaacagaaacctgatgaacaagctggtgaacaacctgggcagcggcagagaagatgatgccatcgtgctggatgatgccaccagcttcaaccacgaggagagcctgggcctggagctgattcatgaggagagtgatgcccccctgctgcccccccgggtgtacagcacagagaaccaccagccccaccactacacccggcggcgcatcccccaggaccacagcgagagcttcttccccctgctgaccaatgagcacacagaggacctgcagagcccccaccgggacagcctgtacacctccatgcccaccctggccggcgtggccgccacagagagcgtgaccaccagcacccagacagagcccccaccagccaagtgtggagatgctgaagatgtgtactacaagtccatgcccaacctgggcagcagaaatcatgtgcaccagctgcacacctactaccagctgggccggggcagcagtgatggcttcatcgtgccccccaacaaggatggcaccccacctgagggcagcagcaaaggacctgcccacctggtgaccagcctgtag

SEQ ID NO: 34984 - DNA, 4056 bp, Artificial Sequence
  Description of Artificial Sequence: Synthetic coding sequence
atgtggcccagccagctgctgatcttcatgatgctgctggcccccatcatccacggcggcaagcacagcgagcggcacccagccctggccgcccccctgcggcatgctgagaggagccctgggggcgccctgcccccaagacacctgctgcagcagcctgctgctgagaggacagctgcccaccggggccagggccccaggggggccacccggggcgtgcggggccctggggcccagggcgcccagattgctgcccaggccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaactatgaggacaaccggcccttcatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcaccggggacatcaacagcagcgccagcctgaacagaggagccatggccaaccacctgatcagcaatgccctgctgcggccccacggcaccaacaacccctacaacaccctgctgggggagcctgctgtgtgcaacaaccccagcgtgtccatgtacaatgcccaggagccctaccgggagacctccatgggcgtgaagctgaacatcgcctaccagatcggggccagcgagcagtgccagggctacaagtgccacggctacagcaccacagagtggtag

SEQ ID NO: 34985 - DNA, 4539 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaactatgaggacaaccggcccttcatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcaccggggacatcaacagcagcgccagcctgaacagaggagccatggccaaccacctgatcagcaatgccctgctgcggccccacggcaccaacaacccctacaacaccctgctgggggagcctgctgtgtgcaacaaccccagcgtgtccatgtacaatgcccaggagggcctgctgaacaatgcccgggacacctctgtgatggacaccctgcccctgaatggaaaccacggcaacagctacagcatcgccagcggggagtacctgagcaactgtgtgcagatcatcgaccggggctacaaccacaatgaaacagccctggagaagaagatcctgaaggagctgaccagcaactacatccccagctacctgaacaaccacgagaggagcagcgagcagaacagaaacctgatgaacaagctggtgaacaacctgggcagcggcagagaagatgatgccatcgtgctggatgatgccaccagcttcaaccacgaggagagcctgggcctggagctgattcatgaggagagtgatgcccccctgctgcccccccgggtgtacagcacagagaaccaccagccccaccactacacccggcggcgcatcccccaggaccacagcgagagcttcttccccctgctgaccaatgagcacacagaggacctgcagagcccccaccgggacagcctgtacacctccatgcccaccctggccggcgtggccgccacagagagcgtgaccaccagcacccagacagagcccccaccagccaagtgtggagatgctgaagatgtgtactacaagtccatgcccaacctgggcagcagaaatcatgtgcaccagctgcacacctactaccagctgggccggggcagcagtgatggcttcatcgtgccccccaacaaggatggcaccccacctgagggcagcagcaaaggacctgcccacctggtgaccagcctgtag

SEQ ID NO: 34986 - DNA, 3927 bp, Artificial Sequence
  Description of Artificial Sequence: Synthetic coding sequence
atgtggcccagccagctgctgatcttcatgatgctgctggcccccatcatccacggcggcaagcacagcgagcggcacccagccctggccgcccccctgcggcatgctgagaggagccctgggggcgccctgcccccaagacacctgctgcagcagcctgctgctgagaggacagctgcccaccggggccagggccccaggggggccacccggggcgtgcggggccctggggcccagggcgcccagattgctgcccaggccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaactatgaggacaaccggcccttcatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcaccggggacatcaacagcagcgccagcctgaaccgggagccctaccgggagacctccatgggcgtgaagctgaacatcgcctaccagattggagccagcgagcagtgccagggctacaagtgccacggctacagcaccacagagtggtag

SEQ ID NO: 34987 - DNA, 3900 bp, Artificial Sequence
  Description of Artificial Sequence: Synthetic coding sequence
atgtggcccagccagctgctgatcttcatgatgctgctggcccccatcatccacggcggcaagcacagcgagcggcacccagccctggccgcccccctgcggcatgctgagaggagccctgggggcgccctgcccccaagacacctgctgcagcagcctgctgctgagaggacagctgcccaccggggccagggccccaggggggccacccggggcgtgcggggccctggggcccagggcgcccagattgctgcccaggccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcactggagacatcaacagcagcgccagcctgaaccgggagccctaccgggagacctccatgggcgtgaagctgaacatcgcctaccagatcggggccagcgagcagtgccagggctacaagtgccacggctacagcaccacagagtggtag

SEQ ID NO: 34988 - DNA, 3723 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaactatgaggacaaccggcccttcatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcaccggggacatcaacagcagcgccagcctgaaccgggagccctaccgggagacctccatgggcgtgaagctgaacatcgcctaccagattggagccagcgagcagtgccagggctacaagtgccacggctacagcaccacagagtggtag

SEQ ID NO: 34989 - DNA, 3825 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcactggagacatcaacagcagcgccagcctgaacagaggagccatggccaaccacctgatcagcaatgccctgctgcggccccacggcaccaacaacccctacaacaccctgctgggggagcctgctgtgtgcaacaaccccagcgtgtccatgtacaatgcccaggagccctaccgggagacctccatgggcgtgaagctgaacatcgcctaccagattggagccagcgagcagtgccagggctacaagtgccacggctacagcaccacagagtggtag

SEQ ID NO: 34990 - DNA, 4410 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaactatgaggacaaccggcccttcatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcaccggggacatcaacagcagcgccagcctgaaccgggagggcctgctgaacaatgcccgggacacctctgtgatggacaccctgcccctgaatggaaatcatggcaacagctacagcatcgccagcggggagtacctgagcaactgtgtgcagatcatcgaccggggctacaaccacaatgaaacagccctggagaagaagatcctgaaggagctgaccagcaactacatccccagctacctgaacaaccacgagaggagcagcgagcagaacagaaacctgatgaacaagctggtgaacaacctgggcagcggccgggaggatgatgccatcgtgctggatgatgccaccagcttcaaccacgaggagagcctgggcctggagctgatccacgaggagagtgatgcccccctgctgcccccccgggtgtacagcacagagaaccaccagccccaccactacacccggcggcgcatcccccaggaccacagcgagagcttcttccccctgctgaccaatgagcacacagaggacctgcagagcccccaccgggacagcctgtacacctccatgcccaccctggccggcgtggccgccacagaatctgtgaccaccagcacccagacagagcccccaccagccaagtgtggagatgctgaagatgtgtactacaagtccatgcccaacctgggcagcaggaaccacgtgcaccagctgcacacctactaccagctgggccggggcagcagtgatggcttcatcgtgccccccaacaaggatggcaccccacctgagggcagcagcaagggccctgcccacctggtgaccagcctgtag

SEQ ID NO: 34991 - DNA, 4512 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacaaggtggagcagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaagctgcagaagcgggagaggagctgccgggcctacgtgcaggccatggtggagaccgtgaacaacctgctgcagccccaggccctgaatgcctggagggacctgaccaccagtgaccagctgcgggccgccaccatgctgctgcacacagtggaggagagcgcctttgtgctggccgacaacctgctgaagacagacatcgtgcgggagaacacagacaacatcaagctggaggtggcccggctgagcacagagggcaacctggaggacctgaagtttcctgagaacatgggccacggcagcaccatccagctgagcgccaacaccctgaagcagaatggaagaaatggagagatccgggtggcctttgtgctgtacaacaacctgggcccctacctgagcacagaaaatgcctccatgaagctgggcacagaggccctgagcaccaaccacagcgtcatcgtgaacagccctgtgatcacagctgccatcaacaaggagttcagcaacaaggtgtacctggccgaccctgtggtgttcaccgtgaagcacatcaagcagagcgaggagaacttcaaccccaactgcagcttctggagctacagcaagaggaccatgacaggctactggagcacccagggctgccgcctgctgaccaccaacaagacccacaccacctgcagctgcaaccacctgaccaactttgctgtgctgatggcccacgtggaggtgaagcacagtgatgctgtgcatgacctgctgctggatgtgatcacctgggtgggcatcctgctgagcctggtgtgcctgctgatctgcatcttcaccttctgcttcttccggggcctgcagagcgacaggaacaccatccacaagaacctgtgcatcagcctgtttgtggccgagctgctcttcctgattggcatcaacagaacagaccagcccatcgcctgtgctgtgtttgctgccctgctgcacttcttcttcctggccgccttcacctggatgttcctggagggcgtgcagctgtacatcatgctggtggaggtgtttgaaagtgagcacagcaggaggaagtacttctacctggtgggctacggcatgcctgccctgattgtggccgtgtctgctgctgtggactaccgctcctatggaacagacaaggtgtgctggctgcggctggacacctacttcatctggagcttcatcggccctgccaccctcatcatcatgctgaatgtcatcttcctgggcatcgccctgtacaagatgttccaccacacagccatcctgaagccagagagcggctgcctggacaacatcaagtcctgggtgattggagccatcgccctgctgtgcctgctgggcctgacctgggccttcggcctgatgtacatcaatgaaagcaccgtcatcatggcctacctgttcaccatcttcaacagcctgcagggcatgttcatcttcatcttccactgtgtgctgcagaagaaggtgaggaaggagtatggcaagtgcctgcggacccactgctgcagcggcaagagcacagagagcagcatcggcagcggcaagaccagcggcagcaggaccccaggccgctacagcacaggcagccagagccgcatccggaggatgtggaatgacacagtgaggaagcagagcgagagcagcttcatcactggagacatcaacagcagcgccagcctgaacagaggagccatggccaaccacctgatcagcaatgccctgctgcggccccacggcaccaacaacccctacaacaccctgctgggggagcctgctgtgtgcaacaaccccagcgtgtccatgtacaatgcccaggagggcctgctgaacaatgcccgggacacctctgtgatggacaccctgcccctgaatggaaatcatggcaacagctacagcatcgccagcggggagtacctgagcaactgtgtgcagatcatcgaccggggctacaaccacaatgaaacagccctggagaagaagatcctgaaggagctgaccagcaactacatccccagctacctgaacaaccacgagaggagcagcgagcagaacagaaacctgatgaacaagctggtgaacaacctgggcagcggccgggaggatgatgccatcgtgctggatgatgccaccagcttcaaccacgaggagagcctgggcctggagctgatccacgaggagagtgatgcccccctgctgcccccccgggtgtacagcacagagaaccaccagccccaccactacacccggcggcgcatcccccaggaccacagcgagagcttcttccccctgctgaccaatgagcacacagaggacctgcagagcccccaccgggacagcctgtacacctccatgcccaccctggccggcgtggccgccacagaatctgtgaccaccagcacccagacagagcccccaccagccaagtgtggagatgctgaagatgtgtactacaagtccatgcccaacctgggcagcaggaaccacgtgcaccagctgcacacctactaccagctgggccggggcagcagtgatggcttcatcgtgccccccaacaaggatggcaccccacctgagggcagcagcaagggccctgcccacctggtgaccagcctgtag

SEQ ID NO: 34992 - DNA, 2124 bp, Artificial Sequence
  Description of Artificial Sequence: Synthetic coding sequence
atgtggcccagccagctgctgatcttcatgatgctgctggcccccatcatccacgccttcagccgggcccccatccccatggctgtggtgagaagagagctgagctgtgagagctaccccatcgagctgcgctgccccggcacagatgtgatcatgattgaaagtgccaactacggccgcacagatgacaagatctgtgacagcgaccctgcccagatggagaacatccgctgctacctgcctgatgcctacaagatcatgagccagcgctgcaacaacagaacccagtgtgctgtggtggccggcccagatgtgtttcctgacccctgccccggcacctacaagtacctggaggtgcagtatgaatgtgtgccctacagagtggaccagaaggtgttcctgtgccccggcctgctgaagggcgtgtaccagagcgagcacctgtttgaaagtgaccaccagagcggggcctggtgcaaggaccccctgcaggccagtgacaagatctactacatgccctggaccccctacagaacagacaccctgacagagtacagcagcaaggatgacttcatcgccggccggcccaccaccacctacaagctgccccaccgggtggatggcactggatttgtggtgtatgatggagccctcttcttcaacaaggagaggaccaggaacatcgtgaagtttgacctgcggacccgcatcaagtctggagaggccatcatcgccaatgccaactaccatgacaccagcccctaccgctggggcggcaagagtgacatcgacctggccgtggatgaaaatggcctgtgggtgatctatgccacagagcagaacaacgggaagatcgtcatcagccagctgaacccctacaccctgagaattgagggcacctgggacacagcctatgacaagaggtctgccagcaatgccttcatgatctgtggcatcctgtatgtggtgaagtctgtgtatgaagatgatgacaatgaggccactggaaacaagattgactacatctacaacacagaccagagcaaggacagcctggtggatgtgcccttccccaacagctaccagtacatcgctgctgtggactacaacccccgggacaacctgctgtatgtgtggaacaactaccacgtggtgaagtacagcctggactttggccccctggacagccgcagcggccaggcccaccacggccaggtgtcctacatcagcccccccatccacctggacagcgagctggagcggcccagcgtgaaggacatcagcaccaccggccccctgggcatgggcagcaccaccaccagcaccaccctgcggaccaccaccctgagccctggccgcagcaccacccccagcgtgtctggaagaagaaacagaagcaccagcacccccagccctgctgtggaggtgctggatgacatgaccacccacctgcccagcgccagcagccagatcccagccctggaggagagctgtgaggccgtggaggcccgggagatcatgtggttcaagacccggcagggccagatcgccaagcagccctgcccagctggcaccatcggcgtgtccacctacctgtgcctggccccagatggcatctgggacccccagggccctgacctgagcaactgcagcagcccctgggtgaaccacatcacccagaagctgaagagcggggagacagctgccaacatcgcccgggagctggccgagcagaccaggaaccacctgaatgctggggacatcacctacagcgtgcgggccatggaccagctggtgggcctgctggatgtgcagctgaggaacctgaccccaggcggcaaggacagcgctgcccggagcctgaacaaggccatggtggagaccgtgaacaacctgctgcagccccaggccctgaatgcctggagggacctgaccaccagtgaccagctgcgggccgccaccatgctgctgcacacagtggaggagagcgcctttgtgctggtgctgcaggtgtgcctgcctgtgcgggagcagagcttcctgcccttcttctccttcttcatcttcttcttctccttcctgcccttcatccccctgaagttccggctggccaagaacaagtag

SEQ ID NO: 34993 - DNA, 4410 bp, Artificial Sequence; identical to SEQ ID NO: 34990
  Description of Artificial Sequence: Synthetic coding sequence

SEQ ID NO: 34994 - DNA, 1125 bp, Artificial Sequence
  Description of Artificial Sequence: Synthetic coding sequence
atgaggcctggaacagccctgcaggccgtgctgctggccgtgctgctggtgggcctgcgggccgccaccggccgcctgctgagcggccagcctgtgtgccggggcggcacccagaggccctgctacaaggtgatctacttccatgacaccagccggcggctgaactttgaggaggccaaggaggcctgcagaagagatggcggccagctggtgtccattgaaagtgaagatgagcagaagctgattgagaagttcatcgagaacctgctgcccagtgatggagacttctggattggcctgcggcggcgggaggagaagcagagcaacagcacagcctgccaggacctgtatgcctggacagatggcagcatcagccagttcaggaactggtacgtggatgagcccagctgtggcagcgaggtgtgtgtggtgatgtaccaccagcccagcgccccagctggcattggaggcccctacatgttccagtggaatgatgaccgctgcaacatgaagaacaacttcatctgcaagtacagtgatgagaagccagctgtgcccagccgggaggccgagggggaggagacagagctgaccacccctgtgctgcctgaggagacccaggaggaggatgccaagaagaccttcaaggagagccgggaggccgccctgaacctggcctacatcctgatccccagcatccccctgctgctgctgctggtggtgaccaccgtggtgtgctgggtgtggatctgcaggaagaggaagcgggagcagcctgaccccagcaccaagaagcagcacaccatctggcccagcccccaccagggcaacagcccagacctggaggtgtacaacgtcatcaggaagcagagcgaggccgacctggccgagaccaggccagacctgaagaacatctccttccgggtgtgcagcggggaggccaccccagatgacatgagctgtgactatgacaacatggctgtgaaccccagcgagagcggctttgtgaccctggtgtctgtggagagcggctttgtgaccaatgacatctatgagttctccccagaccagatgggccgcagcaaggagagcggctgggtggagaatgagatctacggctactag

SEQ ID NO: 34995 - DNA, 1149 bp, Artificial Sequence
  Description of Artificial Sequence: Synthetic coding sequence
atgaggcctggaacagccctgcaggccgtgctgctggccgtgctgctggtgggcctgcgggccgccaccggccgcctgctgagcgccagtgacctggacctgcggggcggccagcctgtgtgccggggcggcacccagaggccctgctacaaggtgatctacttccatgacaccagccggcggctgaactttgaggaggccaaggaggcctgcagaagagatggcggccagctggtgtccattgaaagtgaagatgagcagaagctgattgagaagttcatcgagaacctgctgcccagtgatggagacttctggattggcctgcggcggcgggaggagaagcagagcaacagcacagcctgccaggacctgtatgcctggacagatggcagcatcagccagttcaggaactggtacgtggatgagcccagctgtggcagcgaggtgtgtgtggtgatgtaccaccagcccagcgccccagctggcattggaggcccctacatgttccagtggaatgatgaccgctgcaacatgaagaacaacttcatctgcaagtacagtgatgagaagccagctgtgcccagccgggaggccgagggggaggagacagagctgaccacccctgtgctgcctgaggagacccaggaggaggatgccaagaagaccttcaaggagagccgggaggccgccctgaacctggcctacatcctgatccccagcatccccctgctgctgctgctggtggtgaccaccgtggtgtgctgggtgtggatctgcaggaagaggaagcgggagcagcctgaccccagcaccaagaagcagcacaccatctggcccagcccccaccagggcaacagcccagacctggaggtgtacaacgtcatcaggaagcagagcgaggccgacctggccgagaccaggccagacctgaagaacatctccttccgggtgtgcagcggggaggccaccccagatgacatgagctgtgactatgacaacatggctgtgaaccccagcgagagcggctttgtgaccctggtgtctgtggagagcggctttgtgaccaatgacatctatgagttctccccagaccagatgggccgcagcaaggagagcggctgggtggagaatgagatctacggctactag

SEQ ID NO: 34996 - DNA, 690 bp, Artificial Sequence
  Description of Artificial Sequence: Synthetic coding sequence
atggtgaccagcggcctgggcagcggcggcgtgagaagaaacaaggccatcgcccagcctgcccggaccttcatgctgggcctgatggccgcctaccacaacctggagaagccagctgtgcccagccgggaggccgagggggaggagacagagctgaccacccctgtgctgcctgaggagacccaggaggaggatgccaagaagaccttcaaggagagccgggaggccgccctgaacctggcctacatcctgatccccagcatccccctgctgctgctgctggtggtgaccaccgtggtgtgctgggtgtggatctgcaggaagaggaagcgggagcagcctgaccccagcaccaagaagcagcacaccatctggcccagcccccaccagggcaacagcccagacctggaggtgtacaacgtcatcaggaagcagagcgaggccgacctggccgagaccaggccagacctgaagaacatctccttccgggtgtgcagcggggaggccaccccagatgacatgagctgtgactatgacaacatggctgtgaaccccagcgagagcggctttgtgaccctggtgtctgtggagagcggctttgtgaccaatgacatctatgagttctccccagaccagatgggccgcagcaaggagagcggctgggtggagaatgagatctacggctactag

SEQ ID NO: 34997 - DNA, 1014 bp, Artificial Sequence
  Description of Artificial Sequence: Synthetic coding sequence
atgaggcctggaacagccctgcaggccgtgctgctggccgtgctgctggtgggcctgcgggccgccaccggccgcctgctgagcggccagcctgtgtgccggggcggcacccagaggccctgctacaaggtgatctacttccatgacaccagccggcggctgaactttgaggaggccaaggaggcctgcagaagaagagaggagaagcagagcaacagcacagcctgccaggacctgtatgcctggacagatggcagcatcagccagttcaggaactggtacgtggatgagcccagctgtggcagcgaggtgtgtgtggtgatgtaccaccagcccagcgccccagctggcatcggcggcccctacatgttccagtggaatgatgaccgctgcaacatgaagaacaacttcatctgcaagtacagtgatgagaagccagctgtgcccagccgggaggccgagggggaggagacagagctgaccacccctgtgctgcctgaggagacccaggaggaggatgccaagaagaccttcaaggagagccgggaggccgccctgaacctggcctacatcctgatccccagcatccccctgctgctgctgctggtggtgaccaccgtggtgtgctgggtgtggatctgcaggaagaggaagcgggagcagcctgaccccagcaccaagaagcagcacaccatctggcccagcccccaccagggcaacagcccagacctggaggtgtacaacgtcatcaggaagcagagcgaggccgacctggccgagaccaggccagacctgaagaacatctccttccgggtgtgcagcggggaggccaccccagatgacatgagctgtgactatgacaacatggctgtgaaccccagcgagagcggctttgtgaccctggtgtctgtggagagcggctttgtgaccaatgacatctatgagttctccccagaccagatgggccgcagcaaggagagcggctgggtggagaatgagatctacggctactag

SEQ ID NO: 34998 - DNA, 405 bp, Artificial Sequence
  Description of Artificial Sequence: Synthetic coding sequence
atgaggcctggaacagccctgcaggccgtgctgctggccgtgctgctggtgggcctgcgggccgccaccggccgcctgctgagcggccagcctgtgtgccggggcggcacccagaggccctgctacaaggtgatctacttccatgacaccagccggcggctgaactttgaggaggccaaggaggcctgcagaagagatggcggccagctggtgtccattgaaagtgaagatgagcagaagctgattgagaagttcatcgagaacctgctgcccagtgatggagacttctggattggcctgcggcggcgggaggagaagcagagcaacagcacagcctgccaggacctgtatgcctggacagatggcagcatcagccagttccgggagaccagcagcagcttctag

SEQ ID NO: 34999 - DNA, 1071 bp, Artificial Sequence
  Description of Artificial Sequence: Synthetic coding sequence
atggctgctgagggctggatctggcgctggggctggggccgccgctgcctgggccggcccggcctgctgggccctggccctggccccaccacccccctcttcctgctgctgctgctgggctctgtgacagctgacatcacagatggcaacagcgagcacctgaagcgggagcacagcctcatcaagccctaccagggcgtgggcagcagctccatgcccctgtgggacttccagggcagcaccatgctgaccagccagtatgtgcggctgaccccagatgagaggagcaaggagggcagcatctggaaccaccagccctgcttcctgaaggactgggagatgcacgtgcacttcaaggtgcatggaacaggcaagaagaacctgcatggagatggcatcgccctgtggtacacccgggaccggctggtgcccggccctgtgtttggcagcaaggacaacttccacggcctggccatcttcctggacacctacccaaatgatgagaccacagagagggtcttcccctacatctctgtgatggtgaacaacggcagcctgtcctatgaccacagcaaggatggccgctggacagagctggccggctgcacagctgacttcaggaacagagaccatgacaccttcctggccgtgcgctacagccggggccgcctgactgtgatgacagacctggaggacaagaatgagtggaagaactgcatcgacatcactggagtgcggctgcccaccggctactactttggagccagcgctggcactggagacctgagtgacaaccacgacatcatctccatgaagctgttccagctgatggtggagcacaccccagatgaggagagcattgactggaccaagattgagcccagcgtgaacttcctgaagagccccaaggacaacgtggatgaccccaccggcaacttccgcagcggccccctgaccggctggagggtcttcctgctgctgctgtgtgccctgctgggcatcgtggtgtgtgctgtggtgggcgctgtggtgttccagaagaggcaggagaggaacaagcgcttctactag

SEQ ID NO: 35000 - DNA, 858 bp, Artificial Sequence
  Description of Artificial Sequence: Synthetic coding sequence
atgcccctgtgggacttccagggcagcaccatgctgaccagccagtatgtgcggctgaccccagatgagaggagcaaggagggcagcatctggaaccaccagccctgcttcctgaaggactgggagatgcacgtgcacttcaaggtgcacggcaccgggaagaagaacctgcatggagatggcatcgccctgtggtacacccgggaccggctggtgcccggccctgtgtttggcagcaaggacaacttccacggcctggccatcttcctggacacctacccaaatgatgagaccacagagagggtcttcccctacatctctgtgatggtgaacaacggcagcctgtcctatgaccacagcaaggatggccgctggacagagctggccggctgcacagctgacttcaggaacagagaccatgacaccttcctggccgtgcgctacagccggggccgcctgactgtgatgacagacctggaggacaagaatgagtggaagaactgcatcgacatcaccggggtgcggctgcccaccggctactactttggagccagcgctggcaccggggacctgagtgacaaccacgacatcatctccatgaagctgttccagctgatggtggagcacaccccagatgaggagagcattgactggaccaagattgagcccagcgtgaacttcctgaagagccccaaggacaacgtggatgaccccactggaaacttccgcagcggccccctgaccggctggagggtcttcctgctgctgctgtgtgccctgctgggcatcgtggtgtgtgctgtggtgggcgctgtggtgttccagaagaggcaggagaggaacaagcgcttctactag

SEQ ID NO: 35001 - DNA, 1047 bp, Artificial Sequence
  Description of Artificial Sequence: Synthetic coding sequence
atggccgccaccctgggccccctgggctcctggcagcagtggaggcgctgcctgagcgccagagatggcagcaggatgctgctgctgctgctgctgctgggcagcggccagggcccccagcaggtgggcgccggccagacctttgagtacctgaagcgggagcacagcctgagcaagccctaccagggcgtgggcaccggcagcagcagcctgtggaacctgatgggaaatgccatggtgatgacccagtacatccggctgaccccagacatgcagagcaagcagggcgccctgtggaacagagtgccctgcttcctgcgggactgggagctgcaggtgcacttcaagatccacggccagggcaagaagaacctgcatggagatggcctggccatctggtacaccaaggacaggatgcagcccggccctgtgtttggaaacatggacaagtttgtgggcctgggcgtgtttgtggacacctacccaaatgaggagaagcagcaggagagggtcttcccctacatcagcgccatggtgaacaacggcagcctgtcctatgaccacgagagagatggccggcccacagagctgggcggctgcacagccatcgtgaggaacctgcactatgacaccttcctggtgatccgctacgtgaagaggcacctgaccatcatgatggacattgatggcaagcatgagtggagggactgcatcgaggtgcctggggtgcggctgccccggggctactacttcggcaccagcagcatcactggagacctgagtgacaaccatgatgtgatcagcctgaagctgtttgagctgactgtggagaggaccccagaggaggagaagctgcacagagatgtgttcctgcccagcgtggacaacatgaagctgcctgagatgacagcccccctgccccccctgagcggcctggccctcttcctgattgtgttcttcagcctggtgttttctgtgtttgccatcgtgattggcatcatcctgtacaacaagtggcaggagcagagcaggaagcgcttctactag

SEQ ID NO: 35002 - DNA, 1080 bp, Artificial Sequence
  Description of Artificial Sequence: Synthetic coding sequence
atggccgccaccctgggccccctgggctcctggcagcagtggaggcgctgcctgagcgccagagatggcagcaggatgctgctgctgctgctgctgctgggcagcggccagggcccccagcaggtgggcgccggccagacctttgagtacctgaagcgggagcacagcctgagcaagccctaccagggcgtgggcaccggcagcagcagcctgtggaacctgatgggaaatgccatggtgatgacccagtacatccggctgaccccagacatgcagagcaagcagggcgccctgtggaacagagtgccctgcttcctgcgggactgggagctgcaggtgcacttcaagatccacggccagggcaagaagaacctgcatggagatggcctggccatctggtacaccaaggacaggatgcagcccggccctgtgtttggaaacatggacaagtttgtgggcctgggcgtgtttgtggacacctacccaaatgaggagaagcagcaggaggcccagaagaggcgctacagccctggggtgcagagggtcttcccctacatcagcgccatggtgaacaacggcagcctgtcctatgaccacgagagagatggccggcccacagagctgggcggctgcacagccatcgtgaggaacctgcactatgacaccttcctggtgatccgctacgtgaagaggcacctgaccatcatgatggacattgatggcaagcatgagtggagggactgcatcgaggtgcctggggtgcggctgccccggggctactacttcggcaccagcagcatcaccggggacctgagtgacaaccatgatgtgatcagcctgaagctgtttgagctgactgtggagaggaccccagaggaggagaagctgcacagagatgtgttcctgcccagcgtggacaacatgaagctgcctgagatgacagcccccctgccccccctgagcggcctggccctcttcctgattgtgttcttcagcctggtgttttctgtgtttgccatcgtcatcggcatcatcctgtacaacaagtggcaggagcagagcaggaagcgcttctactag

SEQ ID NO: 35003 - DNA, 645 bp, Artificial Sequence
  Description of Artificial Sequence: Synthetic coding sequence
atggacaaggagcggcgcatctgcatgggcatggcctggcagagcggcacccagagaattggctgcagccaggcccagaagaggcgctacagccctggggtgcagagggtcttcccctacatcagcgccatggtgaacaacggcagcctgtcctatgaccacgagagagatggccggcccacagagctgggcggctgcacagccatcgtgaggaacctgcactatgacaccttcctggtgatccgctacgtgaagaggcacctgaccatcatgatggacattgatggcaagcatgagtggagggactgcatcgaggtgcctggggtgcggctgccccggggctactacttcggcaccagcagcatcactggagacctgagtgacaaccatgatgtgatcagcctgaagctgtttgagctgactgtggagaggaccccagaggaggagaagctgcacagagatgtgttcctgcccagcgtggacaacatgaagctgcctgagatgacagcccccctgccccccctgagcggcctggccctcttcctgattgtgttcttcagcctggtgttttctgtgtttgccatcgtgattggcatcatcctgtacaacaagtggcaggagcagagcaggaagcgcttctactag

SEQ ID NO: 35004 - DNA, 612 bp, Artificial Sequence
  Description of Artificial Sequence: Synthetic coding sequence
atggacaaggagcggcgcatctgcatgggcatggcctggcagagcggcacccagagaattggctgcagccagagggtcttcccctacatcagcgccatggtgaacaacggcagcctgtcctatgaccacgagagagatggccggcccacagagctgggcggctgcacagccatcgtgaggaacctgcactatgacaccttcctggtgatccgctacgtgaagaggcacctgaccatcatgatggacattgatggcaagcatgagtggagggactgcatcgaggtgcctggggtgcggctgccccggggctactacttcggcaccagcagcatcaccggggacctgagtgacaaccatgatgtgatcagcctgaagctgtttgagctgactgtggagaggaccccagaggaggagaagctgcacagagatgtgttcctgcccagcgtggacaacatgaagctgcctgagatgacagcccccctgccccccctgagcggcctggccctcttcctgattgtgttcttcagcctggtgttttctgtgtttgccatcgtcatcggcatcatcctgtacaacaagtggcaggagcagagcaggaagcgcttctactag

SEQ ID NO: 35005 - DNA, 633 bp, Artificial Sequence
  Description of Artificial Sequence: Synthetic coding sequence
atgcagcccggccctgtgtttggaaacatggacaagtttgtgggcctgggcgtgtttgtggacacctacccaaatgaggagaagcagcaggagagggtcttcccctacatcagcgccatggtgaacaacggcagcctgtcctatgaccacgagagagatggccggcccacagagctgggcggctgcacagccatcgtgaggaacctgcactatgacaccttcctggtgatccgctacgtgaagaggcacctgaccatcatgatggacattgatggcaagcatgagtggagggactgcatcgaggtgcctggggtgcggctgccccggggctactacttcggcaccagcagcatcactggagacctgagtgacaaccatgatgtgatcagcctgaagctgtttgagctgactgtggagaggaccccagaggaggagaagctgcacagagatgtgttcctgcccagcgtggacaacatgaagctgcctgagatgacagcccccctgccccccctgagcggcctggccctcttcctgattgtgttcttcagcctggtgttttctgtgtttgccatcgtgattggcatcatcctgtacaacaagtggcaggagcagagcaggaagcgcttctactag

SEQ ID NO: 35006 - DNA, 1581 bp, Artificial Sequence
  Description of Artificial Sequence: Synthetic coding sequence
atgcctgctgtgtctggccctggccccctcttctgcctgctgctgctgctgctggacccccacagccctgagaccggctgcccccccctgcggagatttgagtacaagctgtccttcaagggcccccggctggccctgcctggagctggcatccccttctggagccaccacggagatgccatcctgggcctggaggaggtgcggctgacccccagcatgaggaacagaagtggagctgtgtggagccgggcctctgtgcccttcagcgcctgggaggtggaggtgcagatgagggtgacaggcctgggccggcggggggcccagggcatggctgtgtggtacacccggggccggggccacgtgggctctgtgctgggcggcctggcctcctgggatggcatcggcatcttctttgacagccctgctgaggacacccaggacagccctgccatccgggtgctggccagtgatggccacatccccagcgagcagcctggagatggagccagccagggcctgggcagctgccactgggacttcaggaaccggccccaccccttccgggcccgcatcacctactggggccagaggctgaggatgagcctgaacagcggcctgacccccagcgaccctggagagttctgtgtggatgtgggccccctgctgctggtgcctgggggcttctttggagtgtctgctgccaccggcaccctggctgatgaccatgatgtgctgtccttcctgaccttcagcctgtctgagcccagccctgaggtgcccccccagcccttcctggagatgcagcagctgcggctggcccggcagctggagggcctgtgggcccggctgggcctgggcaccagagaagatgtgacccccaagagtgacagcgaggcccagggcgagggggagcggctgtttgacctggaggagaccctgggccgccaccggcgcatcctgcaggccctgcggggcctgagcaagcagctggcccaggccgagcggcagtggaagaagcagctgggccccccaggccaggcccggccagatggcggctgggccctggatgccagctgccagatccccagcaccccaggccggggcggccacctgtccatgagcctgaacaaggacagcgccaaggtgggcgccctgctgcacggccagtggaccctgctgcaggccctgcaggagatgagagatgctgctgtgaggatggctgctgaggcccaggtgtcctacctgcctgtgggcatcgagcaccacttcctggagctggaccacatcctgggcctgctgcaggaggagctgcggggccctgccaaggccgccgccaaggccccccggcccccaggccagcccccccgggccagcagctgcctgcagcccggcatcttcctgttctacctgctgatccagacagtgggcttcttcggctacgtgcacttccggcaggagctgaacaagagcctgcaggagtgcctgagcacaggcagcctgcccctgggccctgccccccacaccccccgggccctgggcatcctgcggcggcagcccctgcctgcctccatgcctgcctag

SEQ ID NO: 35007 - DNA, 1545 bp, Artificial Sequence
  Description of Artificial Sequence: Synthetic coding sequence
atgcctgctgtgtctggccctggccccctcttctgcctgctgctgctgctgctggacccccacagccctgagaccggctgcccccccctgcggagatttgagtacaagctgtccttcaagggcccccggctggccctgcctggagctggcatccccttctggagccaccacggagatgccatcctgggcctggaggaggtgcggctgacccccagcatgaggaacagaagtggagctgtgtggagccgggcctctgtgcccttcagcgcctgggaggtggaggtgcagatgagggtgacaggcctgggccggcggggggcccagggcatggctgtgtggtacacccggggccggggccacgtgggctctgtgctgggcggcctggcctcctgggatggcatcggcatcttctttgacagccctgctgaggacacccaggacagccctgccatccgggtgctggccagtgatggccacatccccagcgagcagcctggagatggagccagccagggcctgggcagctgccactgggacttcaggaaccggccccaccccttccgggcccgcatcacctactggggccagaggctgaggatgagcctgaacagcggcctgacccccagcgaccctggagagttctgtgtggatgtgggccccctgctgctggtgcctgggggcttctttggagtgtctgctgccaccggcaccctggccggggaggaccccaccggccaggtgcccccccagcccttcctggagatgcagcagctgcggctggcccggcagctggagggcctgtgggcccggctgggcctgggcaccagagaagatgtgacccccaagagtgacagcgaggcccagggcgagggggagcggctgtttgacctggaggagaccctgggccgccaccggcgcatcctgcaggccctgcggggcctgagcaagcagctggcccaggccgagcggcagtggaagaagcagctgggccccccaggccaggcccggccagatggcggctgggccctggatgccagctgccagatccccagcaccccaggccggggcggccacctgtccatgagcctgaacaaggacagcgccaaggtgggcgccctgctgcacggccagtggaccctgctgcaggccctgcaggagatgagagatgctgctgtgaggatggctgctgaggcccaggtgtcctacctgcctgtgggcatcgagcaccacttcctggagctggaccacatcctgggcctgctgcaggaggagctgcggggccctgccaaggccgccgccaaggccccccggcccccaggccagcccccccgggccagcagctgcctgcagcccggcatcttcctgttctacctgctgatccagacagtgggcttcttcggctacgtgcacttccggcaggagctgaacaagagcctgcaggagtgcctgagcacaggcagcctgcccctgggccctgccccccacaccccccgggccctgggcatcctgcggcggcagcccctgcctgcctccatgcctgcctag

SEQ ID NO: 35008 - DNA, 435 bp, Artificial Sequence
  Description of Artificial Sequence: Synthetic coding sequence
atgaggaacagaagtggagctgtgtggagccgggcctctgtgcccttcagcgcctgggaggtggaggtgcagatgagggtgacaggcctgggccggcggggggcccagggcatggacagccctgccatccgggtgctggccagtgatggccacatccccagcgagcagcctggagatggagccagccagggcctgggcagctgccactgggacttcaggaaccggccccaccccttccgggcccgcatcacctactggggccagaggctgaggatgagcctgaacagcggcctgacccccagcgaccctggagagttctgtgtggatgtgggccccctgctgctggtgcctgggggcttctttggagtgtctgctgccaccggcaccctggccggggaggaccccaccggccaggtgcgggcagagggccagtag

SEQ ID NO: 35009 - DNA, 204 bp, Artificial Sequence
  Description of Artificial Sequence: Synthetic coding sequence
atggtggatgtgaagtgcctgagtgactgcaagctgcagaaccagctggagaagctgggcttcagccctggccccatcctgcggggcctgcaggagcaccaggcccctgagagccacatgggcctgagccccaagcgggagaccacagccaggaagacccggctgagccgggccggggagaagaaggtgtcccagtgggcctag

SEQ ID NO: 35010 - DNA, 423 bp, Artificial Sequence
  Description of Artificial Sequence: Synthetic coding sequence
atggtggatgtgaagtgcctgagtgactgcaagctgcagaaccagctggagaagctgggcttcagccctggccccatcctgcagctgaacatcatcctgcagggcaacatcatcctgagcacagagaagagcaagaagctgaagaagtggccagaggccagcaccaccaagaggaaggctgtggacacctactgcctggactacaagcccagcaagggccgccgctgggccgcccgggcccccagcacccgcatcacctacggcaccatcaccaaggagcgggactactgtgccgaggaccagaccattgaatcctggagggaggagggcttccctgtgggcctgaagctggccgtgctgggcatcttcatcatcgtggtgtttgtgtacctgactgtggagaacaagagcctgtttggatag

SEQ ID NO: 35011 - DNA, 423 bp, Artificial Sequence; identical to SEQ ID NO: 35010
  Description of Artificial Sequence: Synthetic coding sequence

SEQ ID NO: 35012 - DNA, 546 bp, Artificial Sequence
  Description of Artificial Sequence: Synthetic coding sequence
atggtggatgtgaagtgcctgagtgactgcaagctgcagaaccagctggagaagctgggcttcagccctggccccatcctgcccagcaccaggaagctgtatgagaagaagctggtgcagctgctggtgtccccaccctgtgcccctcctgtgatgaatggcccccgggagctggatggagcccaggacagtgatgattctgaggagctgaacatcatcctgcagggcaacatcatcctgagcacagagaagagcaagaagctgaagaagtggccagaggccagcaccaccaagaggaaggctgtggacacctactgcctggactacaagcccagcaaaggaagacgctgggccgcccgggcccccagcacccgcatcacctacggcaccatcaccaaggagcgggactactgtgccgaggaccagaccatcgagagctggagggaggagggcttccctgtgggcctgaagctggccgtgctgggcatcttcatcatcgtggtgtttgtgtacctgactgtggagaacaagagcctgtttggatag

SEQ ID NO: 35013 - DNA, 327 bp, Artificial Sequence
  Description of Artificial Sequence: Synthetic coding sequence
atggtggatgtgaagtgcctgagtgactgcaagctgcagaaccagctggagaagctgggcttcagccctggccccatcctgcccagcaccaggaagctgtatgagaagaagctggtgcagctgctggtgtccccaccctgtgcccctcctgtgatgaatggcccccgggagctggatggagcccaggacagtgatgattctgagggcggcctgcaggagcaccaggcccctgagagccacatgggcctgagccccaagcgggagaccacagccaggaagacccggctgagcagagctggggagaagaaggtgtcccagtgggcctag

SEQ ID NO: 35014 - DNA, 327 bp, Artificial Sequence; identical to SEQ ID NO: 35013
  Description of Artificial Sequence: Synthetic coding sequence

SEQ ID NO: 35015 - DNA, 1512 bp, Artificial Sequence
  Description of Artificial Sequence: Synthetic coding sequence
atggccggcctgagtgacctggagctgcggcgggagctgcaggccctgggcttccagcccggccccatcacagacaccaccagagatgtgtacagaaacaagctgcggcggctgcggggggaggcccggctgagagatgaggagcggctgcgggaggaggcccggcccagaggagaggagcggctgcgggaggaggcccggctgcgggaggatgcccccctgcgggcccggcctgctgctgccagccccagggctgagccctggctgagccagcctgccagcggcagcgcctatgccacccctggggcctacggggacatccggcccagcgctgcctcctgggtgggcagccggggcctggcctacccagcccggcctgcccagctgcggcggcgggcctctgtgcggggcagcagtgaagaagatgaagatgcccggaccccagaccgggccacccagggccctggcctggccgcccggcgctggtgggccgccagccctgccccagcccggctgcccagcagcctgctgggccctgaccccaggcctggcctgcgggccacccgggccggccctgctggagctgcccgggcccggcctgaggtgggccggcggctggagcgctggctgagccggctgctgctgtgggccagcctgggcctgctgctggtgttcctgggcatcctgtgggtgaagatgggcaagcccagcgccccccaggaggccgaggacaacatgaagctgctgcctgtggactgtgagaggaagacagatgagttctgccaggccaagcagaaggccgccctgctggagctgctgcacgagctgtacaacttcctggccatccaggccggcaactttgaatgtggcaaccctgagaacctgaagagcaagtgcatccctgtgatggaggcccaggagtacatcgccaacgtgaccagcagcagcagcgccaagtttgaggccgccctgacctggatcctgagcagcaacaaggatgtgggcatctggctgaagggggaggaccagagcgagctggtgaccaccgtggacaaggtggtgtgcctggagagcgcccaccccaggatgggcgtgggctgccgcctgagccgggccctgctgacagctgtgaccaacgtgctgatcttcttctggtgcctggccttcctgtggggcctgctgatcctgctgaagtaccgctggaggaagctggaggaggaggagcaggccatgtatgagatggtgaagaagatcattgatgtggtgcaggaccactacgtggactgggagcaggacatggagcgctacccctacgtgggcatcctgcacgtgcgggacagcctcatccccccccagagcagaagaaggatgaagagggtgtgggacagagctgtggagttcctggccagcaatgaaagccgcatccagacagagagccaccgggtggccggggaggacatgctggtgtggcgctggaccaagcccagcagcttcagtgacagcgagaggtag

SEQ ID NO: 35016 - DNA, 606 bp, Artificial Sequence
  Description of Artificial Sequence: Synthetic coding sequence
atggaggcccaggagtacatcgccaacgtgaccagcagcagcagcgccaagtttgaggccgccctgacctggatcctgagcagcaacaaggatgtgggcatctggctgaagggggaggaccagagcgagctggtgaccaccgtggacaaggtggtgtgcctggagagcgcccaccccaggatgggcgtgggctgccgcctgagccgggccctgctgacagctgtgaccaacgtgctgatcttcttctggtgcctggccttcctgtggggcctgctgatcctgctgaagtaccgctggaggaagctggaggaggaggagcaggccatgtatgagatggtgaagaagatcattgatgtggtgcaggaccactacgtggactgggagcaggacatggagcgctacccctacgtgggcatcctgcacgtgcgggacagcctcatccccccccagagcagaagaaggatgaagagggtgtgggacagagctgtggagttcctggccagcaatgaaagccgcatccagacagagagccaccgggtggccggggaggacatgctggtgtggcgctggaccaagcccagcagcttcagtgacagcgagaggtag

SEQ ID NO: 35017 - DNA, 165 bp, Artificial Sequence
  Description of Artificial Sequence: Synthetic coding sequence
atggaggcccaggagtacatcgccaacgtgaccagcagcagcagcgccaagtttgaggccgccctgacctggatcctgagcagcaacaaggatgtgggcatctggctgaagggggaggaccagagcgagctggtgaccaccgtggacaaggtggtgtgcctgtag

SEQ ID NO: 35018 - DNA, 4470 bp, Artificial Sequence
  Description of Artificial Sequence: Synthetic coding sequence
atgaggcaggtgctgtggctgtgcaatgtgtgtgtgacagcccgggagaccaggcaccacctgcacctgcctgccatcctggacaagatgcctgcccctggggccctgatcctgctggccgctgtgtctgccagcggctgcctggccagccctgcccacccagatggctttgccctgggccgggcccccctggccccaccctatgctgtggtgctgatcagctgcagcggcctgctggccttcatcttcctgctgctgacctgcctgtgctgcaagagaggagatgtgggcttcaaggagtttgagaacccagaaggagaggactgcagcggggagtacaccccacctgctgaggagaccagcagcagccagagcctgcctgatgtgtacatcctgcccctggccgaggtgtccctgcccatgcctgccccccagcccagccacagcgacatgaccacccccctgggcctgagccggcagcacctgagctacctgcaggagatcggcagcggctggtttgggaaggtgatcctgggggagatcttcagtgactacaccccagcccaggtggtggtgaaggagctgcgggccagcgctggccccctggagcagaggaagttcatcagcgaggcccagccctaccgcagcctgcagcaccccaacgtgctgcagtgcctgggcctgtgtgtggagaccctgcccttcctgctgatcatggagttctgccagctgggggacctgaagcgctacctgcgggcccagaggcctcctgagggcctgagccctgagctgcccccccgggacctgcggaccctgcagaggatgggcctggagatcgcccggggcctggcccacctgcacagccacaactacgtgcacagcgacctggccctgaggaactgcctgctgaccagtgacctgactgtgagaattggagactatggcctggcccacagcaactacaaggaggactactacctgaccccagagcggctgtggatccccctgcgctgggccgcccctgagctgctgggggagctgcacggcaccttcatggtggtggaccagagccgggagagcaacatctggagcctgggcgtgaccctgtgggagctgtttgaatttggagcccagccctaccgccacctgagtgatgaggaggtgctggcctttgtggtgcggcagcagcacgtgaagctggcccggccccggctgaagctgccctatgctgactactggtatgacatcctgcagagctgctggaggcccccagcccagaggccttctgccagtgacctgcagctgcagctgacctacctgctgtctgagaggcctccccggcccccacctcctcctcctcctccaagagatggccccttcccctggccctggcccccagcccacagcgcccccaggcctggcaccctgagcagccccttccccctgctggatggcttccctggagctgaccctgatgatgtgctgactgtgacagagagcagccggggcctgaacctggagtgcctgtgggagaaggccaggagaggagctggccggggcggcggggccccagcctggcagcctgccagcgcccccccagccccccacgccaaccccagcaaccccttctatgaggccctgagcaccccatctgtgctgcccgtcatcagcgcccggagccccagcgtgtcctctgagtactacatccggctggaggagcacggcagccccccagagcccctcttccccaatgactgggaccccctggaccccggggtgcctgccccccaggccccccaggcccccagcgaggtgccccagctggtgtctgagacctgggccagccccctcttccctgccccccggcccttccctgcccagagcagcgccagcggcagcttcctgctgagcggctgggaccctgagggccgcggggccggggagaccctggccggggaccctgctgaggtgctgggggagcggggcacagccccctgggtggaggaggaggaggaggaggaggagggcagcagccctggagaggacagcagcagcctgggcggcggccccagccggcggggccccctgccctgccccctgtgcagccgggagggcgcctgcagctgcctgcccctggagagaggagatgctgtggccggctggggcggccacccagccctgggctgcccccaccccccagaagatgacagcagcctgcgggcagagcggggcagcctggccgacctgcccatggcccccccagccagcgcccctcctgagttcctggaccccctgatgggcgctgctgccccccagtacccaggccggggccccccaccagcccctcctcctcctcctcctccaccccgggccccagctgaccctgctgccagcccagaccccccatctgctgtggccagccctggcagcggcctgagcagccctggccccaagccaggggacagcggctatgaaacagagacccccttcagccctgagggcgccttccctgggggcggcgctgctgaggaggagggcgtgccccggccccgggcccctcctgagcccccagaccccggggccccccggcccccaccagaccccggccccctgcccctgcccggcccccgggagaagcccacctttgtggtgcaggtgtccacagagcagctgctgatgagcctgagagaagatgtgaccaggaacctgctgggggagaagggggccacagcccgggagaccggccccaggaaggccggccggggccctggcaaccgggagaaggtgcccggcctgaacagagaccccaccgtgctgggcaatggcaagcaggcccccagcctgagcctgcctgtgaatggagtgacagtgctggagaatggagaccagagggcccctggcatcgaggagaaggctgctgaaaatggagccctgggcagccctgagcgggaggagaaggtgctggagaatggagagctgaccccaccaagaagagaggagaaggccctggagaatggagagctgcggagccctgaggccggggagaaggtgctggtgaatggaggcctgaccccacccaagtctgaggacaaggtgtctgaaaatggaggcctgcgcttccccaggaacacagagaggcctcctgagaccggcccctggagggcccctggcccctgggagaagaccccagagagctggggccctgcccccaccatcggggagcccgcccctgagaccagcctggagcgggccccagcccccagcgctgtggtgagcagcagaaatggaggagaaacagcccctggccccctgggccctgcccccaagaatggcaccctggagcctggaacagaaagaagagcccctgagaccggcggggccccccgggcccctggagctggccgcctggacctgggcagcggcggccgggcccctgtgggcaccggcacagcccctgggggcggccctggcagcggcgtggatgccaaggccggctgggtggacaacacccggccccagcccccacctccacccctgcccccacctcctgaggcccagccccggcggctggagcccgccccaccccgggcccggcctgaggtggcccctgagggggagcccggggccccagacagccgggccggcggggacacagccctgtctggagatggagacccccccaagccagagaggaagggccctgagatgcccaggctcttcctggacctgggccccccccagggcaacagcgagcagatcaaggcccggctgagccggctgagcctggccctgccccccctgaccctgacccccttccctggccctggcccccggcggcccccctgggagggcgcagatgctggagctgctggaggagaggccggcggggccggggcccctggccctgcagaagaagatggagaagatgaagatgaagatgaggaggaggatgaggaggccgccgcccctggagctgctgctggcccccggggccctggccgggcccgggccgcccctgtgcctgtggtggtgagcagcgcagatgctgatgctgcccggcccctgcggggcctgctgaagagccccagaggagcagatgagccagaagattctgagctggagaggaagaggaagatggtgtccttccatggagatgtgacagtgtacctgtttgaccaggagacccccaccaatgagctgtctgtgcaggcccctcctgagggggacacagaccccagcaccccaccagccccacccaccccaccccacccagccaccccaggagatggcttccccagcaatgacagcggctttggaggcagctttgagtgggccgaggacttccccctgctgcccccacctggcccccccctgtgcttcagccgcttctctgtgtccccagccctggagaccccaggccccccagcccgggccccagatgcccggcctgctggccctgtggagaactag

SEQ ID NO: 35019 - DNA, 1656 bp, Artificial Sequence
  Description of Artificial Sequence: Synthetic coding sequence
atgcacctgcagatgagggaggacatggccaagtacagaaggatgtctggagtgcggccccagagcttccgggacctggagaccccaccccactgggccgcctatgacaccggcctggagctgctgggccggcaggaggccggcctggccctgccccggctggaggaggccctgcagggcagcctggcccagatggagagctgcagagctgactgtgagggccctgaggagcagcagggcgctgaggaggaggaggatggagctgccagccagggcggcctgtatgaggccatcgccggccactggatccaggtgctgcagtgccggcagagatgtgtgggggagacagccacccggcccggccgctccttccctgtgcctgacttcctgcccaaccagctgcggcggctgcacgaggcccacgcccaggtgggcaacctgagccaggccattgaaaatgtgctgtctgtgctgctcttctacccagaagatgaggccgccaagagggccctgaaccagtaccaggcccagctgggggagcccaggcctggcctgggcccccgggaggacatccagcgcttcatcctgcggagcctgggggagaagaggcagctgtactatgccatggagcacctgggcaccagcttcaaggaccctgacccctggaccccagctgccctgatccctgaggccctgcgggagaagctgcgggaggaccaggagaagaggccctgggaccacgagcctgtgaagcccaagcccctgacctactggaaggatgtgctgctgctggagggcgtgaccctgacccaggacagccggcagctgaatggaagtgaaagagctgtgctggatggcctgctgaccccagcagaatgtggggtgctgctgcagctggccaaggatgctgctggggccggggcccggagcggctaccggggcagaagaagcccccacacccctcatgaaagatttgagggcctgactgtgctgaaggccgcccagctggcccgggccggcaccgtgggcagccagggcgccaagctgctgctggaggtgtctgagcgggtgaggaccctgacccaggcctacttcagccctgagcggcccctgcacctgtccttcacccacctggtgtgccgcagcgccatcgagggggagcaggagcagaggatggacctgagccaccctgtgcacgccgacaactgtgtgctggaccctgacacaggagagtgctggagggagcccccagcctacacctacagagactacagcggcctgctgtacctgaatgatgacttccagggcggggacctcttcttcacagagcccaatgccctgactgtgacagcccgggtgcggccccgctgtggccgcctggtggccttcagcagtggagtggagaacccccatggagtgtgggccgtgacccggggccgccgctgtgccctggccctgtggcacacctgggcccctgagcaccgggagcaggagtggattgaggccaaggagctgctgcaggagagccaggaggaggaggaggaggaggaggaggagatgcccagcaaggaccccagccctgagccccccagccgccgccaccagagggtgcaggacaagacaggccgggccccccgggtgcgggaggagctgtag

SEQ ID NO: 35020 - DNA, 2208 bp, Artificial Sequence
  Description of Artificial Sequence: Synthetic coding sequence
atgctgcggctgctgcggcccctgctgctgctgctgctgctgcccccacctggcagccctgagcccccaggcctgacccagctgagccctggggccccaccccaggccccagacctgctgtatgcagatggcctgcgggcctatgctgctggggcctgggccccagctgtggccctgctgcgggaggccctgcggagccaggccgccctgggccgggtgcggctggactgtggggccagctgtgccgctgaccctggagctgccctgcctgctgtgctgctgggcgcccctgagccagattctggccctggccccacccagggctcctgggagcggcagctgctgcgggccgccctgcggcgggctgactgcctgacccagtgtgccgcccggcggctgggccctggaggagctgcccggcgggtgggcagcgccctgagagatgccttcagaagaagagagccctacaactacctgcagagggcctactaccagctgaagaagctggacctggccgctgctgctgcccacaccttctttgtggccaaccccatgcacctgcagatgagggaggacatggccaagtacagaaggatgtctggagtgcggccccagagcttccgggacctggagaccccaccccactgggccgcctatgacaccggcctggagctgctgggccggcaggaggccggcctggccctgccccggctggaggaggccctgcagggcagcctggcccagatggagagctgcagagctgactgtgagggccctgaggagcagcagggcgctgaggaggaggaggatggagctgccagccagggcggcctgtatgaggccatcgccggccactggatccaggtgctgcagtgccggcagagatgtgtgggggagacagccacccggcccggccgctccttccctgtgcctgacttcctgcccaaccagctgcggcggctgcacgaggcccacgcccaggtgggcaacctgagccaggccattgaaaatgtgctgtctgtgctgctcttctacccagaagatgaggccgccaagagggccctgaaccagtaccaggcccagctgggggagcccaggcctggcctgggcccccgggaggacatccagcgcttcatcctgcggagcctgggggagaagaggcagctgtactatgccatggagcacctgggcaccagcttcaaggaccctgacccctggaccccagctgccctgatccctgaggccctgcgggagaagctgcgggaggaccaggagaagaggccctgggaccacgagcctgtgaagcccaagcccctgacctactggaaggatgtgctgctgctggagggcgtgaccctgacccaggacagccggcagctgaatggaagtgaaagagctgtgctggatggcctgctgaccccagcagaatgtggggtgctgctgcagctggccaaggatgctgctggggccggggcccggagcggctaccggggcagaagaagcccccacacccctcatgaaagatttgagggcctgactgtgctgaaggccgcccagctggcccgggccggcaccgtgggcagccagggcgccaagctgctgctggaggtgtctgagcgggtgaggaccctgacccaggcctacttcagccctgagcggcccctgcacctgtccttcacccacctggtgtgccgcagcgccatcgagggggagcaggagcagaggatggacctgagccaccctgtgcacgccgacaactgtgtgctggaccctgacacaggagagtgctggagggagcccccagcctacacctacagagactacagcggcctgctgtacctgaatgatgacttccagggcggggacctcttcttcacagagcccaatgccctgactgtgacagcccgggtgcggccccgctgtggccgcctggtggccttcagcagtggagtggagaacccccatggagtgtgggccgtgacccggggccgccgctgtgccctggccctgtggcacacctgggcccctgagcaccgggagcaggagtggattgaggccaaggagctgctgcaggagagccaggaggaggaggaggaggaggaggaggagatgcccagcaaggaccccagccctgagccccccagccgccgccaccagagggtgcaggacaagacaggccgggccccccgggtgcgggaggagctgtag

SEQ ID NO: 35021 - DNA, 492 bp, Artificial Sequence
  Description of Artificial Sequence: Synthetic coding sequence
atgctgcggctgctgcggcccctgctgctgctgctgctgctgcccccacctggcagccctgagcccccaggcctgacccagctgagccctggggccccaccccaggccccagacctgctgtacctgaatgatgacttccagggcggggacctcttcttcacagagcccaatgccctgactgtgacagcccgggtgcggccccgctgtggccgcctggtggccttcagcagtggagtggagaacccccatggagtgtgggccgtgacccggggccgccgctgtgccctggccctgtggcacacctgggcccctgagcaccgggagcaggagtggattgaggccaaggagctgctgcaggagagccaggaggaggaggaggaggaggaggaggagatgcccagcaaggaccccagccctgagccccccagccgccgccaccagagggtgcaggacaagacaggccgggccccccgggtgcgggaggagctgtag

SEQ ID NO: 35022 - DNA, 1083 bp, Artificial Sequence
  Description of Artificial Sequence: Synthetic coding sequence
atggccctgagccgggtgtgctgggcccggtctgctgtgtggggcagcgctgtgaccccaggccactttgtgacccggcggctgcagctgggccgcagcggcctggcctggggcgcccccaggagcagcaagctgcacctgagccccaaggcagatgtgaagaacctgatgtcctatgtggtgaccaagaccaaggccatcaacgggaagtaccaccgcttcctgggccgccacttcccccgcttctacgtgctgtacaccatcttcatgaagggcctgcagatgctgtgggcagatgccaagaaggcccggcgcatcaagaccaacatgtggaagcacaacatcaagttccaccagctgccctaccgggagatggagcacctgcggcagttccggcaggatgtgaccaagtgcctcttcctgggcatcatcagcatccccccatttgccaactacctggtgttcctgctgatgtacctgttcccccggcagctgctgatccgccacttctggacccccaagcagcagacagacttcctggacatctaccacgccttcaggaagcagagccaccctgagatcatctcctacctggagaaggtgatccccctcatcagtgatgctggcctgcgctggaggctgacagacctgtgcaccaagatccagaggggcacccacccagccatccatgacatcctggccctgcgggagtgcttcagcaaccaccccctgggcatgaaccagctgcaggccctgcacgtgaaggccctgagccgggccatgctgctgaccagctacctgcccccacccctgctgcggcaccggctgaagacccacaccaccgtcatccaccagctggacaaggccctggccaagctgggcatcggccagctgacagcccaggaggtgaagagcgcctgctacctgcggggcctgaacagcacccacatcggagaagatcgctgcaggacctggctgggggagtggctgcagatcagctgcagcctgaaggaggccgagctgagcctgctgctgcacaacgtggtgctgctgagcaccaactacctgggcaccaggaggtag

SEQ ID NO: 35023 - DNA, 300 bp, Artificial Sequence
  Description of Artificial Sequence: Synthetic coding sequence
atggccctgagccgggtgtgctgggcccggtctgctgtgtggggcagcgctgtgaccccaggccactttgtgacccggcggctgcagctgggccgcagcggcctggcctggggcgcccccaggagcagcaagctgcacctgagccccaaggcagatgtgaagaacctgatgtcctatgtggtgaccaagaccaaggccatcaacgggaagtaccaccgcttcctgggccgccacttcccccgcttctacgtgctgtacaccatcttcatgaagggcacctgcttccctggcaactactag

SEQ ID NO: 35024 - DNA, 822 bp, Artificial Sequence
  Description of Artificial Sequence: Synthetic coding sequence
atggccctgagccgggtgtgctgggcccggtctgctgtgtggggcagcgctgtgaccccaggccactttgtgacccggcggctgcagctgggccgcagcggcctggcctggggcgcccccaggagcagcaagctgcacctgagccccaaggcagatgtgaagaacctgatgtcctatgtggtgaccaagaccaaggccatcaacgggaagtaccaccgcttcctgggccgccacttcccccgcttctacgtgctgtacaccatcttcatgaagggcatcatcagcatccccccatttgccaactacctggtgttcctgctgatgtacctgttcccccggcagctgctgatccgccacttctggacccccaagcagcagacagacttcctggacatctaccacgccttcaggaagcagagccaccctgagatcatctcctacctggagaaggtgatccccctcatcagtgatgctggcctgcgctggaggctgacagacctgtgcaccaagatccagaggggcacccacccagccatccatgacatcctggccctgcgggagtgcttcagcaaccaccccctgggcatgaaccagctgcaggccctgcacgtgaaggccctgagccgggccatgctgctgaccagctacctgcccccacccctgctgcggcaccggctgaagacccacaccaccgtcatccaccagctggacaaggccctggccaagctgggcatcggccagctgacagccctgcaccagctgccctgggacaaggccctgaatgagccctggagcggctggcactgcccagctgtggtgtag

SEQ ID NO: 35025 - DNA, 915 bp, Artificial Sequence
  Description of Artificial Sequence: Synthetic coding sequence
atgtcctatgtggtgaccaagaccaaggccatcaacgggaagtaccaccgcttcctgggccgccacttcccccgcttctacgtgctgtacaccatcttcatgaagggcctgcagatgctgtgggcagatgccaagaaggcccggcgcatcaagaccaacatgtggaagcacaacatcaagttccaccagctgccctaccgggagatggagcacctgcggcagttccggcaggatgtgaccaagtgcctcttcctgggcatcatcagcatccccccatttgccaactacctggtgttcctgctgatgtacctgttcccccggcagctgctgatccgccacttctggacccccaagcagcagacagacttcctggacatctaccacgccttcaggaagcagagccaccctgagatcatctcctacctggagaaggtgatccccctcatcagtgatgctggcctgcgctggaggctgacagacctgtgcaccaagatccagaggggcacccacccagccatccatgacatcctggccctgcgggagtgcttcagcaaccaccccctgggcatgaaccagctgcaggccctgcacgtgaaggccctgagccgggccatgctgctgaccagctacctgcccccacccctgctgcggcaccggctgaagacccacaccaccgtcatccaccagctggacaaggccctggccaagctgggcatcggccagctgacagcccaggaggtgaagagcgcctgctacctgcggggcctgaacagcacccacatcggagaagatcgctgcaggacctggctgggggagtggctgcagatcagctgcagcctgaaggaggccgagctgagcctgctgctgcacaacgtggtgctgctgagcaccaactacctgggcaccaggaggtag

SEQ ID NO: 35026 - DNA, 1122 bp, Artificial Sequence
  Description of Artificial Sequence: Synthetic coding sequence
atggccctgagccgggtgtgctgggcccggtctgctgtgtggggcagcgctgtgaccccaggccactttgtgacccggcggctgcagctgggccgcagcggcctggcctggggcgcccccaggagcagcaagctgcacctgagccccaaggcagatgtgaagaacctgatgtcctatgtggtgaccaagaccaaggccatcaacgggaagtaccaccgcttcctgggccgccacttcccccgcttctacgtgctgtacaccatcttcatgaagggcctgcagatgctgtgggcagatgccaagaaggcccggcgcatcaagaccaacatgtggaagcacaacatcaagttccaccagctgccctaccgggagatggagcacctgcggcaggtgtgggcccggggccgctacccagaggtgcatggagagttccggcaggatgtgaccaagtgcctcttcctgggcatcatcagcatccccccatttgccaactacctggtgttcctgctgatgtacctgttcccccggcagctgctgatccgccacttctggacccccaagcagcagacagacttcctggacatctaccacgccttcaggaagcagagccaccctgagatcatctcctacctggagaaggtgatccccctcatcagtgatgctggcctgcgctggaggctgacagacctgtgcaccaagatccagaggggcacccacccagccatccatgacatcctggccctgcgggagtgcttcagcaaccaccccctgggcatgaaccagctgcaggccctgcacgtgaaggccctgagccgggccatgctgctgaccagctacctgcccccacccctgctgcggcaccggctgaagacccacaccaccgtcatccaccagctggacaaggccctggccaagctgggcatcggccagctgacagcccaggaggtgaagagcgcctgctacctgcggggcctgaacagcacccacatcggggaggaccgctgcaggacctggctgggggagtggctgcagatcagctgcagcctgaaggaggccgagctgagcctgctgctgcacaacgtggtgctgctgagcaccaactacctgggcaccaggaggtag

SEQ ID NO: 35027 - DNA, 1782 bp, Artificial Sequence
  Description of Artificial Sequence: Synthetic coding sequence
atggatgctgccacagcccccaagcaggcctggccaccctggccacccctgctcttcctgctgctgctgcccggcggcagcggcggcagctgcccagctgtgtgtgactgcaccagccagccccaggccgtgctgtgtggccaccggcagctggaggccgtgcctgggggcctgcccctggacacagagctgctggacctgagcggcaaccggctgtggggcctgcagcagggcatgctgagccggctgagcctgctgcaggagctggacctgagctacaaccagctgagcaccctggagcccggggccttccacggcctgcagagcctgctgaccctgcggctgcagggcaaccggctgcgcatcatgggccctggggtcttcagcggcctgagcgccctgaccctgctggacctgcggctgaaccagatcgtgctcttcctggatggagccttcggggagctgggcagcctgcagaagctggaggtgggggacaaccacctggtgtttgtggcccctggggcctttgctggcctggccaagctgagcaccctgaccctggagcgctgcaacctgagcacagtgcccggcctggccctggcccggctgcctgccctggtggccctgcggctgcgggagctggacatcggccgcctgcctgctggggccctgcggggcctgggccagctgaaggagctggagatccacctgtggcccagcctggaggccctggaccccggcagcctggtgggcctgaacctgagcagcctggccatcacccgctgcaacctgagctctgtgcccttccaggccctgtaccacctgtccttcctgcgggtgctggacctgagccagaaccccatcagcgccatcccagcccggcggctgagccccctggtgcggctgcaggagctgcggctgagcggggcctgcctgaccagcattgctgcccacgccttccacggcctgacagccttccacctgctggatgtggccgacaatgccctgcagaccctggaggagacagccttccccagcccagacaagctggtgaccctgcggctgagcggcaaccccctgacctgtgactgccgcctgctgtggctgctgcggctgcggcggcacctggactttggcatgagccccccagcctgtgccggcccccaccacgtgcagggcaagagcctgaaggagttcagtgacatcctgcccccaggccacttcacctgcaagccagccctgatcaggaagagcggcccccgctgggtgattgctgaggagggcggccatgctgtgttcagctgcagcggagatggagaccctgcccccaccgtgtcctggatgaggcctcatggagcctggctgggccgggccggccgggtgcgggtgctggaggatggcaccctggagatccgctctgtgcagctgcgggacagaggagcctacgtgtgtgtggtgtccaatgtggccggaaatgacagcctgcggacctggctggaggtgatccaggtggagccccccaacggcaccctgagtgaccccaacatcaccgtgcccggcatccctggccccttcttcctggacagcagaggagtggccatggtgctggccgtgggcttcctgcccttcctgacctctgtgaccctgtgcttcggcctcatcgccctgtggagcaagggcaagggccgggtgaagcaccacatgacctttgattttgtggccccccggcccagcggggacaagaacagcggcggcaacagagtgacagccaagctgttctag

SEQ ID NO: 35028 - DNA, 1746 bp, Artificial Sequence
  Description of Artificial Sequence: Synthetic coding sequence
atgcccctgaagcactacctgctgctgctggtgggctgccaggcctggggcgccggcctggcctaccacggctgccccagcgagtgcacctgcagccgggccagccaggtggagtgcaccggggcccgcatcgtggccgtgcccacccccctgccctggaatgccatgagcctgcagatcctgaacacccacatcacagagctgaatgaaagccccttcctgaacatcagcgccctgattgccctgcgcatcgagaagaatgagctgagccgcatcacccctggggccttcaggaacctgggcagcctgcgctacctgagcctggccaacaacaagctgcaggtgctgcccatcggcctcttccagggcctggacagcctggagagcctgctgctgagcagcaaccagctgctgcagatccagcctgcccacttcagccagtgcagcaacctgaaggagctgcagctgcacggcaaccacctggagtacatcccagatggagcctttgaccacctggtgggcctgaccaagctgaacctgggcaagaacagcctgacccacatcagccccagggtcttccagcacctgggcaacctgcaggtgctgcggctgtatgagaaccggctgacagacatccccatgggcacctttgatggcctggtgaacctgcaggagctggccctgcagcagaaccagatcggcctgctgagccctggcctcttccacaacaaccacaacctgcagaggctgtacctgagcaacaaccacatcagccagctgcccccatctgtgttcatgcagctgccccagctgaaccggctgaccctgtttggaaacagcctgaaggagctgagccctggcatcttcggccccatgcccaacctgcgggagctgtggctgtatgacaaccacatcagcagcctgcctgacaacgtgttcagcaacctgcggcagctgcaggtgctgatcctgagcaggaaccagatctccttcatcagccctggggccttcaacggcctgacagagctgcgggagctgagcctgcacaccaatgccctgcaggacctggatggaaatgtgttcaggatgctggccaacctgcagaacatcagcctgcagaacaaccggctgcggcagctgcccggcaacatctttgccaacgtgaatggcctgatggccatccagctgcagaacaaccagctggagaacctgcccctgggcatctttgaccacctgggcaagctgtgtgagctgcggctgtatgacaacccctggaggtgtgacagcgacatcctgcccctgaggaactggctgctgctgaaccagccccggctgggcacagacacagtgcctgtgtgcttcagccctgccaacgtgcggggccagagcctcatcatcatcaacgtgaatgtggccgtgcccagcgtgcacgtgcctgaggtgcccagctacccagagaccccctggtacccagacacccccagctacccagacaccacctctgtgagcagcaccacagagctgaccagccctgtggaggactacacagacctgaccaccatccaggtgacagatgacagatctgtgtggggcatgacccaggcccagagcggcctggccatcgccgccatcgtcatcggcatcgtggccctggcctgcagcctggccgcctgtgtgggctgctgctgctgcaagaagaggagccaggccgtgctgatgcagatgaaggccccaaatgaatgttag

SEQ ID NO: 35029 - DNA, 1764 bp, Artificial Sequence
  Description of Artificial Sequence: Synthetic coding sequence
atgcccctggacaaggccatgcccctgaagcactacctgctgctgctggtgggctgccaggcctggggcgccggcctggcctaccacggctgccccagcgagtgcacctgcagccgggccagccaggtggagtgcaccggggcccgcatcgtggccgtgcccacccccctgccctggaatgccatgagcctgcagatcctgaacacccacatcacagagctgaatgaaagccccttcctgaacatcagcgccctgattgccctgcgcatcgagaagaatgagctgagccgcatcacccctggggccttcaggaacctgggcagcctgcgctacctgagcctggccaacaacaagctgcaggtgctgcccatcggcctcttccagggcctggacagcctggagagcctgctgctgagcagcaaccagctgctgcagatccagcctgcccacttcagccagtgcagcaacctgaaggagctgcagctgcacggcaaccacctggagtacatcccagatggagcctttgaccacctggtgggcctgaccaagctgaacctgggcaagaacagcctgacccacatcagccccagggtcttccagcacctgggcaacctgcaggtgctgcggctgtatgagaaccggctgacagacatccccatgggcacctttgatggcctggtgaacctgcaggagctggccctgcagcagaaccagatcggcctgctgagccctggcctcttccacaacaaccacaacctgcagaggctgtacctgagcaacaaccacatcagccagctgcccccatctgtgttcatgcagctgccccagctgaaccggctgaccctgtttggaaacagcctgaaggagctgagccctggcatcttcggccccatgcccaacctgcgggagctgtggctgtatgacaaccacatcagcagcctgcctgacaacgtgttcagcaacctgcggcagctgcaggtgctgatcctgagcaggaaccagatctccttcatcagccctggggccttcaacggcctgacagagctgcgggagctgagcctgcacaccaatgccctgcaggacctggatggaaatgtgttcaggatgctggccaacctgcagaacatcagcctgcagaacaaccggctgcggcagctgcccggcaacatctttgccaacgtgaatggcctgatggccatccagctgcagaacaaccagctggagaacctgcccctgggcatctttgaccacctgggcaagctgtgtgagctgcggctgtatgacaacccctggaggtgtgacagcgacatcctgcccctgaggaactggctgctgctgaaccagccccggctgggcacagacacagtgcctgtgtgcttcagccctgccaacgtgcggggccagagcctcatcatcatcaacgtgaatgtggccgtgcccagcgtgcacgtgcctgaggtgcccagctacccagagaccccctggtacccagacacccccagctacccagacaccacctctgtgagcagcaccacagagctgaccagccctgtggaggactacacagacctgaccaccatccaggtgacagatgacagatctgtgtggggcatgacccaggcccagagcggcctggccatcgccgccatcgtcatcggcatcgtggccctggcctgcagcctggccgcctgtgtgggctgctgctgctgcaagaagaggagccaggccgtgctgatgcagatgaaggccccaaatgaatgttag

SEQ ID NO: 35030 - DNA, 1764 bp, Artificial Sequence; identical to SEQ ID NO: 35029
  Description of Artificial Sequence: Synthetic coding sequence

SEQ ID NO: 35031 - DNA, 1113 bp, Artificial Sequence
  Description of Artificial Sequence: Synthetic coding sequence
atgaaggtgacaggcatcaccatcctcttctggcccctgtccatgatcctgctgagtgacaagatccagagcagcaagcgggaggtgcagtgcaacttcacagagaagaactacaccctcatcccagctgacatcaagaaggatgtgaccatcctggacctgagctacaaccagatcaccctgaatggaacagacaccagggtgctgcagacctacttcctgctgacagagctgtacctgattgagaacaaggtgaccatcctgcacaacaatggatttggaaacctgagcagcctggagatcctgaacatctgcaggaacagcatctacgtgatccagcagggcgccttcctgggcctgaacaagctgaagcagctgtacctgtgccagaacaagattgagcagctgaatgctgatgtgtttgtgcccctgcggagcctgaagctgctgaacctgcagggcaacctgatctcctacctggatgtgcccccactcttccacctggagctgatcaccctgtatggcaacctgtggaactgcagctgcagcctcttcaacctgcagaactggctgaacaccagcaatgtgaccctggagaatgaaaacatcaccatgtgcagctaccccaacagcctgcagagctacaacatcaagacagtgccccacaaggccgagtgccacagcaagttccccagctctgtgacagaggacctgtacatccacttccagcccatcagcaacagcatcttcaacagcagcagcaacaacctgaccagaaattctgaacatgagcccctgggcaagtcctgggccttcctggtgggcgtggtggtgacagtgctgaccaccagcctgctgatcttcatcgccatcaagtgccccatctggtacaacatcctgctgagctacaaccaccaccggctggaggagcatgaagctgagacctatgaagatggcttcaccggcaaccccagcagcctgagccagatccctgagaccaacagcgaggagaccaccgtcatctttgagcagctgcacagctttgtggtggatgatgatggcttcatcgaggacaagtacatcgacatccacgagctgtgtgaagaaaattag

SEQ ID NO: 35032 - DNA, 1542 bp, Artificial Sequence
  Description of Artificial Sequence: Synthetic coding sequence
atggccctgcgggccccagccctgctgcccctgctgctgctgctgctgcccctgcgggctgctggctgcccagctgcctgccgctgctacagcgccaccgtggagtgtggggccctgcggctgcgggtggtgcccctgggcatccccccaggcacccagaccctcttcctgcaggacaacaacatcgcccggctggagcccggggccctggcccccctggccgccctgcggcggctgtacctgcacaacaacagcctgcgggccctggaggccggggccttccgggcccagccccggctgctggagctggccctgaccagcaaccggctgcggggcctgcggagcggggcctttgtgggcctggcccagctgcgggtgctgtacctggccggcaaccagctggcccggctgctggacttcaccttcctgcacctgccccggctgcaggagctgcacctgcaggagaacagcattgagctgctggaggaccaggccctggccggcctgagcagcctggccctgctggacctgagcaggaaccagctgggcaccatcagccgggaggccctgcagcccctggccagcctgcaggtgctgcggctgacagagaacccctggaggtgtgactgtgccctgcactggctgggcgcctggatcaaggagggcggccagaggctgctgaccagccgggacaggaagatcatgtgtgccgagcccccccggctggccctgcagagcctgctggatgtgagccacagcagcctcatctgcatccccccatctgtgcacgtgcagcccctggagctgacagccaacctgggggaggacctgcgggtggcctgccaggccagcggctacccccagcccctggtgacctggaggaaggtgccccagccccgggagggccggccccgggcccaggcccagctggagggcggcctgctgggcctgggcggccacagcgccagtgacaccggcagcggcatgctgttcctgagcaacatcaccctggcccacgccggcaagtatgaatgtgaggccagcaatgctgggggcgccgcccgggtgcccttccggctgctggtgaatgccagccggcagcagccccagcagcctgcccagcccccacctcctgctgcccggcctgctggcagcgagcccaggcctgaggccggctccatggccttccgggccctgggcgtggccacccagacagccatcgctgctgccatcgccctgctggccctgacagccctgctgctggtggccatgatctgcagaagaagaagaagaaggaagaaggcccggggccccccaggagagggcgccctgtttgtgaatgactacctggatggcccctgcacctttgcccagctggaggagctgagagatgagcggggccacgagatgtttgtgatcaacagaagcaagcccctgtttgctgagggccctgctgaggccccagctgactgtggccctgagcagggcgccggccctggcctgcgggtgcccccacctgtggcctatgagatccactgctag

SEQ ID NO: 35033 - DNA, 774 bp, Artificial Sequence
  Description of Artificial Sequence: Synthetic coding sequence
atgggcaccgtgcggcccccccggcccagcctgctgctggtgtccacccgggagagctgcctcttcctgctcttctgcctgcacctgggcgccgcctgcccccagccctgccgctgcccagaccatgctggagctgtggccgtgttctgcagcctgcggggcctgcaggaggtgcctgaggacatcccagccaacacagtgctgctgaagctggatgccaacaagatcagccacctgcctgatggagccttccagcacctgcaccggctgcgggagctggacctgagccacaatgccatcgaggccatcggcagcgccacctttgctggcctggccggcggcctgcggctgctggacctgagctacaaccgcatccagaggatccccaaggatgccctgggcaagctgagcgccaagatccggctgagccacaaccccctgcactgtgaatgtgccctgcaggaggccctgtgggagctgaagctggaccctgacagcgtggatgagatcgcctgccacacctctgtgcaggaggagtttgtgggcaagcccctggtgcaggccctggatgctggggccagcctgtgcagcgtgccccacaggaccacagatgtggccatgctggtgaccatgtttggctggtttgccatggtgattgcctacgtggtgtactacgtgcgccacaaccaggaggatgcccggcggcacctggagtacctgaagagcctgcccagcgccccagccagcaaggaccccatcggccctggcccctag

SEQ ID NO: 35034 - DNA, 414 bp, Artificial Sequence
  Description of Artificial Sequence: Synthetic coding sequence
atgggcaccgtgcggcccccccggcccagcctgctgctggtgtccacccgggagagctgcctcttcctgctcttctgcctgcacctgggcgccgcctgcccccagccctgccgctgcccagaccatgctggagctgtggccgtgttctgcagcctgcggggcctgcaggaggtgcctgaggacatcccagccaacacagtgctgctgaagctggatgccaacaagatcagccacctgcctgatggagccttccagcacctgcaccggctgcgggagctggacctgagccacaatgccatcgaggccatcggcagcgccacctttgctggcctggccggcggcctgcggctgctggacctgagctacaaccgcatccagaggatccccaaggaccccatcggccctggcccctag

SEQ ID NO: 35035 - DNA, 1989 bp, Artificial Sequence
  Description of Artificial Sequence: Synthetic coding sequence
atgaggccccagatcctgctgctgctggccctgctgaccctgggcctggccgcccagcaccaggacaaggtgccctgcaagatggtggacaagaaggtgtcctgccaggtgctgggcctgctgcaggtgcccagcgtgctgcccccagacacagagaccctggacctgagcggcaaccagctgcggagcatcctggccagccccctgggcttctacacagccctgcggcacctggacctgagcaccaatgagatctccttcctgcagcccggggccttccaggccctgacccacctggagcacctgagcctggcccacaaccggctggccatggccacagccctgtctgctgggggcctgggccccctgccccgggtgaccagcctggacctgagcggcaacagcctgtacagcggcctgctggagcggctgctgggggaggcccccagcctgcacaccctgagcctggccgagaacagcctgacccggctgaccaggcacaccttccgggacatgcctgccctggagcagctggacctgcacagcaatgtgctgatggacattgaagatggagcctttgagggcctgccccggctgacccacctgaacctgagcaggaacagcctgacctgcatcagtgacttcagcctgcagcagctgcgggtgctggacctgagctgcaacagcattgaggccttccagacagccagccagccccaggccgagttccagctgacctggctggacctgcgggagaacaagctgctgcacttcccagacctggccgccctgcccaggctcatctacctgaacctgagcaacaacctgatccggctgcccactggaccaccccaggacagcaagggcatccacgcccccagcgagggctggagcgccctgcccctgagcgcccccagcggaaatgccagcggccggcccctgagccagctgctgaacctggacctgagctacaatgaaattgagctgatcccagacagcttcctggagcacctgaccagcctgtgcttcctgaacctgagcaggaactgcctgcggacctttgaggcccggcggctgggcagcctgccctgcctgatgctgctggacctgagccacaatgccctggagaccctggagctgggcgcccgggccctgggcagcctgcggaccctgctgctgcagggcaatgccctgcgggacctgcccccctacacctttgccaacctggccagcctgcagaggctgaacctgcagggcaacagagtgagcccctgtggcggcccagatgagcccggccccagcggctgtgtggccttcagcggcatcaccagcctgcggagcctgagcctggtggacaatgaaattgagctgctgcgggccggggccttcctgcacacccccctgacagagctggacctgagcagcaaccctggcctggaggtggccactggagccctgggcggcctggaggccagcctggaggtgctggccctgcagggcaatggcctgatggtgctgcaggtggacctgccctgcttcatctgcctgaagaggctgaacctggctgaaaatcggctgagccacctgcctgcctggacccaggccgtgtccctggaggtgctggacctgaggaacaacagcttcagcctgctgcccggcagcgccatgggcggcctggagaccagcctgcggcggctgtacctgcagggcaaccccctgagctgctgcggaaatggctggctggccgcccagctgcaccagggccgggtggatgtggatgccacccaggacctgatctgccgcttcagcagccaggaggaggtgtccctgagccacgtgcggcctgaggactgtgagaagggcggcctgaagaacatcaacctgatcatcatcctgaccttcatcctggtgtctgccatcctgctgaccaccctggccgcctgctgctgcgtgcggcggcagaagttcaaccagcagtacaaggcctag

SEQ ID NO: 35036 - DNA, 1989 bp, Artificial Sequence; identical to SEQ ID NO: 35035
  Description of Artificial Sequence: Synthetic coding sequence

SEQ ID NO: 35037 - DNA, 1989 bp, Artificial Sequence; identical to SEQ ID NO: 35035
  Description of Artificial Sequence: Synthetic coding sequence

SEQ ID NO: 35038 - DNA, 561 bp, Artificial Sequence
  Description of Artificial Sequence: Synthetic coding sequence
atgaggccccagatcctgctgctgctggccctgctgaccctgggcctggccgcccagcaccaggacaaggtgccctgcaagatggtggacaagaaggtgtcctgccaggtgctgggcctgctgcaggtgcccagcgtgctgcccccagacacagagaccctggacctgagcggcaaccagctgcggagcatcctggccagccccctgggcttctacacagccctgcggcacctggacctgagcaccaatgagatctccttcctgcagcccggggccttccaggccctgacccacctggagcacctgagcctggcccacaaccggctggccatggccacagccctgtctgctgggggcctgggccccctgccccgggtgaccagcctggacctgagcggcaacagcctgtacagcggcctgctggagcggctgctgggggaggcccccagcctgcacaccctgagcctggccgagaacagcctgacccggctgaccaggcacaccttccgggacatgcctgccctggagcagctggacctgcacagcaatgtgctgatgtag

SEQ ID NO: 35039 - DNA, 2079 bp, Artificial Sequence
  Description of Artificial Sequence: Synthetic coding sequence
atggagctgctgcccctgtggctgtgcctgggcttccacttcctgactgtgggctggaggaacagaagtggcacagccacagctgccagccagggcgtgtgcaagctggtgggcggcgctgctgactgccggggccagagcctggcctctgtgcccagcagcctgcccccccacgccaggatgctgaccctggatgccaaccccctgaagaccctgtggaaccacagcctgcagccctaccccctgctggagagcctgagcctgcacagctgccacctggagcgcatcagcagaggagccttccaggagcagggccacctgcggagcctggtgctgggggacaactgcctgtctgaaaattatgaggagacagctgctgccctgcacgccctgcccggcctgcggcggctggacctgtctggaaatgccctgacagaggacatggccgccctgatgctgcagaacctgagcagcctgcggtctgtgtccctggccggcaacaccatcatgaggctggatgattctgtgtttgagggcctggagcggctgcgggagctggacctgcagaggaactacatctttgaaattgagggcggggcctttgatggcctggccgagctgcggcacctgaacctggccttcaacaacctgccctgcatcgtggactttggcctgacccggctgcgggtgctgaatgtgtcctacaacgtgctggagtggttcctggccaccggcggggaggccgcctttgagctggagaccctggacctgagccacaaccagctgctcttcttccccctgctgccccagtacagcaagctgcggaccctgctgctgcgggacaacaacatgggcttctacagagacctgtacaacaccagcagcccccgggagatggtggcccagttcctgctggtggatggaaatgtgaccaacatcaccaccgtgtccctgtgggaggagttcagcagcagtgacctggccgacctgcgcttcctggacatgagccagaaccagttccagtacctgcctgatggcttcctgaggaagatgcccagcctgagccacctgaacctgcaccagaactgcctgatgaccctgcacatccgggagcacgagcccccaggggccctgacagagctggacctgagccacaaccagctgtctgagctgcacctggcccctggcctggccagctgcctgggcagcctgcggctcttcaacctgagcagcaaccagctgctgggcgtgcccccaggcctgtttgccaatgccaggaacatcaccaccctggacatgagccacaaccagatcagcctgtgccccctgcctgctgccagtgacagagtgggcccccccagctgtgtggacttcaggaacatggccagcctgcggagcctgagcctggagggctgcggcctgggcgccctgcctgactgccccttccagggcaccagcctgacctacctggacctgagcagcaactggggcgtgctgaatggcagcctggcccccctgcaggatgtggcccccatgctgcaggtgctgagcctgaggaacatgggcctgcacagcagcttcatggccctggacttcagcggctttggaaacctgcgggacctggacctgagcggcaactgcctgaccaccttccccaggtttggaggcagcctggccctggagaccctggacctgcggaggaacagcctgacagccctgccccagaaggctgtgtctgagcagctgagccggggcctgcggaccatctacctgagccagaacccctatgactgctgcggcgtggatggctggggcgccctgcagcacggccagacagtggccgactgggccatggtgacctgcaacctgagcagcaagatcatccgggtgacagagctgcccggcggcgtgccccgggactgcaagtgggagcggctggacctgggcctgctgtacctggtgctgatcctgcccagctgcctgaccctgctggtggcctgcaccgtcatcgtgctgaccttcaagaagcccctgctgcaggtgatcaagagccgctgccactggagctctgtgtactag

SEQ ID NO: 35040 - DNA, 4905 bp, Artificial Sequence
  Description of Artificial Sequence: Synthetic coding sequence
atgaccagcgcccagtgcccagccctggcctgtgtgatgagccccctgcgcttctggggcccctggcccctgctgatgtggcagctgctgtggctgctggtgaaggaggcccagcccctggagtgggtgaaggaccccctgcagctgaccagcaaccccctgggccccccagagccctggagcagccacagcagccacttcccccgggagagcccccacgcccccaccctgcctgctgacccctgggactttgaccacctgggccccagcgccagcagcgagatgcctgccccaccccaggagagcacagagaacctggtgcccttcctggacacctgggacagcgctggggagctgcccctggagcctgagcagttcctggccagccagcaggacctgaaggacaagctgagcccccaggagcggctgcctgtgagccccaagaagctgaagaaggaccctgcccagcgctggagcctggccgagatcatcggcatcatccaccagctgagcaccccccagagccagaagcagaccctgcagaatgagtacagcagcacagacaccccctacccaggcagcctgcccccagagctgcgggtgaagagtgatgagcccccaggccccagcgagcaggtgggccccagccagttccacctggagcctgagacccagaaccctgagaccctggaggacatccagagcagcagcctgcagcaggaggccccagcccagctgccccagctgctggaggaggagcccagctccatgcagcaggaggccccagccctgcccccagagagctccatggagagcctgaccctgcccaaccacgaggtgtctgtgcagcccccaggagaggaccaggcctactaccacctgcccaacatcaccgtgaagccagcagatgtggaggtgaccatcaccagcgagcccaccaatgaaacagagagcagccaggcccagcaggagacccccatccagtttcctgaggaggtggagcccagcgccacccagcaggaggcccccatcgagccccctgtgccccccatggagcacgagctgagcatcagcgagcagcagcagcctgtgcagcccagcgagagcagccgggaggtggagagcagccccacccagcaggagaccccaggccagcccccagagcaccacgaggtgacagtgagccccccaggccaccaccagacccaccacctggccagccccagcgtgtctgtgaagcccccagatgtgcagctgaccatcgctgctgagcccagcgctgaggtgggcaccagcctggtgcaccaggaggccaccacccggctgagcggcagcggaaatgatgtggagcccccagccatccagcacggcggcccccccctgctgcctgagagcagcgaggaggccggccccctggccgtgcagcaggagaccagcttccagagccctgagcccatcaacaatgaaaaccccagccccacccagcaggaggccgctgctgagcacccccagacagctgaggagggggagagcagcctgacccaccaggaggccccagcccagaccccagagttccccaacgtggtggtggcccagcccccagagcacagccacctgacccaggccaccgtgcagcccctggacctgggcttcaccatcaccccagagagcatgacagaggtggagctgagccccaccatgaaggagacccccacccagccccccaagaaggtggtgccccagctgcgggtgtaccagggcgtgaccaaccccaccccaggccaggaccaggcccagcaccctgtgagccccagcgtgacagtgcagctgctggacctgggcctgaccatcaccccagagcccaccacagaggtgggccacagcaccccacccaagaggaccatcgtgagccccaagcaccctgaggtgaccctgccccacccagaccaggtgcagacccagcacagccacctgacccgggccaccgtgcagcccctggacctgggcttcaccatcacccccaagtccatgacagaggtggagcccagcacagccctgatgaccacagcccctcctcctggccaccctgaggtgaccctgcccccaagtgacaagggccaggcccagcacagccacctgacccaggccaccgtgcagcccctggacctggagctgaccatcaccaccaagcccaccacagaggtgaagcccagccccaccacagaggagaccagcacccagctgcctgacctgggcctggccatcatccctgagcccaccacagaaacaggccacagcacagccctggagaagaccacagcccccaggccagacagagtgcagaccctgcacaggagcctgacagaggtgactggaccacccacagagctggagcccgcccaggacagcctggtgcagagcgagagctacacccagaacaaggccctgacagcccctgaggagcacaaggccagcaccagcaccaacatctgtgagctgtgcacctgtggagatgagatgctgagctgcatcgacctgaaccctgagcagaggctgcggcaggtgcctgtgcctgagcccaacacccacaacggcaccttcaccatcctgaacttccagggcaactacatctcctacattgatggaaatgtgtggaaggcctacagctggacagagaagctgatcctgcgggagaacaacctgacagagctgcacaaggacagctttgagggcctgctgagcctgcagtacctggacctgagctgcaacaagatccagagcattgaaagacacacctttgagcccctgcccttcctgaagttcatcaacctgagctgcaacgtcatcacagagctgagctttggcaccttccaggcctggcacggcatgcagttcctgcacaagctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgattgtgcccagccacatggcctgctgcctgtgccagttcaagaacagcattgaagctgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgatcatcgagcctgaggagcccagcgacagcagcggcatcaacctgagcggctttggaagtgagcagctggacaccaatgatgaaagtgatgtgaccagcaccctgagctacatcctgccctacttctctgctgtgaacctggatgtgaagagcctgctgctgcccttcatcaagctgcccaccactggaaacagcctggccaagatccagacagtgggcaagaaccggcagaggctgaacagagtgctgatgggccccaggagcatccagaagaggcacttcaaggaggtgggccggcagagcatccggcgggagcagggcgcccaggcctctgtggagaacacagctgaggagaagaggctgggcagccctgccccccgggagctgaagcagccccacacccagcagggccctgagaagctggccggaaatgctgtgtacaccaagcccagcttcacccaggagcacaaggctgctgtgtctgtgctgaagcccttcagcaaaggagcccccagcaccagcagccctgccaaggccctgccccaggtgcgggaccgctggaaggacctgacccacgccatcagcatcctggagagcgccaaggcccgggtgaccaacatgaagaccagcaagcccatcgtgcacagcaggaagaagtaccgcttccacaagaccaggagcaggatgacccacaggacccccaaggtgaagaagagccccaaggtgaggaagaagagctacctgagccggctgatgctgagcaaccggctgcccttctctgctgccaagagcctcatcaacagccccagccagggcgccttcagcagcctgcgggacctgagcccccaggagaaccccttcctggaggtgtctgcccccagcgagcacttcatcgagaacaacaacaccaaggacaccacagccagaaatgcctttgaagaaaatgtgttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcgtcatccccaacaacaacgtgagaagactcatcgcccacgtgatccgcaccctgaagatggactgcagcggggcccacgtgcaggtgacctgtgccaagctggtgtccaggacaggccacctgatgaagctgctgagcggccagcaggaggtgaaggccagcaagattgagtgggacacagaccagtggaagacagagaactacatcaatgaaagcacagaggcccagagcgagcagaaggagaagagcctggagttcaccaaggagctgcccggctacggctacaccaagaagctgatcctggccctgattgtgacaggcatcctgaccatcctgatcatcctgctgtgcctgattgagatctgctgccaccggcgcagcctgcaggaggatgaggagggcttcagccgggacagcgaggcccccacagaggaggagagcgaggccctgccctag

SEQ ID NO: 35041 - DNA, 4905 bp, Artificial Sequence; identical to SEQ ID NO: 35040
  Description of Artificial Sequence: Synthetic coding sequence

SEQ ID NO: 35042 - DNA, 1836 bp, Artificial Sequence
  Description of Artificial Sequence: Synthetic coding sequence
atggcctgctgcctgtgccagttcaagaacagcattgaggccgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgatcatcgagcctgaggagcccagcgacagcagcggcatcaacctgagcggcttcggcagcgagcagctggacaccaatgatgaaagtgatgtgaccagcaccctgagctacatcctgccctacttctctgctgtgaacctggatgtgaagagcctgctgctgcccttcatcaagctgcccaccaccggcaacagcctggccaagatccagacagtgggcaagaaccggcagaggctgaacagagtgctgatgggccccaggagcatccagaagaggcacttcaaggaggtgggccggcagagcatcagaagagagcagggcgcccaggcctctgtggagaacacagctgaggagaagaggctgggcagccctgccccccgggagctgaagcagccccacacccagcagggccctgagaagctggccggaaatgctgtgtacaccaagcccagcttcacccaggagcacaaggctgctgtgtctgtgctgaagcccttcagcaagggggcccccagcaccagcagccctgccaaggccctgccccaggtgcgggaccgctggaaggacctgacccacgccatcagcatcctggagagcgccaaggcccgggtgaccaacatgaagaccagcaagcccatcgtgcacagcaggaagaagtaccgcttccacaagaccaggagcaggatgacccacaggacccccaaggtgaagaagagccccaaggtgaggaagaagagctacctgagccggctgatgctgagcaaccggctgcccttctctgctgccaagagcctcatcaacagccccagccagggcgccttcagcagcctgcgggacctgagcccccaggagaaccccttcctggaggtgtctgcccccagcgagcacttcatcgagaacaacaacaccaaggacaccacagccagaaatgcctttgaggagaatgtgttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcgtcatccccaacaacaacgtgcggcggctgattgcccacgtgatccgcaccctgaagatggactgcagcggggcccacgtgcaggtgacctgtgccaagctggtgtccaggacaggccacctgatgaagctgctgagcggccagcaggaggtgaaggccagcaagattgagtgggacacagaccagtggaagacagagaactacatcaatgaaagcacagaggcccagagcgagcagaaggagaagagcctggagttcaccaaggagctgcccggctacggctacaccaagaagctgatcctggccctgattgtgacaggcatcctgaccatcctgatcatcctgctgtgcctgattgagatctgctgccacagaagaagcctgcaggaggatgaggagggcttcagccgggacagcgaggcccccacagaggaggagagcgaggccctgccctag

SEQ ID NO: 35043 - DNA, 2148 bp, Artificial Sequence
  Description of Artificial Sequence: Synthetic coding sequence
cacaggaacttccagggcaactacatctcctacattgatggaaatgtgtggaaggcctacagctggacagagaagctgatcctgcgggagaacaacctgacagagctgcacaaggacagctttgagggcctgctgagcctgcagtacctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgattgtgcccagccacatggcctgctgcctgtgccagttcaagaacagcattgaggccgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgatcatcgagcctgaggagcccagcgacagcagcggcatcaacctgagcggcttcggcagcgagcagctggacaccaatgatgaaagtgatgtgaccagcaccctgagctacatcctgccctacttctctgctgtgaacctggatgtgaagagcctgctgctgcccttcatcaagctgcccaccaccggcaacagcctggccaagatccagacagtgggcaagaaccggcagaggctgaacagagtgctgatgggccccaggagcatccagaagaggcacttcaaggaggtgggccggcagagcatcagaagagagcagggcgcccaggcctctgtggagaacacagctgaggagaagaggctgggcagccctgccccccgggagctgaagcagccccacacccagcagggccctgagaagctggccggaaatgctgtgtacaccaagcccagcttcacccaggagcacaaggctgctgtgtctgtgctgaagcccttcagcaagggggcccccagcaccagcagccctgccaaggccctgccccaggtgcgggaccgctggaaggacctgacccacgccatcagcatcctggagagcgccaaggcccgggtgaccaacatgaagaccagcaagcccatcgtgcacagcaggaagaagtaccgcttccacaagaccaggagcaggatgacccacaggacccccaaggtgaagaagagccccaaggtgaggaagaagagctacctgagccggctgatgctgagcaaccggctgcccttctctgctgccaagagcctcatcaacagccccagccagggcgccttcagcagcctgcgggacctgagcccccaggagaaccccttcctggaggtgtctgcccccagcgagcacttcatcgagaacaacaacaccaaggacaccacagccagaaatgcctttgaggagaatgtgttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcgtcatccccaacaacaacgtgcggcggctgattgcccacgtgatccgcaccctgaagatggactgcagcggggcccacgtgcaggtgacctgtgccaagctggtgtccaggacaggccacctgatgaagctgctgagcggccagcaggaggtgaaggccagcaagattgagtgggacacagaccagtggaagacagagaactacatcaatgaaagcacagaggcccagagcgagcagaaggagaagagcctggagttcaccaaggagctgcccggctacggctacaccaagaagctgatcctggccctgattgtgacaggcatcctgaccatcctgatcatcctgctgtgcctgattgagatctgctgccacagaagaagcctgcaggaggatgaggagggcttcagccgggacagcgaggcccccacagaggaggagagcgaggccctgccctag

SEQ ID NO: 35044 - DNA, 2019 bp, Artificial Sequence
  Description of Artificial Sequence: Synthetic coding sequence
atgcagttcctgcacaagctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgattgtgcccagccacatggcctgctgcctgtgccagttcaagaacagcattgaagctgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgatcatcgagcctgaggagcccagcgacagcagcggcatcaacctgagcggctttggaagtgagcagctggacaccaatgatgaaagtgatgtgaccagcaccctgagctacatcctgccctacttctctgctgtgaacctggatgtgaagagcctgctgctgcccttcatcaagctgcccaccactggaaacagcctggccaagatccagacagtgggcaagaaccggcagaggctgaacagagtgctgatgggccccaggagcatccagaagaggcacttcaaggaggtgggccggcagagcatccggcgggagcagggcgcccaggcctctgtggagaacacagctgaggagaagaggctgggcagccctgccccccgggagctgaagcagccccacacccagcagggccctgagaagctggccggaaatgctgtgtacaccaagcccagcttcacccaggagcacaaggctgctgtgtctgtgctgaagcccttcagcaaaggagcccccagcaccagcagccctgccaaggccctgccccaggtgcgggaccgctggaaggacctgacccacgccatcagcatcctggagagcgccaaggcccgggtgaccaacatgaagaccagcaagcccatcgtgcacagcaggaagaagtaccgcttccacaagaccaggagcaggatgacccacaggacccccaaggtgaagaagagccccaaggtgaggaagaagagctacctgagccggctgatgctgagcaaccggctgcccttctctgctgccaagagcctcatcaacagccccagccagggcgccttcagcagcctgcgggacctgagcccccaggagaaccccttcctggaggtgtctgcccccagcgagcacttcatcgagaacaacaacaccaaggacaccacagccagaaatgcctttgaagaaaatgtgttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcgtcatccccaacaacaacgtgagaagactcatcgcccacgtgatccgcaccctgaagatggactgcagcggggcccacgtgcaggtgacctgtgccaagctggtgtccaggacaggccacctgatgaagctgctgagcggccagcaggaggtgaaggccagcaagattgagtgggacacagaccagtggaagacagagaactacatcaatgaaagcacagaggcccagagcgagcagaaggagaagagcctggagttcaccaaggagctgcccggctacggctacaccaagaagctgatcctggccctgattgtgacaggcatcctgaccatcctgatcatcctgctgtgcctgattgagatctgctgccaccggcgcagcctgcaggaggatgaggagggcttcagccgggacagcgaggcccccacagaggaggagagcgaggccctgccctag

SEQ ID NO: 35045 - DNA, 5103 bp, Artificial Sequence
  Description of Artificial Sequence: Synthetic coding sequence
atgagcagcgcccagtgcccagccctggtgtgtgtgatgagccggctgcgcttctggggcccctggcccctgctgatgtggcagctgctgtggctgctggtgaaggaggcccagcccctggagtgggtgaaggaccccctgcagctgaccagcaaccccctgggccccccagagagctggagcagccacagcagccacttcccccgggagagcccccacgcccccaccctgcctgctgacccctgggactttgaccacctgggccccagcgccagcagcgagatgcctgccccaccccaggagagcacagagaacctggtgcccttcctggacacctgggacagcgctggggagcagcccctggagcctgagcagttcctggccagccagcaggacctgaaggacaagctgagcccccaggagcggctgcctgtgagccccaagaagctgaagaaggaccctgcccagcgctggagcctggccgagatcatcggcatcacccggcagctgagcaccccccagagccagaagcagaccctgcagaatgagtacagcagcacagacaccccctacccaggcagcctgcccccagagctgcgggtgaagagtgatgagcccccaggccccagcgagcaggtgggccccagccagttccacctggagcctgagacccagaaccctgagaccctggaggacatccagagcagcagcctgcagcaggaggccccagcccagctgccccagctgctggaggaggagcccagctccatgcagcaggaggccccagccctgcccccagagagctccatggagagcctgaccctgcccaaccacgaggtgtctgtgcagcccccaggagaggaccaggcctactaccacctgcccaacatcaccgtgaagccagcagatgtggaggtgaccatcaccagcgagcccaccaatgaaacagagagcagccaggcccagcaggagacccccatccagtttcctgaggaggtggagcccagcgccacccagcaggaggcccccatcgagccccctgtgccccccatggagcacgagctgagcatcagcgagcagcagcagcctgtgcagcccagcgagagcccccgggaggtggagagcagccccacccagcaggagaccccaggccagcccccagagcaccacgaggtgacagtgagccccccaggccaccaccagacccaccacctggccagccccagcgtgtctgtgaagcccccagatgtgcagctgaccatcgctgctgagcccagcgctgaggtgggcaccagcctggtgcaccaggaggccaccacccggctgagcggcagcggaaatgatgtggagcccccagccatccagcacggcggcccccccctgctgcctgagagcagcgaggaggccggccccctggccgtgcagcaggagaccagcttccagagccctgagcccatcaacaatgaaaaccccagccccacccagcaggaggccgctgctgagcacccccagacagctgaggagggggagagcagcctgacccaccaggaggccccagcccagaccccagagttccccaacgtggtggtggcccagcccccagagcacagccacctgacccaggccaccgtgcagcccctggacctgggcttcaccatcaccccagagagcaagacagaggtggagctgagccccaccatgaaggagacccccacccagccccccaagaaggtggtgccccagctgcgggtgtaccagggcgtgaccaaccccaccccaggccaggaccaggcccagcaccctgtgagccccagcgtgacagtgcagctgctggacctgggcctgaccatcaccccagagcccaccacagaggtgggccacagcaccccacccaagaggaccatcgtgagccccaagcaccctgaggtgaccctgccccacccagaccaggtgcagacccagcacagccacctgacccgggccaccgtgcagcccctggacctgggcttcaccatcacccccaagtccatgacagaggtggagcccagcacagccctgatgaccacagcccctcctcctggccaccctgaggtgaccctgcccccaagtgacaagggccaggcccagcacagccacctgacccaggccaccgtgcagcccctggacctggagctgaccatcaccaccaagcccaccacagaggtgaagcccagccccaccacagaggagaccagcacccagcccccagacctgggcctggccatcatccctgagcccaccacagaaacaggccacagcacagccctggagaagaccacagcccccaggccagacagagtgcagaccctgcacaggagcctgacagaggtgactggaccacccacagagctggagcccgcccaggacagcctggtgcagagcgagagctacacccagaacaaggccctgacagcccctgaggagcacaaggccagcaccagcaccaacatctgtgagctgtgcacctgtggagatgagatgctgagctgcatcgacctgaaccctgagcagaggctgcggcaggtgcctgtgcctgagcccaacacccacaacggcaccttcaccatcctgaacttccagggcaactacatctcctacattgatggaaatgtgtggaaggcctacagctggacagagaagctgatcctgcgggagaacaacctgacagagctgcacaaggacagctttgagggcctgctgagcctgcagtacctggacctgagctgcaacaagatccagagcattgaaagacacacctttgagcccctgcccttcctgaagttcatcaacctgagctgcaacgtcatcacagagctgagctttggcaccttccaggcctggcacggcatgcagttcctgcacaagctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgatcctgcccagccacatggcctgctgcctgtgccagttcaagaacagcattgaagctgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgattgtggagcctgaggagcccagcgacagcagcggcatcaacctgagcggctttggaagtgagcagctggacaccaatgatgaaagtgacttcatcagcaccctgagctacatcctgccctacttctctgctgtgaacctggatgtgaagagcctgctgctgcccttcatcaagctgcccaccactggaaacagcctggccaagatccagacagtgggccagaaccggcagagggtgaagagggtgctgatgggccccaggagcatccagaagaggcacttcaaggaggtgggccggcagagcatccggcgggagcagggcgcccaggcctctgtggagaatgctgctgaggagaagaggctgaccagccctgccccccgggaggtggagcagccccacacccagcagggccctgagaagctggccggaaatgctgtgtacaccaagcccagcttcacccaggagcacaaggctgctgtgtctgtgctgaagcccttcagcaagggcacccccagcaccagcagccctgccaaggccctgccccaggtgcgggacaggagcaaggacctgacccacgccatcagcatcctggagagcgccaaggcccgggtgaccaacaccaagaccagcaagcccatcgtgcacgccaggaagaagtaccgcttccacaagaccaggagccacgtgacccacaggaccaccaaggtgaagaagagccccaaggtgaggaagaagagctacctgagccggctgatgctggccaaccggctgcccttctctgctgccaagagcctcatcaacagccccagccagggcgccttcagcagcctgggggacctgagcccccaggagaaccccttcctggaggtgtctgccctgtctgagcacttcatcgagaagaacaacaccaagcacaccacagccagaaatgcctttgaagaaaatgacttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcctcatccccaacaacaacgtgagaagactcatcgcccacgtgatccgcaccctgaagatggactgcagcggggcccacgtgcaggtgacctgtgccaagctgatcagcaggacaggccacctgatgaagctgctgagcggccagcaggaggtgaaggccagcaagattgagtgggacacagaccagtggaagattgagaactacatcaatgaaagcacagaggcccagagcgagcagaaggagaagagcctggagctgaagaaggaggtgcccggctacggctacacagacaagctgatcctggccctgattgtgacaggcatcctgaccatcctgatcatcctcttctgcctgattgtcatctgctgccaccggcgcagcctgcaggaggatgaggagggcttcagccggggcatcttccgcttcctgccctggaggggctgcagcagccggcgggagagccaggacggcctgagcagctttggccagcccctgtggttcaaggacctgtacaagcccctgagcgccacccgcatcaacaaccacgcctggaagctgcacaagaagagcagcaatgaagacaagatcctgaacagagaccccggggacagcgaggcccccacagaggaggaggagagcgaggccctgccctag

SEQ ID NO: 35046 - DNA, 5103 bp, Artificial Sequence; identical to SEQ ID NO: 35045
  Description of Artificial Sequence: Synthetic coding sequence

SEQ ID NO: 35047 - DNA, 2925 bp, Artificial Sequence
  Description of Artificial Sequence: Synthetic coding sequence
atggcccacgcctacaagggccacgagcacctgcgggccgccaggatggcctttgctgagtgcatcgccccagcctgtgtgatgtcctggctgcgcttctggggcccctggcccctgctgacctggcagctgctgagcctgctggtgaaggaggcccagcccctggtgtgggtgaaggaccccctgcagctgaccagcaaccccctgggccccccagagccctggagcagccgcagcagccacctgccctgggagagcccccacgccccagcccccccagctgcccctggggactttgactacctgggccccagcgccagcagccagatgtctgccctgccccaggagcccacagagaacctggcccccttcctgaaggagctggacagcgctggggagctgcccctgggccctgagcccttcctggccgcccaccaggacctgaatgacaagaggaccccagaggagcggctgcctgaggtggtgcccctgctgaacagagaccagaaccaggccctggtgcagctgccccggctgaagtgggtgcagaccacagacctggacagagctgctggccaccaggctgatgagatcctggtgcccctggacagcaaggtgtcccggcccaccaagtttgtggtgagccccaagaacctgaagaaggacctggccgagcgctggagcctgcctgagatcgtgggcatcccccaccagctgagcaagccccagaggcagaagcagaccctgcctgatgactacctgtccatggacaccctgtacccaggcagcctgcccccagagctgcgggtgaatgctgatgagcccccaggccccccagagcaggtgggcctgagccagttccacctggagcccaagagccagaaccctgagaccctggaggacatccagagcagcagcctgcaggaggaggccccagcccagctgctgcagctgccccaggaggtggagcccagcacccagcaggaggccccagccctgcccccagagagctccatggagagcctggcccagacccccctgaaccacgaggtgacagtgcagcccccaggagaggaccaggcccactacaacctgcccaagttcaccgtgaagccagcagatgtggaggtgaccatgaccagcgagcccaagaatgaaacagagagcacccaggcccagcaggaggcccccatccagcccccagaggaggccgagcccagcagcacagccctgcggaccacagaccccccacctgagcaccctgaggtgaccctgccccccagcgacaagggccaggcccagcacagccacctgacagaggccaccgtgcagcccctggacctggagctgagcatcaccacagagcccaccacagaggtgaagcccagccccaccacagaggagaccagcgcccagcccccagaccccggcctggccatcaccccagagcccaccacagagatcggccacagcacagccctggagaagacccgggccccccacccagaccaggtgcagaccctgcacaggagcctgacagaggtgacaggcccccccaccaagctggagagcagccaggacagcctggtgcagagcgagacagcccctgaggagcagaaggccagcaccagcaccaacatctgtgagctgtgcacctgtggagatgagaccctgagctgtgtgggcctgagccccaagcagaggctgcggcaggtgcctgtgcctgagccagacacctacaacggcatcttcaccaccctgaacttccagggcaactacatctcctacctggatggaaatgtgtggaaggcctacagctggacagagaagctgatcctgtctgagaactacctgacagagctgcccaaggacagctttgagggcctgctgtacctgcagtacctggacctgagctgcaacaagatccgctacatcgagcggcagacctttgagagcctgcccttcctgcagtacatcaacctgggctgcaacctgatcaccaagctgagcctgggcaccttccaggcctggcacggcatgcagttcctgcacaacctgatcctgaacagaaaccccctgaccaccgtggaggacccctacctgtttgagctgcctgccctgaagtacctggacatgggcaccacccacatcaccctgaccaccctgaagaacatcctgaccatgacagtggagctggagaagctgatcctgcccagccacatggcctgctgcctgtgccagttcaagaacagcattgaggccgtgtgcaagacagtgaagctgcactgcaacacagcctgcctgaccaacagcatccactgcccagaggaggcctctgtgggcaaccctgagggcgccttcatgaagatgctgcaggccaggaagcagcacatgagcacccagctgaccatcgagagcgaggcccccagcgacagcagcggcatcaacctgagcggctttggaggagaccagctggagatccagctgacagagcagctgcggagcctcatccccaatgaagatgtgaggaagttcatgagccacgtgatccgcaccctgaagatggagtgcagcgagacccacgtgcagggcagctgtgccaagctgatgctgaggacaggcctgctgatgaagctgctgtctgagcagcaggaggccaaggccctgaatgtggagtgggacacagaccagcagaagaccaactacatcaatgaaaacatggagcagaatgagcagaaggagcagaagagcagcgagctgatgaaggaggtgcctggagatgactacaagaacaagctgatctttgccatctctgtgaccgtcatcctgatcatcctgatcatcatcttctgcctgattgaggtgaacagccacaagagggccagcgagaagtacaaggacaaccccagcatcagcggggcctag

SEQ ID NO: 35048 - DNA, 2844 bp, Artificial Sequence
  Description of Artificial Sequence: Synthetic coding sequence
atgtcctggctgcgcttctggggcccctggcccctgctgacctggcagctgctgagcctgctggtgaaggaggcccagcccctggtgtgggtgaaggaccccctgcagctgaccagcaaccccctgggccccccagagccctggagcagccgcagcagccacctgccctgggagagcccccacgccccagcccctcctgctgcccctggggactttgactacctgggccccagcgccagcagccagatgtctgccctgccccaggagcccacagagaacctggcccccttcctgaaggagctggacagcgctggggagctgcccctgggccctgagcccttcctggccgcccaccaggacctgaatgacaagaggaccccagaggagcggctgcctgaggtggtgcccctgctgaacagagaccagaaccaggccctggtgcagctgccccggctgaagtgggtgcagaccacagacctggacagagctgctggccaccaggctgatgagatcctggtgcccctggacagcaaggtgtcccggcccaccaagtttgtggtgagccccaagaacctgaagaaggacctggccgagcgctggagcctgcctgagatcgtgggcatcccccaccagctgagcaagccccagaggcagaagcagaccctgcctgatgactacctgtccatggacaccctgtacccaggcagcctgcccccagagctgcgggtgaatgctgatgagcccccaggccccccagagcaggtgggcctgagccagttccacctggagcccaagagccagaaccctgagaccctggaggacatccagagcagcagcctgcaggaggaggccccagcccagctgctgcagctgccccaggaggtggagcccagcacccagcaggaggccccagccctgcccccagagagctccatggagagcctggcccagacccccctgaaccacgaggtgacagtgcagcccccaggagaggaccaggcccactacaacctgcccaagttcaccgtgaagccagcagatgtggaggtgaccatgaccagcgagcccaagaatgaaacagagagcacccaggcccagcaggaggcccccatccagcccccagaggaggccgagcccagcagcacagccctgcggaccacagatcctcctcctgagcaccctgaggtgaccctgcccccaagtgacaagggccaggcccagcacagccacctgacagaggccaccgtgcagcccctggacctggagctgagcatcaccacagagcccaccacagaggtgaagcccagccccaccacagaggagaccagcgcccagcccccagaccccggcctggccatcaccccagagcccaccacagaaattggccacagcacagccctggagaagacccgggccccccacccagaccaggtgcagaccctgcacaggagcctgacagaggtgactggaccacccaccaagctggagagcagccaggacagcctggtgcagagcgagacagcccctgaggagcagaaggccagcaccagcaccaacatctgtgagctgtgcacctgtggagatgagaccctgagctgtgtgggcctgagccccaagcagaggctgcggcaggtgcctgtgcctgagccagacacctacaacggcatcttcaccaccctgaacttccagggcaactacatctcctacctggatggaaatgtgtggaaggcctacagctggacagagaagctgatcctgtctgagaactacctgacagagctgcccaaggacagctttgagggcctgctgtacctgcagtacctggacctgagctgcaacaagatccgctacatcgagcggcagacctttgagagcctgcccttcctgcagtacatcaacctgggctgcaacctgatcaccaagctgagcctgggcaccttccaggcctggcacggcatgcagttcctgcacaacctgatcctgaacagaaaccccctgaccaccgtggaggacccctacctgtttgagctgcctgccctgaagtacctggacatgggcaccacccacatcaccctgaccaccctgaagaacatcctgaccatgacagtggagctggagaagctgatcctgcccagccacatggcctgctgcctgtgccagttcaagaacagcattgaagctgtgtgcaagacagtgaagctgcactgcaacacagcctgcctgaccaacagcatccactgcccagaggaggcctctgtgggcaaccctgagggcgccttcatgaagatgctgcaggccaggaagcagcacatgagcacccagctgaccattgaaagtgaggcccccagcgacagcagcggcatcaacctgagcggctttggaggagaccagctggagatccagctgacagagcagctgcggagcctcatccccaatgaagatgtgaggaagttcatgagccacgtgatccgcaccctgaagatggagtgcagcgagacccacgtgcagggcagctgtgccaagctgatgctgaggacaggcctgctgatgaagctgctgtctgagcagcaggaggccaaggccctgaatgtggagtgggacacagaccagcagaagaccaactacatcaatgaaaacatggagcagaatgagcagaaggagcagaagagcagcgagctgatgaaggaggtgcctggagatgactacaagaacaagctgatctttgccatctctgtgaccgtcatcctgatcatcctgatcatcatcttctgcctgattgaggtgaacagccacaagagggccagcgagaagtacaaggacaaccccagcatcagcggggcctag

SEQ ID NO: 35049 - DNA, 2691 bp, Artificial Sequence
  Description of Artificial Sequence: Synthetic coding sequence
atgtcctggctgcgcttctggggcccctggcccctgctgacctggcagctgctgagcctgctggtgaaggaggcccagcccctggtgtgggtgaaggaccccctgcagctgaccagcaaccccctgggccccccagagccctggagcagccgcagcagccacctgccctgggagagcccccacgccccagcccctcctgctgcccctggggactttgactacctgggccccagcgccagcagccagatgtctgccctgccccaggagcccacagagaacctggcccccttcctgaaggagctggacagcgctggggagctgcccctgggccctgagcccttcctggccgcccaccaggacctgaatgacaagaggaccccagaggagcggctgcctgaggtggtgcccctgctgaacagagaccagaaccaggccctggtgcagctgccccggctgaagtgggtgcagaccacagacctggacagagctgctggccaccaggctgatgagatcctggtgcccctggacagcaaggtgtcccggcccaccaagtttgtggtgagccccaagaacctgaagaaggacctggccgagcgctggagcctgcctgagatcgtgggcatcccccaccagctgagcaagccccagaggcagaagcagaccctgcctgatgactacctgtccatggacaccctgtacccaggcagcctgcccccagagctgcgggtgaatgctgatgagcccccaggccccccagagcaggtgggcctgagccagttccacctggagcccaagagccagaaccctgagaccctggaggacatccagagcagcagcctgcaggaggaggccccagcccagctgctgcagctgccccaggaggtggagcccagcacccagcaggaggccccagccctgcccccagagagctccatggagagcctggcccagacccccctgaaccacgaggtgacagtgcagcccccaggagaggaccaggcccactacaacctgcccaagttcaccgtgaagccagcagatgtggaggtgaccatgaccagcgagcccaagaatgaaacagagagcacccaggcccagcaggaggcccccatccagcccccagaggaggccgagcccagcagcacagccctgcggaccacagatcctcctcctgagcaccctgaggtgaccctgcccccaagtgacaagggccaggcccagcacagccacctgacagaggccaccgtgcagcccctggacctggagctgagcatcaccacagagcccaccacagaggtgaagcccagccccaccacagaggagaccagcgcccagcccccagaccccggcctggccatcaccccagagcccaccacagaaattggccacagcacagccctggagaagacccgggccccccacccagaccaggtgcagaccctgcacaggagcctgacagaggtgactggaccacccaccaagctggagagcagccaggacagcctggtgcagagcgagacagcccctgaggagcagaaggccagcaccagcaccaacatctgtgagctgtgcacctgtggagatgagaccctgagctgtgtgggcctgagccccaagcagaggctgcggcaggtgcctgtgcctgagccagacacctacaacggcatcttcaccaccctgaacttccagggcaactacatctcctacctggatggaaatgtgtggaaggcctacagctggacagagaagctgatcctgtctgagaactacctgacagagctgcccaaggacagctttgagggcctgctgtacctgcagtacctgatcctgaacagaaaccccctgaccaccgtggaggacccctacctgtttgagctgcctgccctgaagtacctggacatgggcaccacccacatcaccctgaccaccctgaagaacatcctgaccatgacagtggagctggagaagctgatcctgcccagccacatggcctgctgcctgtgccagttcaagaacagcattgaggccgtgtgcaagacagtgaagctgcactgcaacacagcctgcctgaccaacagcatccactgcccagaggaggcctctgtgggcaaccctgagggcgccttcatgaagatgctgcaggccaggaagcagcacatgagcacccagctgaccatcgagagcgaggcccccagcgacagcagcggcatcaacctgagcggctttggaggagaccagctggagatccagctgacagagcagctgcggagcctcatccccaatgaagatgtgaggaagttcatgagccacgtgatccgcaccctgaagatggagtgcagcgagacccacgtgcagggcagctgtgccaagctgatgctgaggacaggcctgctgatgaagctgctgtctgagcagcaggaggccaaggccctgaatgtggagtgggacacagaccagcagaagaccaactacatcaatgaaaacatggagcagaatgagcagaaggagcagaagagcagcgagctgatgaaggaggtgcctggagatgactacaagaacaagctgatctttgccatctctgtgaccgtcatcctgatcatcctgatcatcatcttctgcctgattgaggtgaacagccacaagagggccagcgagaagtacaaggacaaccccagcatcagcggggcctag

SEQ ID NO: 35050 - DNA, 2598 bp, Artificial Sequence
  Description of Artificial Sequence: Synthetic coding sequence
atgtctgccctgccccaggagcccacagagaacctggcccccttcctgaaggagctggacagcgctggggagctgcccctgggccctgagcccttcctggccgcccaccaggacctgaatgacaagaggaccccagaggagcggctgcctgaggtggtgcccctgctgaacagagaccagaaccaggccctggtgcagctgccccggctgaagtgggtgcagaccacagacctggacagagctgctggccaccaggctgatgagatcctggtgcccctggacagcaaggtgtcccggcccaccaagtttgtggtgagccccaagaacctgaagaaggacctggccgagcgctggagcctgcctgagatcgtgggcatcccccaccagctgagcaagccccagaggcagaagcagaccctgcctgatgactacctgtccatggacaccctgtacccaggcagcctgcccccagagctgcgggtgaatgctgatgagcccccaggccccccagagcaggtgggcctgagccagttccacctggagcccaagagccagaaccctgagaccctggaggacatccagagcagcagcctgcaggaggaggccccagcccagctgctgcagctgccccaggaggtggagcccagcacccagcaggaggccccagccctgcccccagagagctccatggagagcctggcccagacccccctgaaccacgaggtgacagtgcagcccccaggagaggaccaggcccactacaacctgcccaagttcaccgtgaagccagcagatgtggaggtgaccatgaccagcgagcccaagaatgaaacagagagcacccaggcccagcaggaggcccccatccagcccccagaggaggccgagcccagcagcacagccctgcggaccacagatcctcctcctgagcaccctgaggtgaccctgcccccaagtgacaagggccaggcccagcacagccacctgacagaggccaccgtgcagcccctggacctggagctgagcatcaccacagagcccaccacagaggtgaagcccagccccaccacagaggagaccagcgcccagcccccagaccccggcctggccatcaccccagagcccaccacagaaattggccacagcacagccctggagaagacccgggccccccacccagaccaggtgcagaccctgcacaggagcctgacagaggtgactggaccacccaccaagctggagagcagccaggacagcctggtgcagagcgagacagcccctgaggagcagaaggccagcaccagcaccaacatctgtgagctgtgcacctgtggagatgagaccctgagctgtgtgggcctgagccccaagcagaggctgcggcaggtgcctgtgcctgagccagacacctacaacggcatcttcaccaccctgaacttccagggcaactacatctcctacctggatggaaatgtgtggaaggcctacagctggacagagaagctgatcctgtctgagaactacctgacagagctgcccaaggacagctttgagggcctgctgtacctgcagtacctggacctgagctgcaacaagatccgctacatcgagcggcagacctttgagagcctgcccttcctgcagtacatcaacctgggctgcaacctgatcaccaagctgagcctgggcaccttccaggcctggcacggcatgcagttcctgcacaacctgatcctgaacagaaaccccctgaccaccgtggaggacccctacctgtttgagctgcctgccctgaagtacctggacatgggcaccacccacatcaccctgaccaccctgaagaacatcctgaccatgacagtggagctggagaagctgatcctgcccagccacatggcctgctgcctgtgccagttcaagaacagcattgaagctgtgtgcaagacagtgaagctgcactgcaacacagcctgcctgaccaacagcatccactgcccagaggaggcctctgtgggcaaccctgagggcgccttcatgaagatgctgcaggccaggaagcagcacatgagcacccagctgaccattgaaagtgaggcccccagcgacagcagcggcatcaacctgagcggctttggaggagaccagctggagatccagctgacagagcagctgcggagcctcatccccaatgaagatgtgaggaagttcatgagccacgtgatccgcaccctgaagatggagtgcagcgagacccacgtgcagggcagctgtgccaagctgatgctgaggacaggcctgctgatgaagctgctgtctgagcagcaggaggccaaggccctgaatgtggagtgggacacagaccagcagaagaccaactacatcaatgaaaacatggagcagaatgagcagaaggagcagaagagcagcgagctgatgaaggaggtgcctggagatgactacaagaacaagctgatctttgccatctctgtgaccgtcatcctgatcatcctgatcatcatcttctgcctgattgaggtgaacagccacaagagggccagcgagaagtacaaggacaaccccagcatcagcggggcctag

SEQ ID NO: 35051 - DNA, 885 bp, Artificial Sequence
  Description of Artificial Sequence: Synthetic coding sequence
atgaggccccgggccccagcctgtgccgctgctgccctgggcctgtgcagcctgctgctgctgctggcccctggccacgcctgcccagctggctgtgcctgcacagacccccacacagtggactgccgggaccggggcctgcccagcgtgcctgaccccttccccctggatgtgaggaagctgctggtggccggcaaccgcatccagagaattcctgaggacttcttcatcttctatggagacctggtgtacctggacttcaggaacaacagcctgcggagcctggaggagggcaccttcagcggcagcgccaagctggtgttcctggacctgagctacaacaacctgacccagctgggcgctggggccttccgctctgctggccgcctggtgaagctgagcctggccaacaacaacctggtgggcgtgcatgaagatgcctttgagaccctggagagcctgcaggtgctggagctgaatgacaacaacctgcggagcctgtctgtggccgccctggccgccctgcctgccctgcggagcctgcggctggatggcaacccctggctgtgtgactgtgactttgcccacctgttctcctggatccaggagaatgccagcaagctgcccaagggcctggatgagatccagtgcagcctgcccatggagagccgccgcatcagcctgcgggagctgtctgaggccagcttcagcgagtgccgcttcagcctgagcctgacagacctgtgcatcatcatcttcagcggcgtggccgtgtccattgctgccatcatcagcagcttcttcctggccaccgtggtgcagtgcctgcagagatgtgcccccaacaaggatgctgaagatgaagatgaggacaaggatgactag

SEQ ID NO: 35052 - DNA, 780 bp, Artificial Sequence
  Description of Artificial Sequence: Synthetic coding sequence
atgaacctggtggacctgtggctgaccaggagcctgtccatgtgcctgctgctgcagagctttgtgctgatgatcctgtgcttccacagcgcctccatgtgccccaagggctgcctgtgcagcagcagcggcggcctgaatgtgacctgcagcaatgccaacctgaaggagatcccccgggacctgcccccagagaccgtgctgctgtacctggacagcaaccagatcaccagcatccccaatgagatcttcaaggacctgcaccagctgcgggtgctgaacctgagcaagaatggcatcgagttcattgatgagcacgccttcaagggcgtggccgagaccctgcagaccctggacctgagtgacaaccgcatccagagcgtgcacaagaatgccttcaacaacctgaaggcccgggcccgcatcgccaacaacccctggcactgtgactgcaccctgcagcaggtgctgcgctccatggccagcaaccacgagacagcccacaacgtcatctgcaagacctctgtgctggatgagcacgccggccggcccttcctgaatgctgccaatgatgctgacctgtgcaacctgcccaagaagaccacagattatgccatgctggtgaccatgtttggctggttcaccatggtgatctcctatgtggtgtactacgtgcggcagaaccaggaggatgcccggcggcacctggagtacctgaagagcctgcccagccggcagaagaaggcagatgagccagatgacatcagcacagtggtgtag

SEQ ID NO: 35053 - DNA, 168 bp, Artificial Sequence
  Description of Artificial Sequence: Synthetic coding sequence
atgaacctggtggacctgtggctgaccaggagcctgtccatgtgcctgctgctgcagagctttgtgctgatgatcctgtgcttccacagcgcctccatgtgccccaagggctgcctgtgcagcagcagcggcggcctgaatgtgacctgcagcaatgccaacctgtag

SEQ ID NO: 35054 - DNA, 780 bp, Artificial Sequence; identical to SEQ ID NO: 35052
  Description of Artificial Sequence: Synthetic coding sequence

SEQ ID NO: 35055 - DNA, 492 bp, Artificial Sequence
  Description of Artificial Sequence: Synthetic coding sequence
atgaacctggtggacctgtggctgaccaggagcctgtccatgtgcctgctgctgcagagctttgtgctgatgatcctgtgcttccacagcgcctccatgtgccccaagggctgcctgtgcagcagcagcggcggcctgaatgtgacctgcagcaatgccaacctgaaggagatcccccgggacctgcccccagagaccgtgctgctgtacctggacagcaaccagatcaccagcatccccaatgagatcttcaaggacctgcaccagctgcgggtgctgaacctgagcaagaatggcatcgagttcattgatgagcacgccttcaagggcgtggccgagaccctgcagaccctggacctgagtgacaaccgcatccagagcgtgcacaagaatgccttcaacaacctgaaggcccgggcccgcatcgccaacaacccctggcactgtgactgcaccctgcagcaggtgctgcgctccatggccagcaactag

SEQ ID NO: 35056 - DNA, 780 bp, Artificial Sequence; identical to SEQ ID NO: 35052
  Description of Artificial Sequence: Synthetic coding sequence

SEQ ID NO: 35057 - DNA, 828 bp, Artificial Sequence
  Description of Artificial Sequence: Synthetic coding sequence
atgaggatgaccagcagcagctttgtgtcctactgcaccccaggcctgtgccagttcatggccatgctgcccacagctggccacctgctgcccctgctgctggtgattggcaccggcggcaccgtgcccagcccccaggtgcccccccggggctgctacgtggccaaggaggccggggagaggaccttccgctgcagccaggccggcctgtctgctgtgcccagcggcatccccaatgacaccaggaagctgtacctggatgccaaccagctggcctctgtgcctgctggggccttccagcacctgcctgtgctggaggagctggacctgagccacaatgccctggcccacctgtctggagctgccttccagggcctggagggcaccctgcggcacctggacctgagcgccaaccagctggcctctgtgcctgtggaggcctttgtgggcctgcagatccaggtgaacctgagcgccaacccctggcactgtgactgtgccctgcaggaggtgctgcggcaggtgcggctggtgcccggcactggaactggaattgtgtgtggcagcggggcccggccagacctggtgggccaggagttcctgctgctggccggggaggaggagctgtgtggcagcggctggggcggggcccggcgcagcacagatgtggccctgctggtgaccatgggcggctggctgaccctgatggtggcctacctggtgcactacgtgtggcagaacagagatgagacccggcgcagcctgaagagggcccctgtgctgcctgtgcgctctgaggacagcagcatcctgagcacagtggtgtag

SEQ ID NO: 35058 - DNA, 1962 bp, Artificial Sequence
  Description of Artificial Sequence: Synthetic coding sequence
atgaagctgctgtggcaggtgacagtgcaccaccacacctggaatgccatcctgctgccctttgtgtacctgacagcccaggtgtggatcctgtgtgccgccatcgctgctgctgccagcgctggcccccagaactgccccagcgtgtgcagctgcagcaaccagttcagcaaggtggtgtgcacccggcggggcctgtctgaggtgccccagggcatccccagcaacacccgctacctgaacctgatggagaacaacatccagatgatccaggccgacaccttccgccacctgcaccacctggaggtgctgcagctgggcaggaacagcatccggcagatcgaggtgggcgccttcaacggcctggccagcctgaacaccctggagctgtttgacaactggctgaccgtcatccccagcggggcctttgagtacctgagcaagctgcgggagctgtggctgaggaacaaccccatcgagagcatccccagctatgccttcaacagagtgcccagcctgatgaggctggacctgggggagctgaagaagctggagtacatcagcgagggcgcctttgagggcctcttcaacctgaagtacctgaacctgggcatgtgcaacatcaaggacatgcccaacctgacccccctggtgggcctggaggagctggagatgagcggcaaccacttccctgagatccggcccggcagcttccacggcctgagcagcctgaagaagctgtgggtgatgaacagccaggtgtccctgattgaaagaaatgcctttgatggcctggccagcctggtggagctgaacctggcccacaacaacctgagcagcctgccccatgacctcttcacccccctgcgctacctggtggagctgcacctgcaccacaacccctggaactgtgactgtgacatcctgtggctggcctggtggctgcgggagtacatccccaccaacagcacctgctgcggccgctgccacgcccccatgcacatgaggggccgctacctggtggaggtggaccaggccagcttccagtgcagcgcccccttcatcatggatgccccccgggacctgaacatcagcgagggccgcatggccgagctgaagtgcaggaccccacccatgagctctgtgaagtggctgctgcccaacggcaccgtgctgagccacgccagccgccacccccgcatctctgtgctgaatgatggcaccctgaacttcagccacgtgctgctgagtgacacaggagtgtacacctgcatggtgaccaacgtggccggcaacagcaatgccagcgcctacctgaatgtgtccacagctgagctgaacaccagcaactacagcttcttcaccaccgtgacagtggagaccacagagatcagccctgaggacaccaccaggaagtacaagcctgtgcccaccaccagcacaggctaccagcctgcctacaccaccagcaccaccgtgctgatccagaccaccagggtgcccaagcaggtggccgtgcctgccacagacaccacagacaagatgcagaccagcctggatgaggtgatgaagaccaccaagatcatcatcggctgctttgtggccgtgaccctgctggccgccgccatgctgattgtgttctacaagctgaggaagaggcaccagcagaggagcacagtgacagctgccaggacagtggagatcatccaggtggatgaggacatcccagctgccaccagcgctgctgccacagctgcccccagcggcgtgtctggagagggcgctgtggtgctgcccaccatccatgaccacatcaactacaacacctacaagccagcccacggggcccactggacagagaacagcctgggcaacagcctgcaccccaccgtgaccaccatcagcgagccctacatcatccagacccacaccaaggacaaggtgcaggagacccagatctag

SEQ ID NO: 35059 - DNA, 285 bp, Artificial Sequence
  Description of Artificial Sequence: Synthetic coding sequence
atgaagctgctgtggcaggtgacagtgcaccaccacacctggaatgccatcctgctgccctttgtgtacctgacagcccaggtgtggatcctgtgtgccgccatcgctgctgctgccagcgctggcccccagaactgccccagcgtgtgcagctgcagcaaccagttcagcaaggtggtgtgcacccggcggggcctgtctgaggtgccccagggcatccccagcaacacccgctacctgaacctgatggagaacaacatccagatgatccaggccgacacctag

SEQ ID NO: 35060 - DNA, 156 bp, Artificial Sequence
  Description of Artificial Sequence: Synthetic coding sequence
atgaagctgctgtggcaggtgacagtgcaccaccacacctggaatgccatcctgctgccctttgtgtacctgacagcccaggtgtggatcctgtgtgccgccatcgctgctgctgccagcgctggcccccagaactgccccagcgtgtgcagctag

SEQ ID NO: 35061 - DNA, 2142 bp, Artificial Sequence
  Description of Artificial Sequence: Synthetic coding sequence
atggcccgggcccggggcagcccctgcccccccctgcccccaggccgcatgtcctggccccatggagccctgctcttcctgtggctgttcagcccccccctgggcgctgggggcggcggcgtggccgtgaccagcgctgctgggggcggcagccccccagccaccagctgccctgtggcctgcagctgcagcaaccaggccagcagggtcatctgcacccggcgggacctggccgaggtgcctgccagcatccctgtgaacacccgctacctgaacctgcaggagaatggcatccaggtgatcagaacagacaccttcaagcacctgcggcacctggagatcctgcagctgagcaagaacctggtgaggaagattgaggtgggcgccttcaacggcctgcccagcctgaacaccctggagctgtttgacaaccggctgaccaccgtgcccacccaggcctttgagtacctgagcaagctgcgggagctgtggctgaggaacaaccccatcgagagcatccccagctatgccttcaacagagtgcccagcctgcggcggctggacctgggggagctgaagaggctggagtacatcagcgaggccgcctttgagggcctggtgaacctgcgctacctgaacctgggcatgtgcaacctgaaggacatccccaacctgacagccctggtgcggctggaggagctggagctgagcggcaaccggctggacctgatccggcccggcagcttccagggcctgaccagcctgaggaagctgtggctgatgcacgcccaggtggccaccatcgagagaaatgcctttgatgacctgaagagcctggaggagctgaacctgagccacaacaacctgatgagcctgccccatgacctcttcacccccctgcaccggctggagcgggtgcacctgaaccacaacccctggcactgcaactgtgatgtgctgtggctgtcctggtggctgaaggagaccgtgcccagcaacaccacctgctgtgcccgctgccacgccccagctggcctgaagggccgctacatcggggagctggaccagagccacttcacctgctacgcccctgtgattgtggagcccccaacagacctgaatgtgacagagggcatggctgctgagctgaagtgcaggacaggcacctccatgacctctgtgaactggctgacccccaacggcaccctgatgacccacggcagctacagagtgcgcatctctgtgctgcatgatggcaccctgaacttcaccaacgtgacagtgcaggacaccggccagtacacctgcatggtgaccaacagcgctggcaacaccacagccagcgccaccctgaatgtgtctgctgtggaccctgtggccgccggcggcaccggcagcggcggcggcggccctgggggcagcggcggcgtgggcggcggcagcggcggctacacctacttcaccaccgtgacagtggagaccctggagacccagcctggagaggaggccctgcagccccggggcacagagaaggagcccccaggccccaccacagatggagtgtggggcggcggccggcctggagatgctgctggccctgccagcagcagcaccacagccccagcccccaggagcagccggcccacagagaaggccttcaccgtgcccatcacagatgtgacagaaaatgccctgaaggacctggatgatgtgatgaagaccaccaagatcatcatcggctgctttgtggccatcaccttcatggctgctgtgatgctggtggccttctacaagctgaggaagcagcaccagctgcacaagcaccacggccccaccaggacagtggagatcatcaacgtggaggatgagctgcctgctgccagcgctgtgtctgtggccgctgctgctgctgtggccagcggcggcggcgtgggcggggacagccacctggccctgcctgccctggagcgggaccacctgaaccaccaccactacgtggccgccgccttcaaggcccactacagcagcaaccccagcggcggcggctgcggcggcaagggccccccaggcctgaacagcatccacgagcccctgctcttcaagagcggcagcaaagaaaatgtgcaggagacccagatctag

SEQ ID NO: 35062 - DNA, 1266 bp, Artificial Sequence
  Description of Artificial Sequence: Synthetic coding sequence
atggcccgggcccggggcagcccctgcccccccctgcccccaggccgcatgtcctggccccatggagccctgctcttcctgtggctgttcagcccccccctgggcgctgggggcggcggcgtggccgtgaccagcgctgctgggggcggcagccccccagccaccagctgccctgtggcctgcagctgcagcaaccaggccagcagggtcatctgcacccggcgggacctggccgaggtgcctgccagcatccctgtgaacacccgctacctgaacctgcaggagaatggcatccaggtgatcagaacagacaccttcaagcacctgcggcacctggagatcctgcagctgagcaagaacctggtgaggaagattgaggtgggcgccttcaacggcctgcccagcctgaacaccctggagctgtttgacaaccggctgaccaccgtgcccacccaggcctttgagtacctgagcaagctgcgggagctgtggctgaggaacaaccccatcgagagcatccccagctatgccttcaacagagtgcccagcctgcggcggctggacctgggggagctgaagaggctggagtacatcagcgaggccgcctttgagggcctggtgaacctgcgctacctgaacctgggcatgtgcaacctgaaggacatccccaacctgacagccctggtgcggctggaggagctggagctgagcggcaaccggctggacctgatccggcccggcagcttccagggcctgaccagcctgaggaagctgtggctgatgcacgcccaggtggccaccatcgagagaaatgcctttgatgacctgaagagcctggaggagctgaacctgagccacaacaacctgatgagcctgccccatgacctcttcacccccctgcaccggctggagcgggtgcacctgaaccacaacccctggcactgcaactgtgatgtgctgtggctgtcctggtggctgaaggagaccgtgcccagcaacaccacctgctgtgcccgctgccacgccccagctggcctgaagggccgctacatcggggagctggaccagagccacttcacctgctacgcccctgtgattgtggagcccccaacagacctgaatgtgacagagggcatggctgctgagctgaagtgcaggacaggcacctccatgacctctgtgaactggtggccccagctgcaccccaggaccagcgccctgcaggagcggctgcagggcgagcgggccagagatgctgacctgtag

SEQ ID NO: 35063 - DNA, 942 bp, Artificial Sequence
  Description of Artificial Sequence: Synthetic coding sequence
atgagcctggccagcggccctggccctggctggctgctcttctcctttggcatgggcctggtgtctggcagcaaatgtcccaacaactgcctgtgccaggcccaggaggtgatctgcaccgggaagcagctgacagagtaccccctggacatccccctgaacacccggcggctcttcctgaatgaaaatcgcatcaccagcctgcctgccatgcacctgggcctgctgagtgacctggtgtacctggactgccagaacaaccgcatccgggaggtgatggactacaccttcatcggggtcttcaagctgatctacctggacctgagcagcaacaacctgaccagcatcagccccttcaccttctctgtgctgagcaacctggtgcagctgaacatcgccaacaacccccacctgctgagcctgcacaagttcacctttgccaacaccaccagcctgcgctacctggacctgaggaacacaggcctgcagaccctggacagcgctgccctgtaccacctgaccaccctggagaccctcttcctgagcggcaacccctggaagtgcaactgcagcttcctggactttgccatcttcctgattgtgttccacatggaccccagtgatgacctgaatgccacctgtgtggagcccacagagctgaccggctggcccatcaccagggtgggcaaccccctgcgctacatgtgcatcacccacctggaccacaaggactacatcttcctgctgctgattggcttctgcatctttgctgctggcaccgtggccgcctggctgactggagtgtgtgctgtgctgtaccagaacaccaggcacaagagcagtgaagaagatgaagatgaggccggcaccagggtggaggtgagccgccgcatcttccagacccagaccagctctgtgcaggagttcccccagctgatctag

SEQ ID NO: 35064 - DNA, 1026 bp, Artificial Sequence
  Description of Artificial Sequence: Synthetic coding sequence
atgctgcggagccccaccttcacagatgctggcccccgctgcagctgcctgcctgtgtcccagaccctggacagcatggacacagtgctgatgggcagcctgcagcactgctgctgcctgctgcccaagatgggagacacctgggcccagctgccctggccaggccccccccacccagccatgctgctgatcagcctgctgctggccgccggcctgatgcacagtgatgctggcaccagctgccctgtgctgtgcacctgcaggaaccaggtggtggactgcagcagccagaggctcttctctgtgcccccagacctgcccatggacaccaggaacctgagcctggcccacaaccgcatcacagctgtgcccccaggctacctgacctgctacatggagctgcaggtgctggacctgcacaacaacagcctgatggagctgccccggggcctcttcctgcacgccaagaggctggcccacctggacctgagctacaacaacttcagccacgtgcctgctgacatgttccaggaggcccacggcctggtgcacatcgacctgagccacaacccctggctgcggcgggtgcacccccaggccttccagggcctgatgcagctgcgggacctggacctgtcctatggaggcctggccttcctgagcctggaggccctggagggcctgcccggcctggtgaccctgcagatcggcggcaacccctgggtgtgtggctgcaccatggagcccctgctgaagtggctgaggaaccgcatccagcgctgcacagctgacagccagctggctgaatgtcggggccccccagaggtggagggcgcccccctcttcagcctgacagaggagagcttcaaggcctgccacctgaccctgaccctggatgactacctgttcatcgcctttgtgggctttgtggtgtccatcgcctctgtggccaccaacttcctgctgggcatcacagccaactgctgccaccgctggagcaaggccagcgaggaggaggagatctag

SEQ ID NO: 35065 - DNA, 447 bp, Artificial Sequence
  Description of Artificial Sequence: Synthetic coding sequence
atggcctctgtggtgctggccctgcggaccaggacagctgtgaccagcctgctgagccccaccccagccacagccctggccgtgcgctatgccagcaagaagagcggcggcagcagcaagaacctgggcggcaagagcagtggaagacggcagggcatcaagaagatggagggccactacgtgcatgctggcaacatcatcgccacccagaggcacttccgctggcaccctggggcccacgtgggcgtgggcaagaacaagtgcctgtatgccctggaggagggcatcgtgcgctacaccaaggaggtgtatgtgccccaccccaggaacacagaagctgtggacctgatcacccggctgcccaagggagctgtgctgtacaagacctttgtgcacgtggtgcctgccaagccagagggcaccttcaagctggtggccatgctgtag

SEQ ID NO: 35066 - DNA, 2643 bp, Artificial Sequence
  Description of Artificial Sequence: Synthetic coding sequence
atgaagaacctgtacttccgggtcatcaccatcgtgattggcctgtacttcaccggcatcatgaccaatgccagcaggaagagcaacatcctcttcaacagcgagtgccagtggaatgagtacatcctgaccaactgcagcttcaccggaaaatgtgacatccctgtggacatcagccagacagctgccaccgtggatgtgtccttcaacttcttccgggtgctgctgcagagccacaccaagaaggaggagtggaagatcaagcacctggacctgagcaacaacctgatcagcaagatcaccctgagcccctttgcctacctgcacgccctggaggtgctgaacctgagcaacaatgccatccacagcctgagcctggacctgctgagccccaagagctcctgggtgaagaggcacaggagcagcttcaggaaccgcttccccctgctgaaggtgctgatcctgcagaggaacaagctgagtgacacccccaagggcctgtggaagctgaagagcctgcagagcctggacctgtccttcaacggcatcctgcagatcggctggagcgacttccacaactgcctgcagctggagaacctgtgcctgaagagcaacaagatcttcaagatccccccccaggccttcaaggacctgaagaagctgcaggtgattgacctgagcaacaatgccctgatcaccatcctgcccatgatgatcatcgccctggagttcccccacctggtggtggacctggccgacaacaactggcagtgtgatgattctgtggccgtgttccagaacttcatcagcgagagctggaggaagaagtggaatgtcatctgcaacagaagcatcggcagcgaggaggccaatggaggcaccccccagagccgcatcagccgggagacccggctgccccccatccacctgcacaggatgaagagcctcatccgcagcaaggccgagcggccccagggcggccgccacacaggcatcagcaccctgggcaagaaggccaaggccggcagcggcctgaggaagaagcagaggcggctgcccaggtctgtgcgcagcaccagagatgtgcaggccgccggcaagaaggaggatgccccccaggacctggccctggccgtgtgcctgagcgtcttcatcaccttcctggtggccttcagcctgggcgccttcacccggccctacgtggaccggctgtggcagaagaagtgccagagcaagagccctggcctggacaatgcctacagcaatgaaggcttctatgatgacatggaggccgccggccacaccccccaccctgagacccacctgcggcaggtgttcccccacctgagcctgtatgagaaccagacccccttctgggtgacccagccccacccccacgccaccgtcatcccagacaggaccctgggccgcagcaggaaggaccccggcagcagccagagccctggccagtgtggggacaacacaggagctggcagcggaaatgatggagctgtgtacagcatcctgcagaggcacccccatgctggcaaccgggagctgatgtctgctgcccaggaccacatccacagaaatgacatcctgggggagtggacctatgaaacagtggcccaggaggagcccctgagcgcccacagcgtgggcgtgtcctctgtggccggcaccagccatgctgtgtctggcagcagccgctatgacagcaatgagctggaccccagcctgtctggagagatcacagccagcctgtgcaagatgctgacccatgctgaggcccagaggactggagacagcaaggagcggggcggcacagagcagagcctgtgggacagccagatggagttcagcaaggagcggcaggtgagcagcagcattgacctgctgagcatccagcagccccggctgagcggggcccgggcagaggaggccctgagcgcccactacagcgaggtgccctacggggacccccgggacaccggccccagcgtcttccccccacgctgggacagcggcctggatgtgaccccagccaacaaggagcctgtgcagaagagcacccccagcgacacctgctgtgagctggagagtgactgtgacagtgatgagggcagcctcttcaccctgagcagcatcagcagcgagagcgcccggagcaagacagaggaggccgtgcctgatgaggagagcctgcaggatgagagcagcggggccagcaaggacaacgtgacagctgtggacagcctggaggagaatgtgaccttccagaccatccctgggaagtgcaagaaccaggaggacccctttgagaagcccctcatcagcgccccagattctggcatgtacaagacccacctggagaatgccagtgacacagacagaagtgagggcctgagcccctggcccaggagccctggcaacagccccctgggagatgagttccctggcatgttcacctatgactatgacacagccctgcagagcaaggctgctgagtggcactgcagcctgcgggacctggagttcagcaatgtggatgtgctgcagcagaccccaccctgcagcgctgaggtgcccagcgaccctgacaaggccgccttccacgagcgggacagcgacatcctgaagtag

SEQ ID NO: 35067 - DNA, 1869 bp, Artificial Sequence
  Description of Artificial Sequence: Synthetic coding sequence
atgtgtggcctgcagttcagcctgccctgcctgcggctcttcctggtggtgacctgctacctgctgctgctgctgcacaaggagatcctgggctgcagctctgtgtgccagctgtgcaccggccggcagatcaactgcaggaacctgggcctgagcagcatccccaagaacttccctgagagcaccgtcttcctgtacctgaccggcaacaacatctcctacatcaatgaaagtgagctgaccggcctgcacagcctggtggccctgtacctggacaacagcaacatcctgtatgtgtaccccaaggcctttgtgcagctgcggcacctgtacttcctgttcctgaacaacaacttcatcaagaggctggaccccggcatcttcaagggcctgctgaacctgaggaacctgtacctgcagtacaaccaggtgtcctttgtgccccggggcgtcttcaatgacctggtgtctgtgcagtacctgaacctgcagaggaaccggctgactgtgctgggcagcggcacctttgtgggcatggtggccctgcgcatcctggacctgagcaacaacaacatcctgcgcatcagcgagagcggcttccagcacctggagaacctggcctgcctgtacctgggcagcaacaacctgaccaaggtgcccagcaatgcctttgaggtgctgaagagcctgcggcggctgagcctgagccacaaccccatcgaggccatccagccctttgccttcaagggcctggccaacctggagtacctgctgctgaagaacagccgcatcagaaatgtgaccagagatggcttcagcggcatcaacaacctgaagcacctgatcctgagccacaatgacctggagaacctgaacagcgacaccttcagcctgctgaagaacctgatctacctgaagctggacaggaaccgcatcatcagcattgacaatgacacctttgagaacatgggcgccagcctgaagatcctgaacctgtccttcaacaacctgacagccctgcacccccgggtgctgaagcccctgagcagcctcatccacctgcaggccaacagcaacccctgggagtgcaactgcaagctgctgggcctgcgggactggctggccagcagcgccatcaccctgaacatctactgccagaacccccccagcatgaggggccgggccctgcgctacatcaacatcaccaactgtgtgaccagcagcatcaacgtgtcccgggcctgggccgtggtgaagagcccccacatccaccacaagaccacagccctgatgatggcctggcacaaggtgaccaccaacggcagccccctggagaacacagaaacagagaacatcaccttctgggagcgcatccccaccagccctgctggccgcttcttccaggagaatgccttcggcaaccccctggagaccacagctgtgctgcctgtgcagatccagctgaccacctctgtgaccctgaacctggagaagaacagcgccctgcccaatgatgctgcctccatgtctgggaagaccagcctcatctgcacccaggaggtggagaagctgaatgaggcctttgacatcctgctggccttcttcatcctggcctgtgtgctgatcatcttcctgatctacaaggtggtgcagttcaagcagaagctgaaggccagcgagaacagccgggagaaccggctggagtactacagcttctaccagagcgcccgctacaacgtgacagccagcatctgcaacaccagccccaacagcctggagagccctggcctggagcagatccggctgcacaagcagatcgtgcctgaaaatgaggcccaggtgatcctgtttgagcacagcgccctgtag

SEQ ID NO: 35068 - DNA, 2151 bp, Artificial Sequence
  Description of Artificial Sequence: Synthetic coding sequence
atggccaggatgagctttgtgattgctgcctgccagctggtgctgggcctgctgatgaccagcctgacagagagcagcatccagaacagtgaatgtccccagctgtgtgtgtgtgagatccggccctggttcaccccccagagcacctaccgggaggccaccaccgtggactgcaatgacctgcggctgacccgcatccccagcaacctgagcagtgacacccaggtgctgctgctgcagagcaacaacatcgccaagacagtggatgagctgcagcagctgttcaacctgacagagctggacttcagccagaacaacttcaccaacatcaaggaggtgggcctggccaacctgacccagctgaccaccctgcacctggaggagaaccagatcacagagatgacagactactgcctgcaggacctgagcaacctgcaggagctgtacatcaaccacaaccagatcagcaccatcagcgcccacgcctttgctggcctgaagaacctgctgcggctgcacctgaacagcaacaagctgaaggtgattgacagccgctggtttgacagcacccccaacctggagatcctgatgattggagagaaccctgtgattggcatcctggacatgaacttcaagcccctggccaacctgcggagcctggtgctggccggcatgtacctgacagacatccctggaaatgccctggtgggcctggacagcctggagagcctgtccttctatgacaacaagctggtgaaggtgccccagctggccctgcagaaggtgcccaacctgaagttcctggacctgaacaagaaccccatccacaagatccaggagggggacttcaagaacatgctgcggctgaaggagctgggcatcaacaacatgggagagctggtgtctgtggacagatatgccctggacaacctgcctgagctgaccaagctggaggccaccaacaaccccaagctgagctacatccaccggctggccttccgctctgtgcctgccctggagagcctgatgctgaacaacaatgccctgaatgccatctaccagaagacagtggagagcctgcccaacctgcgggagatcagcatccacagcaaccccctgcgctgtgactgtgtgatccactggatcaacagcaacaagaccaacatccgcttcatggagcccctgtccatgttctgtgccatgcctcctgagtacaagggccaccaggtgaaggaggtgctgatccaggacagcagcgagcagtgcctgcccatgatcagccatgacagcttccccaaccggctgaatgtggacatcggcaccaccgtcttcctggactgccgggccatggccgagcctgagcctgagatctactgggtgacccccatcggcaacaagatcaccgtggagaccctgagtgacaagtacaagctgagcagcgagggcaccctggagatcagcaacatccagatcgaggacagcggccgctacacctgtgtggcccagaatgtgcagggcgctgacaccagggtggccaccatcaaggtgaatggcaccctgctggatggcacccaggtgctgaagatctacgtgaagcagacagagagccacagcatcctggtgtcctggaaggtgaacagcaatgtgatgaccagcaacctgaagtggagcagcgccaccatgaagattgacaacccccacatcacctacacagcccgggtgcctgtggatgtgcatgagtacaacctgacccacctgcagcccagcacagattatgaggtgtgcctgactgtgagcaacatccaccagcagacccagaagagctgtgtgaatgtgaccaccaagaatgctgcctttgctgtggacatcagtgaccaggagaccagcacagccctggccgctgtgatgggctccatgtttgctgtgatcagcctggccagcattgctgtgtactttgccaagcgcttcaagaggaagaactaccaccacagcctgaagaagtacatgcagaagaccagcagcatccccctgaatgagctgtacccacccctcatcaacctgtgggagggggacagcgagaaggacaaggatggcagcgctgacaccaagcccacccaggtggacaccagccgcagctactacatgtggtag

SEQ ID NO: 35069 - DNA, 2142 bp, Artificial Sequence
  Description of Artificial Sequence: Synthetic coding sequence
atgaggctgctggtggcccccctgctgctggcctgggtggccggggccacagctgctgtgcctgtggtgccctggcacgtgccctgccccccccagtgtgcctgccagatccggccctggtacacccccaggagcagctaccgggaggccaccaccgtggactgcaatgacctcttcctgacagctgtgcccccagccctgcctgctggcacccagaccctgctgctgcagagcaacagcatcgtgcgggtggaccagagcgagctgggctacctggccaacctgacagagctggacctgagccagaacagcttcagtgatgcccgggactgtgacttccacgccctgccccagctgctgagcctgcacctggaggagaaccagctgacccggctggaggaccacagctttgctggcctggccagcctgcaggagctgtacctgaaccacaaccagctgtaccgcatcgccccccgggccttcagcggcctgagcaacctgctgcggctgcacctgaacagcaacctgctgcgggccatcgacagccgctggtttgagatgctgcccaacctggagatcctgatgattggaggcaacaaggtggatgccatcctggacatgaacttccggcccctggccaacctgcggagcctggtgctggccggcatgaacctgcgggagatcagtgactatgccctggagggcctgcagagcctggagagcctgtccttctatgacaaccagctggcccgggtgccccggcgggccctggagcaggtgcccggcctgaagttcctggacctgaacaagaaccccctgcagagggtgggccctggggactttgccaacatgctgcacctgaaggagctgggcctgaacaacatggaggagctggtgtccattgacaagtttgccctggtgaacctgcctgagctgaccaagctggacatcaccaacaacccccggctgtccttcatccacccccgggccttccaccacctgccccagatggagaccctgatgctgaacaacaatgccctgagcgccctgcaccagcagacagtggagagcctgcccaacctgcaggaggtgggcctgcacggcaaccccatccgctgtgactgtgtgatccgctgggccaatgccaccggcaccagggtgcgcttcatcgagccccagagcaccctgtgtgccgagcccccagacctgcagaggctgcctgtgcgggaggtgcccttccgggagatgacagaccactgcctgcccctcatcagccccaggagcttcccccccagcctgcaggtggccagcggggagagcatggtgctgcactgccgggccctggccgagcctgagcctgagatctactgggtgaccccagctggcctgcggctgaccccagcccacgccggccgccgctacagagtgtacccagagggcaccctggagctgcggcgggtgacagctgaggaggccggcctgtacacctgtgtggcccagaacctggtgggcgctgacaccaagacagtgtctgtggtggtgggccgggccctgctgcagcccggcagagatgagggccagggcctggagctgcgggtgcaggagacccacccctaccacatcctgctgtcctgggtgaccccacccaacacagtgtccaccaacctgacctggagcagcgccagcagcctgcggggccagggcgccacagccctggcccggctgccccggggcacccacagctacaacatcacccggctgctgcaggccacagagtactgggcctgcctgcaggtggcctttgctgatgcccacacccagctggcctgtgtgtgggcccggaccaaggaggccaccagctgccaccgggccctgggggacaggcctggcctcatcgccatcctggccctggccgtgctgctgctggccgccggcctggccgcccacctgggcaccggccagcccaggaaaggagtgggcggccggcggcccctgcccccagcctgggccttctggggctggagcgcccccagcgtgcgggtggtgtctgcccccctggtgctgccctggaaccctggcaggaagctgcccaggagcagcgagggggagaccctgctgccccccctgagccagaacagctag

SEQ ID NO: 35070 - DNA, 2142 bp, Artificial Sequence; identical to SEQ ID NO: 35069
  Description of Artificial Sequence: Synthetic coding sequence

SEQ ID NO: 35071 - DNA, 2142 bp, Artificial Sequence; identical to SEQ ID NO: 35069
  Description of Artificial Sequence: Synthetic coding sequence

SEQ ID NO: 35072 - DNA, 2127 bp, Artificial Sequence
  Description of Artificial Sequence: Synthetic coding sequence
atgaaggacatgcccctgcgcatccacgtgctgctgggcctggccatcaccaccctggtgcaggccgtggacaagaaggtggactgcccccggctgtgcacctgtgagatccggccctggttcacccccaggagcatctacatggaggccagcacagtggactgcaatgacctgggcctgctgaccttccctgcccggctgcctgccaacacccagatcctgctgctgcagaccaacaacatcgccaagattgagtacagcacagacttccctgtgaacctgaccggcctggacctgagccagaacaacctgagctctgtgaccaacatcaacgtgaagaagatgccccagctgctgtctgtgtacctggaggagaacaagctgacagagctgcctgagaagtgcctgtctgagctgagcaacctgcaggagctgtacatcaaccacaacctgctgagcaccatcagccctggggccttcatcggcctgcacaacctgctgcggctgcacctgaacagcaaccggctgcagatgatcaacagcaagtggtttgatgccctgcccaacctggagatcctgatgattggagagaaccccatcatccgcatcaaggacatgaacttcaagcccctcatcaacctgcggagcctggtgattgctggcatcaacctgacagagatcccagacaatgccctggtgggcctggagaacctggagagcatctccttctatgacaacagactcatcaaggtgccccacgtggccctgcagaaggtggtgaacctgaagttcctggacctgaacaagaaccccatcaaccgcatccggcggggggacttcagcaacatgctgcacctgaaggagctgggcatcaacaacatgcctgagctgatcagcattgacagcctggccgtggacaacctgcctgacctgaggaagattgaggccaccaacaacccccggctgagctacatccaccccaatgccttcttccggctgcccaagctggagagcctgatgctgaacagcaatgccctgagcgccctgtaccacggcaccatcgagagcctgcccaacctgaaggagatcagcatccacagcaaccccatccgctgtgactgtgtgatccgctggatgaacatgaacaagaccaacatccgcttcatggagccagacagcctcttctgtgtggaccccccagagttccagggccagaatgtgcggcaggtgcacttccgggacatgatggagatctgcctgcccctgattgcccctgagagcttccccagcaacctgaatgtggaggccggcagctatgtgtccttccactgccgggccacagctgagccccagcctgagatctactggatcacccccagcggccagaagctgctgcccaacaccctgacagacaagttctacgtgcacagcgagggcaccctggacatcaacggggtgacccccaaggagggcggcctgtacacctgcatcgccaccaacctggtgggcgctgacctgaagtctgtgatgatcaaggtggatggcagcttcccccaggacaacaacggcagcctgaacatcaagatccgggacatccaggccaacagcgtgctggtgtcctggaaggccagcagcaagatcctgaagagctctgtgaagtggacagcctttgtgaagacagagaacagccatgctgcccagagcgcccgcatccccagtgatgtgaaggtgtacaacctgacccacctgaaccccagcacagagtacaagatctgcatcgacatccccaccatctaccagaagaacaggaagaagtgtgtgaatgtgaccaccaagggcctgcacccagaccagaaggagtatgagaagaacaacaccaccaccctgatggcctgcctgggcggcctgctgggcatcatcggggtcatctgcctgatcagctgcctgagccctgagatgaactgtgatggcggccacagctatgtgaggaactacctgcagaagcccacctttgccctgggggagctgtacccacccctcatcaacctgtgggaggccggcaaggagaagagcaccagcctgaaggtgaaggccaccgtgattggcctgcccaccaacatgtcctag

SEQ ID NO: 35073 - DNA, 2127 bp, Artificial Sequence; identical to SEQ ID NO: 35072
  Description of Artificial Sequence: Synthetic coding sequence

SEQ ID NO: 35074 - DNA, 2127 bp, Artificial Sequence; identical to SEQ ID NO: 35072
  Description of Artificial Sequence: Synthetic coding sequence

SEQ ID NO: 35075 - DNA, 2223 bp, Artificial Sequence
  Description of Artificial Sequence: Synthetic coding sequence
atgaggcagaccctgcccctgctgctgctgactgtgctgcggcccagctgggccgaccccccccaggagaaggtgcccctcttccgggtgacccagcagggcccctggggcagcagcggcagcaatgccacagacagcccctgtgagggcctgcctgctgctgatgccacagccctgaccctggccaacagaaacctggagcggctgcccggctgcctgcccaggaccctgcggagcctggatgccagccacaacctgctgcgggccctgagcaccagcgagctgggccacctggagcagctgcaggtgctgaccctgcggcacaacagaattgctgccctgcgctggggccctgggggccctgctggcctgcacaccctggacctgagctacaaccagctggccgccctgcccccctgcaccggccctgccctgagcagcctgcgggccctggccctggccggcaaccccctgcgggccctgcagccccgggcctttgcctgcttccctgccctgcagctgctgaacctgagctgcacagccctgggccgcggggcccagggcggcattgctgaggccgcctttgctggggaggatggagcccccctggtgaccctggaggtgctggacctgagcggcaccttcctggagcgggtggagagcggctggatccgggacctgcccaagctgaccagcctgtacctgaggaagatgccccggctgaccaccctggagggggacatcttcaagatgacccccaacctgcagcagctggactgccaggacagccctgccctggcctctgtggccacccacatcttccaggacaccccccacctgcaggtgctgctcttccagaactgcaacctgagcagcttccccccctggaccctggacagcagccaggtgctgagcatcaacctgtttggaaaccccctgacctgcagctgtgacctgtcctggctgctgacagatgccaagaggacagtgctgagcagagctgctgacaccatgtgtgccccagctgctggcagcagcggccccttcagcgccagcctgagcctgagccagctgcccggggtgtgccagagcgaccagagcaccaccctgggcgccagccaccccccctgcttcaacagaagcacctacgcccagggcaccaccgtggcccccagcgctgccccagccaccaggcctgctggggaccagcagagcgtgtccaaggccccaaatgtgggcagcaggaccatcgccgcctggccccacagtgatgcccgggagggcacagcccccagcaccaccaacagcgtggccggccacagcaacagcagcgtcttccccagggctgccagcaccaccaggacccagcacagaggagaacatgcccctgagctggtgctggagccagacatctctgctgccagcacccccctggccagcaagctgctgggccccttccccacctcctgggacaggagcatcagcagcccccagcccggccagaggacccacgccaccccccaggcccccaaccccagcctgtctgagggggagatccctgtgctgctgctggatgactacagcgaggaggaggagggcaggaaggaggaggtgggcaccccccaccaggatgtgccctgtgactaccacccctgcaagcacctgcagaccccctgtgccgagctgcagaggcgctggcgctgccgctgccccggcctgagcggggaggacaccatcccagaccccccccggctgcagggcgtgacagagaccacagacaccagcgccctggtgcactggtgtgcccccaacagcgtggtgcacggctaccagatccgctacagcgctgagggctgggccggcaaccagagcgtggtgggcgtcatctatgccacagcccggcagcaccccctgtatggcctgagccctggcaccacctacagagtgtgtgtgctggccgccaacagagctggcctgagccagcccaggagcagcggctggaggagcccctgtgccgccttcaccaccaagcccagctttgccctgctgctgagcggcctgtgtgccgccagcggcctgctgctggccagcacagtggtgctgagcgcctgcctgtgcagaagaggccagaccctgggcctgcagagatgtgacacccacctggtggcctacaagaacccagcctttgatgactaccccctgggcctgcagacagtgtcctag

SEQ ID NO: 35076 - DNA, 1191 bp, Artificial Sequence
  Description of Artificial Sequence: Synthetic coding sequence
atgaagaactatgagagcaagaagtacagcgaccccagccagcccggcaacacagtgctgcaccctggcaccaggctcatccagaagctgcacaccagcacctgctggctgcaggaggtgcctgggaagccccagctggagcaggccaccaagcacccccaggtgaccagcccccaggccaccaaggagaccggcatggagatcaaggagggcaagcagagctaccggcagaagatcatggatgagctgaagtactactacaacggcttctacctgctgtggattgatgccaaggtggccgccaggatggtgtggaggctgctgcacggccaggtgctgacccggcgggagaggagaagagaggagaagcagaagaagaagatggctgtgaagctggagctggccaagttcctgcaggagaccatgacagagatggcccggaggaacagagccaagatgggagatgccagcacccagctgagcagctatgtgaagcaggtgcagacaggccacaagcccagcaccaaggagatcgtgcgcttcagcaagctgtttgaggaccagctggccctggagcacctggaccggccccagctggtggccctgtgcaagctgctggagctgcagaccttcggcaccaacaacctgctgcgcttccagctgctgatgaagctgaagagcatcaaggcagatgatgagatcatcgccaaggagggcgtgacagccctgtctgtgtctgagctgcaggccgcctgccgggcccggggcatgaggagcctgggcctgacagaggagcagctgcggcagcagctgacagagtggcaggacctgcacctgaaggaaaatgtgccccccagcctgctgctgctgagcaggaccttctacctgattgatgtgaagcccaagcccatcgagatccccctgtctggagaggcccccaagacagacatcctggtggagctgcccaccttcacagagagcaaagaaaacatggtggacctggccccccagctgaagggcaccaaggatgaggacttcatccagcccccacctgtgaccagcagccccatcacccccagcacccccatcagcctgcccaagggccccatcaccagcagcgaggagcccaccctgcaggccaagagccagatgacagcccagaacagcaaggccagcagcaagggggcctag

SEQ ID NO: 35077 - DNA, 1476 bp, Artificial Sequence
  Description of Artificial Sequence: Synthetic coding sequence
atggccttctacagctacaacagcgtgctggccatcgcccggacccgcttccccagccactttgtgcaccccacctgcagcagctacagccccagctgtgccttcctgcacctgcctgacagccacctgaacaagacctgcatgaagaactatgagagcaagaagtacagcgaccccagccagcccggcaacacagtgctgcaccctggcaccaggctcatccagaagctgcacaccagcacctgctggctgcaggaggtgcctgggaagccccagctggagcaggccaccaagcacccccaggtgaccagcccccaggccaccaaggagaccggcatggagatcaaggagggcaagcagagctaccggcagaagatcatggatgagctgaagtactactacaacggcttctacctgctgtggattgatgccaaggtggccgccaggatggtgtggaggctgctgcacggccaggtgctgacccggcgggagcggcggcggctgctgcggacctgtgtggacttcttccggctggtgcccttcatggtgttcctgattgtgcccttcatggagttcctgctgcctgtgttcctgaagctgtttcctgagatgctgcccagcacctttgaaagtgagagcaagaaggaggagaagcagaagaagaagatggctgtgaagctggagctggccaagttcctgcaggagaccatgacagagatggcccggaggaacagagccaagatgggagatgccagcacccagctgagcagctatgtgaagcaggtgcagacaggccacaagcccagcaccaaggagatcgtgcgcttcagcaagctgtttgaggaccagctggccctggagcacctggaccggccccagctggtggccctgtgcaagctgctggagctgcagaccttcggcaccaacaacctgctgcgcttccagctgctgatgaagctgaagagcatcaaggcagatgatgagatcatcgccaaggagggcgtgacagccctgtctgtgtctgagctgcaggccgcctgccgggcccggggcatgaggagcctgggcctgacagaggagcagctgcggcagcagctgacagagtggcaggacctgcacctgaaggaaaatgtgccccccagcctgctgctgctgagcaggaccttctacctgattgatgtgaagcccaagcccatcgagatccccctgagcggggaggcccccaagacagacatcctggtggagctgcccaccttcacagagagcaaggagaacatggtggacctggccccccagctgaagggcaccaaggatgaggacttcatccagcccccacctgtgaccagcagccccatcacccccagcacccccatcagcctgcccaagggccccatcaccagcagcgaggagcccaccctgcaggccaagagccagatgacagcccagaacagcaaggccagcagcaaaggagcctag

SEQ ID NO: 35078 - DNA, 1332 bp, Artificial Sequence
  Description of Artificial Sequence: Synthetic coding sequence
atggccttctacagctacaacagcgtgctggccatcgcccggacccgcttccccagccactttgtgcaccccacctgcagcagctacagccccagctgtgccttcctgcacctgcctgacagccacctgaacaagacctgcatgaagaactatgagagcaagaagtacagcgaccccagccagcccggcaacacagtgctgcaccctggcaccaggctcatccagaagctgcacaccagcacctgctggctgcaggaggtgcctgggaagccccagctggagcaggccaccaagcacccccaggtgaccagcccccaggccaccaaggagaccggcatggagatcaaggagggcaagcagagctaccggcagaagatcatggatgagctgaagtactactacaacggcttctacctgctgtggattgatgccaaggtggccgccaggatggtgtggaggctgctgcacggccaggtgctgacccggcgggagcggcggcgggaggagaagcagaagaagaagatggctgtgaagctggagctggccaagttcctgcaggagaccatgacagagatggcccggaggaacagagccaagatgggagatgccagcacccagctgagcagctatgtgaagcaggtgcagacaggccacaagcccagcaccaaggagatcgtgcgcttcagcaagctgtttgaggaccagctggccctggagcacctggaccggccccagctggtggccctgtgcaagctgctggagctgcagaccttcggcaccaacaacctgctgcgcttccagctgctgatgaagctgaagagcatcaaggcagatgatgagatcatcgccaaggagggcgtgacagccctgtctgtgtctgagctgcaggccgcctgccgggcccggggcatgaggagcctgggcctgacagaggagcagctgcggcagcagctgacagagtggcaggacctgcacctgaaggaaaatgtgccccccagcctgctgctgctgagcaggaccttctacctgattgatgtgaagcccaagcccatcgagatccccctgagcggggaggcccccaagacagacatcctggtggagctgcccaccttcacagagagcaaggagaacatggtggacctggccccccagctgaagggcaccaaggatgaggacttcatccagcccccacctgtgaccagcagccccatcacccccagcacccccatcagcctgcccaagggccccatcaccagcagcgaggagcccaccctgcaggccaagagccagatgacagcccagaacagcaaggccagcagcaaaggagcctag

SEQ ID NO: 35079 - DNA, 429 bp, Artificial Sequence
  Description of Artificial Sequence: Synthetic coding sequence
atggccttctacagctacaacagcgtgctggccatcgcccggacccgcttccccagccactttgtgcaccccacctgcagcagctacagccccagctgtgccttcctgcacctgcctgacagccacctgaacaagacctgcatgaagaactatgagagcaagaagtacagcgaccccagccagcccggcaacacagtgctgcaccctggcaccaggctcatccagaagctgcacaccagcacctgctggctgcaggaggtgcctgggaagccccagctggagcaggccaccaagcacccccaggtgaccagcccccaggccaccaaggagaccggcatggagatcaaggagggcaagcagagctaccggcagaagatcatggatgagctgaagtactactacaacggcttctacctgctgtggatctag

SEQ ID NO: 35080 - DNA, 351 bp, Artificial Sequence
  Description of Artificial Sequence: Synthetic coding sequence
atggccttctacagctacaacagcgtgctggccatcgcccggacccgcttccccagccactttgtgcaccccacctgcagcagctacagccccagctgtgccttcctgcacctgcctgacagccacctgaacaagacctgcatgaagaactatgagagcaagaagtacagcgaccccagccagcccggcaacacagtgctgcaccctggcaccaggctcatccagaagctgcacaccagcacctgctggctgcaggaggtgcctgggaagccccagctggagcaggccaccaagcacccccaggtgaccagcccccaggccaccaaggagaccggcatggagatcaagtag

SEQ ID NO: 35081 - DNA, 834 bp, Artificial Sequence
  Description of Artificial Sequence: Synthetic coding sequence
atggaggagaagcagaagaagaagatggctgtgaagctggagctggccaagttcctgcaggagaccatgacagagatggcccggaggaacagagccaagatgggagatgccagcacccagctgagcagctatgtgaagcaggtgcagacaggccacaagcccagcaccaaggagatcgtgcgcttcagcaagctgtttgaggaccagctggccctggagcacctggaccggccccagctggtggccctgtgcaagctgctggagctgcagaccttcggcaccaacaacctgctgcgcttccagctgctgatgaagctgaagagcatcaaggcagatgatgagatcatcgccaaggagggcgtgacagccctgtctgtgtctgagctgcaggccgcctgccgggcccggggcatgaggagcctgggcctgacagaggagcagctgcggcagcagctgacagagtggcaggacctgcacctgaaggaaaatgtgccccccagcctgctgctgctgagcaggaccttctacctgattgatgtgaagcccaagcccatcgagatccccctgagcggggaggcccccaagacagacatcctggtggagctgcccaccttcacagagagcaaggagaacatggtggacctggccccccagctgaagggcaccaaggatgaggacttcatccagcccccacctgtgaccagcagccccatcacccccagcacccccatcagcctgcccaagggccccatcaccagcagcgaggagcccaccctgcaggccaagagccagatgacagcccagaacagcaaggccagcagcaaaggagcctag

SEQ ID NO: 35082 - DNA, 369 bp, Artificial Sequence
  Description of Artificial Sequence: Synthetic coding sequence
atgaagaactatgagagcaagaagtacagcgaccccagccagcccggcaacacagtgctgcaccctggcaccaggctcatccagaagctgcacaccagcacctgctggctgcaggaggtgcctgggaagccccagctggagcaggccaccaagcacccccaggtgaccagcccccaggccaccaaggagaccggcatggagatcaaggagggcaagcagagctaccggcagaagatcatggatgagctgaagtactactacaacggcttctacctgctgtggattgatgccaaggtggccgccaggatggtgtggaggctgctgcacggccaggtgctgacccggcgggagcggcggcgctgcttctag

SEQ ID NO: 35083 - DNA, 1335 bp, Artificial Sequence
  Description of Artificial Sequence: Synthetic coding sequence
atgaagaactatgagagcaagaagtacagcgaccccagccagcccggcaacacagtgctgcaccctggcaccaggctcatccagaagctgcacaccagcacctgctggctgcaggaggtgcctgggaagccccagctggagcaggccaccaagcacccccaggtgaccagcccccaggccaccaaggagaccggcatggagatcaaggagggcaagcagagctaccggcagaagatcatggatgagctgaagtactactacaacggcttctacctgctgtggattgatgccaaggtggccgccaggatggtgtggaggctgctgcacggccaggtgctgacccggcgggagcggcggcggctgctgcggacctgtgtggacttcttccggctggtgcccttcatggtgttcctgattgtgcccttcatggagttcctgctgcccgtcttcctgaagctgtttcctgagatgctgcccagcacctttgagagcgagagcaagaaggaggagaagcagaagaagaagatggctgtgaagctggagctggccaagttcctgcaggagaccatgacagagatggcccggaggaacagagccaagatgggagatgccagcacccagctgagcagctatgtgaagcaggtgcagacaggccacaagcccagcaccaaggagatcgtgcgcttcagcaagctgtttgaggaccagctggccctggagcacctggaccggccccagctggtggccctgtgcaagctgctggagctgcagaccttcggcaccaacaacctgctgcgcttccagctgctgatgaagctgaagagcatcaaggcagatgatgagatcatcgccaaggagggcgtgacagccctgtctgtgtctgagctgcaggccgcctgccgggcccggggcatgaggagcctgggcctgacagaggagcagctgcggcagcagctgacagagtggcaggacctgcacctgaaggaaaatgtgccccccagcctgctgctgctgagcaggaccttctacctgattgatgtgaagcccaagcccatcgagatccccctgtctggagaggcccccaagacagacatcctggtggagctgcccaccttcacagagagcaaagaaaacatggtggacctggccccccagctgaagggcaccaaggatgaggacttcatccagcccccacctgtgaccagcagccccatcacccccagcacccccatcagcctgcccaagggccccatcaccagcagcgaggagcccaccctgcaggccaagagccagatgacagcccagaacagcaaggccagcagcaagggggcctag

SEQ ID NO: 35084 - DNA, 1872 bp, Artificial Sequence
  Description of Artificial Sequence: Synthetic coding sequence
atgagggtggccctgggcatgctgtggctgctggccctggcctggccaccccaggcccggggcttctgccccagccagtgcagctgcagcctgcacatcatgggagatggcagcaaggccaggacagtggtgtgcaatgaccctgacatgaccctgcccccagccagcatccccccagacaccagccggctgcggctggagaggacagccatccggcgggtgcctggagaggccttccggcccctgggccgcctggagcagctgtggctgccctacaatgccctgtctgagctgaatgccctgatgctgcggggcctgcggcggctgcgggagctgcggctgcccggcaaccggctggccgccttcccctgggccgccctgagagatgcccccaagctgcggctgctggacctgcaggccaaccggctgtctgctgtgcctgctgaggccgcccgcttcctggagaacctgaccttcctggacctgagcagcaaccagctgatgaggctgccccaggagctgattgtgtcctgggcccacctggagaccggcatcttccccccaggccaccaccccaggagagtgctgggcctgcaggacaacccctgggcctgtgactgccgcctgtatgacctggtgcacctgctggatggctgggcccccaacctggccttcatcgagacagagctgcgctgtgccagccccaggagcctggccggcgtggccttcagccagctggagctgaggaagtgccagggccctgagctgcaccctggggtggccagcatccgcagcctgctgggcggcacagccctgctgcgctgtggggccaccggggtgcccggccctgagatgtcctggaggcgggccaacggccggcccctgaatggcaccgtgcaccaggaggtgtccagtgatggcacctcctggaccctgctgggcctgcctgctgtgagccacctggacagcggggactacatctgccaggccaagaacttcctgggcgccagcgagaccgtcatcagcctcatcgtgacagagccccccaccagcacagagcacagcggcagccctggggccctgtgggccaggactggaggcggcggggaggccgccgcctacaacaacaagctggtggcccggcacgtgccccagatccccaagccagctgtgctggccaccggccccagcgtgcccagcaccaaggaggagctgaccctggagcacttccagatggatgccctgggggagctgagtgatggccgggccggccccagcgaggccaggatggtgcgctctgtgaaggtggtgggggacacctaccacagcgtgtccctggtgtggaaggccccccaggccaagaacaccacagccttctctgtgctgtatgctgtgtttggccagcacagcatgagaagagtgattgtgcagcccgggaagaccagggtgaccatcaccggcctgctgcccaagaccaagtatgtggcctgtgtgtgtgtgcagggcctggtgcccaggaaggagcagtgtgtgatcttcagcaccaatgaggtggtggatgctgagaacacccagcagctgatcaacgtggtggtgatctctgtggccatcgtgattgccctgcccctgaccctgctggtgtgctgcagcgccctgcagaagcgctgcaggaagtgcttcaacaaggacagcacagaggccaccgtgacctacgtgaacctggagcggctgggctacagtgaagatggcctggaggagctgagccgccacagcgtgtctgaggccgaccggctgctgagcgcccggagctctgtggacttccaggccttcggcgtgaagggcggccgccgcatcaatgagtacttctgctag

SEQ ID NO: 35085 - DNA, 1491 bp, Artificial Sequence
  Description of Artificial Sequence: Synthetic coding sequence
atggtggagccccaccaggagcccaggcacagcaaggtgggcctgcaggacaacccctggttctgtgactgccacatcagcaagatgattgagctgagcaaggtggtggaccctgccatcgtgctgctggaccccctgatgacctgcagcgagcctgagcggctgaccggcatcctcttccagagagctgagctggagcactgcctgaagcccagcgtgatgaccagcgccaccaagatcatgtctgccctgggcagcaatgtgctgctgcgctgtgatgccaccggcttccccaccccccagatcacctggaccaggagtgacagcagccctgtgaactacaccgtcatccaggagagccctgaggagggcgtgcgctggagcatcatgagcctgaccggcatcagcagcaaggatgctggggactacaagtgcaaggccaagaacctggccggcatgtctgaggccgtggtgacagtgacagtgctgggcatcaccaccacccccatccccccagacaccagcgagaggactggagaccaccctgagtgggatgtgcagcccggcagcggccgcagcacctctgtgagcagcgccagcagctacctgtggagcagcagcttcagccccaccagcagcttcagcgccagcaccctgagcccccccagcacagccagcttcagcctgagccccttcagcagcagcacagtgagcagcaccaccaccctgagcaccagcatcagcgccagcaccaccatggccaacaagaggagcttccagctgcaccagggcggcaagaggaacctgaaggtggccaagaatggcagcaagctgcccccagccagcaccagcaagaaggaggagctggccctgctggaccagaccatgctgacagagaccaatgctgccatcgagaacctgcgggtggtgtctgagaccaaggagagcgtgaccctgacctggaacatgatcaacaccacccacaacagcgctgtgacagtgctgtacagcaaatatggaggcaaggacctgctgctgctgaatgctgacagcagcaagaaccaggtgaccattgatggcctggagcccggcggccagtacatggcctgtgtgtgccccaagggcgtgcccccccagaaggaccagtgcatcaccttcagcacagagcgggtggagggagatgacagccagtggagcctgctgctggtggtgaccagcacagcctgtgtggtgatcctgcccctcatctgcttcctgctgtacaaggtgtgcaagctgcagtgcaagtctgagcccttctgggaggatgacctggccaaggagacctacatccagtttgagaccctcttccccaggagccagagcgtgggggagctgtggaccaggagccacagagatgacagcgagaagctgctgctgtgcagccgcagctctgtggagagccaggtgaccttcaagtctgagggcagcaggcctgagtactactgctag

SEQ ID NO: 35086 - DNA, 1905 bp, Artificial Sequence
  Description of Artificial Sequence: Synthetic coding sequence
atggacatgaatgagctgcccaccaacctgcctgtggacacagtgaagctgagaattgagaagacagtcatccgccgcatctctgctgaggccttctactacctggtggagctgcagtacctgtgggtgacctacaacagcgtggccagcattgaccccagcagcttctacaacctgaagcagctgcacgagctgcggctggatggcaacagcctggccgccttcccctgggccagcctgctggacatgcccctgctgcggaccctggacctgcacaacaacaagatcacctctgtgcccaatgaggccctgcgctacctgaagaacctggcctacctggacctgagcagcaaccggctgaccaccctgcccccagacttcctggagagctggacccacctggtgtccaccccatctggagtgctggacctgagccccagccgcatcatcctgggcctgcaggacaacccctggttctgtgactgccacatcagcaagatgattgagctgagcaaggtggtggaccctgccatcgtgctgctggaccccctgatgacctgcagcgagcctgagcggctgaccggcatcctcttccagagagctgagctggagcactgcctgaagcccagcgtgatgaccagcgccaccaagatcatgtctgccctgggcagcaatgtgctgctgcgctgtgatgccaccggcttccccaccccccagatcacctggaccaggagtgacagcagccctgtgaactacaccgtcatccaggagagccctgaggagggcgtgcgctggagcatcatgagcctgaccggcatcagcagcaaggatgctggggactacaagtgcaaggccaagaacctggccggcatgtctgaggccgtggtgacagtgacagtgctgggcatcaccaccacccccatccccccagacaccagcgagaggactggagaccaccctgagtgggatgtgcagcccggcagcggccgcagcacctctgtgagcagcgccagcagctacctgtggagcagcagcttcagccccaccagcagcttcagcgccagcaccctgagcccccccagcacagccagcttcagcctgagccccttcagcagcagcacagtgagcagcaccaccaccctgagcaccagcatcagcgccagcaccaccatggccaacaagaggagcttccagctgcaccagggcggcaagaggaacctgaaggtggccaagaatggcagcaagctgcccccagccagcaccagcaagaaggaggagctggccctgctggaccagaccatgctgacagagaccaatgctgccatcgagaacctgcgggtggtgtctgagaccaaggagagcgtgaccctgacctggaacatgatcaacaccacccacaacagcgctgtgacagtgctgtacagcaaatatggaggcaaggacctgctgctgctgaatgctgacagcagcaagaaccaggtgaccattgatggcctggagcccggcggccagtacatggcctgtgtgtgccccaagggcgtgcccccccagaaggaccagtgcatcaccttcagcacagagcgggtggagggagatgacagccagtggagcctgctgctggtggtgaccagcacagcctgtgtggtgatcctgcccctcatctgcttcctgctgtacaaggtgtgcaagctgcagtgcaagtctgagcccttctgggaggatgacctggccaaggagacctacatccagtttgagaccctcttccccaggagccagagcgtgggggagctgtggaccaggagccacagagatgacagcgagaagctgctgctgtgcagccgcagctctgtggagagccaggtgaccttcaagtctgagggcagcaggcctgagtactactgctag

SEQ ID NO: 35087 - DNA, 1491 bp, Artificial Sequence; identical to SEQ ID NO: 35085
  Description of Artificial Sequence: Synthetic coding sequence

SEQ ID NO: 35088 - DNA, 3360 bp, Artificial Sequence
  Description of Artificial Sequence: Synthetic coding sequence
atgtctgcccccagcctgcgggcccgggctgctggcctgggcctgctgctgtgtgctgtgctgggccgggccggccgcagtgacagcggcggccgcggggagctgggccagcccagcggcgtggccgctgagcggccctgccccaccacctgccgctgcctgggggacctgctggactgcagcaggaagaggctggcccggctgcctgagcccctgcccagctgggtggcccggctggacctgagccacaaccggctgtccttcatcaaggccagctccatgagccacctgcagagcctgcgggaggtgaagctgaacaacaatgagctggagaccatccccaacctgggccctgtgtctgccaacatcaccctgctgagcctggccggcaacagaattgtggagatcctgcctgagcacctgaaggagttccagagcctggagaccctggacctgagcagcaacaacatcagcgagctgcagacagccttccctgccctgcagctgaagtacctgtacctgaacagcaacagagtgacctccatggagcccggctactttgacaacctggccaacaccctgctggtgctgaagctgaacagaaaccgcatcagcgccatcccccccaagatgttcaagctgccccagctgcagcacctggagctgaacagaaacaagatcaagaatgtggatggcctgaccttccagggcctgggcgccctgaagagcctgaagatgcagagaaatggagtgaccaagctgatggatggagccttctggggcctgagcaacatggagatcctgcagctggaccacaacaacctgacagagatcaccaagggctggctgtatggcctgctgatgctgcaggagctgcacctgagccagaatgccatcaaccgcatcagcccagatgcctgggagttctgccagaagctgtctgagctggacctgaccttcaaccacctgagccggctggatgacagcagcttcctgggcctgagcctgctgaacaccctgcacatcggcaacaacagagtgtcctacatcgctgactgtgccttccggggcctgagcagcctgaagaccctggacctgaagaacaatgagatctcctggaccatcgaggacatgaatggagccttcagcggcctggacaagctgcggcggctcatcctgcagggcaaccgcatccgcagcatcaccaagaaggccttcaccggcctggatgccctggagcacctggacctgagtgacaatgccatcatgagcctgcagggcaatgccttcagccagatgaagaagctgcagcagctgcacctgaacaccagcagcctgctgtgtgactgccagctgaagtggctgccccagtgggtggccgagaacaacttccagagctttgtgaatgccagctgtgcccacccccagctgctgaagggccgcagcatctttgctgtgtccccagatggctttgtgtgtgatgacttccccaagccccagatcaccgtgcagcctgagacccagagcgccatcaagggcagcaacctgtccttcatctgcagcgctgccagcagcagtgacagccccatgacctttgcctggaagaaggacaatgagctgctgcatgatgctgagatggagaactatgcccacctgcgggcccagggcggggaggtgatggagtacaccaccatcctgcggctgcgggaggtggagtttgccagcgagggcaagtaccagtgtgtgatcagcaaccacttcggcagcagctacagcgtgaaggccaagctgactgtgaacatgctgcccagcttcaccaagacccccatggacctgaccatccgggccggggccatggcccggctggagtgtgccgctgtgggccacccagccccccagatcgcctggcagaaggatggcggcacagacttccctgctgcccgggagaggaggatgcacgtgatgccagaagatgatgtgttcttcatcgtggatgtgaagattgaagatattggagtgtacagctgcacagcccagaacagcgctggcagcatcagcgccaatgccaccctgactgtgctggagacccccagcttcctgcggcccctgctggacagaacagtgaccaagggggagacagctgtgctgcagtgcatcgccggcggcagccccccacccaagctgaactggaccaaggatgacagccccctggtggtgacagagcggcacttctttgctgctggcaaccagctgctgatcatcgtggacagtgatgtgtctgatgctgggaagtacacctgtgagatgagcaacaccctgggcacagaaagaggaaatgtgcggctgagcgtcatccccacccccacctgtgacagcccccagatgacagcccccagcctggatgatgatggctgggccaccgtgggcgtggtgatcatcgctgtggtgtgctgcgtggtgggcaccagcctggtgtgggtggtgatcatctaccacaccaggagaagaaatgaagactgcagcatcaccaacacagatgagaccaacctgcctgctgacatccccagctacctgagcagccagggcaccctggccgaccggcaggacggctacgtgagcagcgagagcggcagccaccaccagtttgtgaccagcagcggggccggcttcttcctgccccagcacgacagcagcggcacctgccacatcgacaacagcagcgaggctgatgtggaggccgccacagacctcttcctgtgccccttcctgggcagcacaggccccatgtacctgaagggaaatgtgtatggcagtgacccctttgagacctaccacacaggctgcagcccagaccccaggacagtgctgatggaccactatgagcccagctacatcaagaagaaggagtgctacccctgcagccaccccagcgaggagagctgtgagaggagcttcagcaacatctcctggcccagccacgtgaggaagctgctgaacaccagctacagccacaatgaaggacctggcatgaagaacctgtgcctgaacaagagcagcctggacttcagcgccaaccctgagcccgcctctgtggccagcagcaacagcttcatgggcaccttcggcaaggccctgcggcggccccacctggatgcctacagcagctttggccagcccagcgactgccagccccgggccttctacctgaaggcccacagcagcccagacctggacagcggctctgaagaagatggcaaggagaggacagacttccaggaggagaaccacatctgcaccttcaagcagaccctggagaactaccgcacccccaacttccagagctatgacctggacacctag

SEQ ID NO: 35089 - DNA, 3180 bp, Artificial Sequence
  Description of Artificial Sequence: Synthetic coding sequence
atggtggatgtgctgctgctcttcagcctgtgcctgctcttccacatcagcaggccagacctgagccacaaccggctgtccttcatcaaggccagctccatgagccacctgcagagcctgcgggaggtgaagctgaacaacaatgagctggagaccatccccaacctgggccctgtgtctgccaacatcaccctgctgagcctggccggcaacagaattgtggagatcctgcctgagcacctgaaggagttccagagcctggagaccctggacctgagcagcaacaacatcagcgagctgcagacagccttccctgccctgcagctgaagtacctgtacctgaacagcaacagagtgacctccatggagcccggctactttgacaacctggccaacaccctgctggtgctgaagctgaacagaaaccgcatcagcgccatcccccccaagatgttcaagctgccccagctgcagcacctggagctgaacagaaacaagatcaagaatgtggatggcctgaccttccagggcctgggcgccctgaagagcctgaagatgcagagaaatggagtgaccaagctgatggatggagccttctggggcctgagcaacatggagatcctgcagctggaccacaacaacctgacagagatcaccaagggctggctgtatggcctgctgatgctgcaggagctgcacctgagccagaatgccatcaaccgcatcagcccagatgcctgggagttctgccagaagctgtctgagctggacctgaccttcaaccacctgagccggctggatgacagcagcttcctgggcctgagcctgctgaacaccctgcacatcggcaacaacagagtgtcctacatcgctgactgtgccttccggggcctgagcagcctgaagaccctggacctgaagaacaatgagatctcctggaccatcgaggacatgaatggagccttcagcggcctggacaagctgcggcggctcatcctgcagggcaaccgcatccgcagcatcaccaagaaggccttcaccggcctggatgccctggagcacctggacctgagtgacaatgccatcatgagcctgcagggcaatgccttcagccagatgaagaagctgcagcagctgcacctgaacaccagcagcctgctgtgtgactgccagctgaagtggctgccccagtgggtggccgagaacaacttccagagctttgtgaatgccagctgtgcccacccccagctgctgaagggccgcagcatctttgctgtgtccccagatggctttgtgtgtgatgacttccccaagccccagatcaccgtgcagcctgagacccagagcgccatcaagggcagcaacctgtccttcatctgcagcgctgccagcagcagtgacagccccatgacctttgcctggaagaaggacaatgagctgctgcatgatgctgagatggagaactatgcccacctgcgggcccagggcggggaggtgatggagtacaccaccatcctgcggctgcgggaggtggagtttgccagcgagggcaagtaccagtgtgtgatcagcaaccacttcggcagcagctacagcgtgaaggccaagctgactgtgaacatgctgcccagcttcaccaagacccccatggacctgaccatccgggccggggccatggcccggctggagtgtgccgctgtgggccacccagccccccagatcgcctggcagaaggatggcggcacagacttccctgctgcccgggagaggaggatgcacgtgatgccagaagatgatgtgttcttcatcgtggatgtgaagattgaagatattggagtgtacagctgcacagcccagaacagcgctggcagcatcagcgccaatgccaccctgactgtgctggagacccccagcttcctgcggcccctgctggacagaacagtgaccaagggggagacagctgtgctgcagtgcatcgccggcggcagccccccacccaagctgaactggaccaaggatgacagccccctggtggtgacagagcggcacttctttgctgctggcaaccagctgctgatcatcgtggacagtgatgtgtctgatgctgggaagtacacctgtgagatgagcaacaccctgggcacagaaagaggaaatgtgcggctgagcgtcatccccacccccacctgtgacagcccccagatgacagcccccagcctggatgatgatggctgggccaccgtgggcgtggtgatcatcgctgtggtgtgctgcgtggtgggcaccagcctggtgtgggtggtgatcatctaccacaccaggagaagaaatgaagactgcagcatcaccaacacagatgagaccaacctgcctgctgacatccccagctacctgagcagccagggcaccctggccgaccggcaggacggctacgtgagcagcgagagcggcagccaccaccagtttgtgaccagcagcggggccggcttcttcctgccccagcacgacagcagcggcacctgccacatcgacaacagcagcgaggctgatgtggaggccgccacagacctcttcctgtgccccttcctgggcagcacaggccccatgtacctgaagggaaatgtgtatggcagtgacccctttgagacctaccacacaggctgcagcccagaccccaggacagtgctgatggaccactatgagcccagctacatcaagaagaaggagtgctacccctgcagccaccccagcgaggagagctgtgagaggagcttcagcaacatctcctggcccagccacgtgaggaagctgctgaacaccagctacagccacaatgaaggacctggcatgaagaacctgtgcctgaacaagagcagcctggacttcagcgccaaccctgagcccgcctctgtggccagcagcaacagcttcatgggcaccttcggcaaggccctgcggcggccccacctggatgcctacagcagctttggccagcccagcgactgccagccccgggccttctacctgaaggcccacagcagcccagacctggacagcggctctgaagaagatggcaaggagaggacagacttccaggaggagaaccacatctgcaccttcaagcagaccctggagaactaccgcacccccaacttccagagctatgacctggacacctag

SEQ ID NO: 35090 - DNA, 1038 bp, Artificial Sequence
  Description of Artificial Sequence: Synthetic coding sequence
atgaagggggagctgctgctcttcagcagcgtcatcgtgctgctgcaggtggtgtgcagctgcccagacaagtgctactgccagagcagcaccaactttgtggactgcagccagcagggcctggccgagatccccagccacctgcccccccagaccaggaccctgcacctgcaggacaaccagatccaccacctgcctgcctttgccttccgctctgtgccctggctgatgaccctgaacctgagcaacaacagcctgagcaacctggcccctggggccttccacggcctgcagcacctgcaggtgctgaacctgacccagaacagcctgctgagcctggagagccgcctcttccacagcctgccccagctgcgggagctggacctgagcagcaacaacatcagccacctgcccaccagcctgggggagacctgggagaacctgaccatcctggccgtgcagcagaaccagctgcagcagctggaccgggccctgctggagagcatgcccagcgtgcggctgctgctgctgaaggacaacctgtggaagtgcaactgccacctgctgggcctgaagctgtggctggagaagtttgtgtacaagggcggcctgacagatggcatcatctgtgagagcccagacacctggaagggcaaggacctgctgcgcatcccccatgagctgtaccagccctgccccctgcctgccccagaccctgtgagcagccaggcccagtggccaggcagcgcccatggagtggtgctgcggcccccagagaaccacaatgctggggagcgggagctgctggagtgtgagctgaagcccaagcccaggcctgccaacctgcggcatgccatcgccaccgtcatcatcaccggggtggtgtgtggcatcgtgtgcctgatgatgctggccgccgccatctacggctgcacctacgccgccatcacagcccagtaccatggaggccccctggcccagaccaatgaccccgggaaggtggaggagaaggagagatttgacagcagccctgcctag

SEQ ID NO: 35091 - DNA, 810 bp, Artificial Sequence
  Description of Artificial Sequence: Synthetic coding sequence
atgaccctgaacctgagcaacaacagcctgagcaacctggcccctggggccttccacggcctgcagcacctgcaggtgctgaacctgacccagaacagcctgctgagcctggagagccgcctcttccacagcctgccccagctgcgggagctggacctgagcagcaacaacatcagccacctgcccaccagcctgggggagacctgggagaacctgaccatcctggccgtgcagcagaaccagctgcagcagctggaccgggccctgctggagagcatgcccagcgtgcggctgctgctgctgaaggacaacctgtggaagtgcaactgccacctgctgggcctgaagctgtggctggagaagtttgtgtacaagggcggcctgacagatggcatcatctgtgagagcccagacacctggaagggcaaggacctgctgcgcatcccccatgagctgtaccagccctgccccctgcctgccccagaccctgtgagcagccaggcccagtggccaggcagcgcccatggagtggtgctgcggcccccagagaaccacaatgctggggagcgggagctgctggagtgtgagctgaagcccaagcccaggcctgccaacctgcggcatgccatcgccaccgtcatcatcaccggggtggtgtgtggcatcgtgtgcctgatgatgctggccgccgccatctacggctgcacctacgccgccatcacagcccagtaccatggaggccccctggcccagaccaatgaccccgggaaggtggaggagaaggagagatttgacagcagccctgcctag

SEQ ID NO: 35092 - DNA, 1113 bp, Artificial Sequence
  Description of Artificial Sequence: Synthetic coding sequence
atgctggcccctggcagcagccctggccagaggggccgcctggccctgcagtggaggcaggtgtcctggatcacctgctggatcgccctgtatgctgtggaggccctgcccacctgccccttcagctgcaagtgtgacagccgcagcctggaggtggactgcagcggcctgggcctgaccaccgtgcccccagatgtgcctgctgccaccaggaccctgctgctgctgaacaacaagctgagcgccctgcccagctgggcctttgccaacctgagcagcctgcagaggctggacctgagcaacaacttcctggaccggctgcccaggagcatctttggagacctgaccaacctgacagagctgcagctgaggaacaacagcatccgcaccctggaccgggacctgctgcggcacagccccctgctgcggcacctggacctgagcatcaatggcctggcccagctgcccccaggcctgtttgatggcctgctggccctgcggagcctgagcctgcggagcaaccggctgcagaacctggaccggctgacctttgagcccctggccaacctgcagctgctgcaggtgggggacaacccctgggagtgtgactgcaacctgcgggagttcaagcactggatggagtggttctcctaccggggcggccgcctggaccagctggcctgcaccctgcccaaggagctgcggggcaaggacatgaggatggtgcccatggagatgttcaactactgcagccagctggaggatgagaacagcagcgctggcctggacatccctggccccccctgcaccaaggccagccctgagcccgccaagcccaagccaggagctgagcctgagcctgagcccagcacagcctgcccccagaagcagaggcacaggcctgcctctgtgagaagagccatgggcaccgtcatcatcgccggcgtggtgtgtggggtggtgtgcatcatgatggtggtggccgccgcctacggctgcatctatgccagcctgatggccaagtaccaccgggagctgaagaagaggcagcccctgatgggagaccctgagggggagcacgaggaccagaagcagatcagctctgtggcctag

SEQ ID NO: 35093 - DNA, 408 bp, Artificial Sequence
  Description of Artificial Sequence: Synthetic coding sequence
atgaggatggtgcccatggagatgttcaactactgcagccagctggaggatgagaacagcagcgctggcctggacatccctggccccccctgcaccaaggccagccctgagcccgccaagcccaagccaggggcccagcacagcctgcccacagaagctgaggccccagctggggagcgggaggccagccacggccacggggaccactgccggggccgggtgagaagaaggctgcaccatgatggcggcggccgctgcctgtggctgcacctgcggctgccccacggccaggtgcccccaggggcccagaaggccccagccccagatggcggcccccggggccgggcccggggccctgaggccgacctcttctgtggcctgagcgcccacccccacccagccaggtag

SEQ ID NO: 35094 - DNA, 1113 bp, Artificial Sequence; identical to SEQ ID NO: 35092
  Description of Artificial Sequence: Synthetic coding sequence

SEQ ID NO: 35095 - DNA, 1113 bp, Artificial Sequence; identical to SEQ ID NO: 35092
  Description of Artificial Sequence: Synthetic coding sequence

SEQ ID NO: 35096 - DNA, 1500 bp, Artificial Sequence
  Description of Artificial Sequence: Synthetic coding sequence
atgaccctcatcctgaccagcctgctcttcttcggcctgagcctgggccccaggaccagggtgcaggccgagaacctgcccaagcccatcctgtgggccgagcccggccctgtgatcacctggcacaaccctgtgaccatctggtgccagggcaccctggaggcccagggctaccgcctggacaaggagggcaacagcatgagccgccacatcctgaagaccctggagagcgagaacaaggtgaagctgagcatccccagcatgatgtgggagcacgccggccgctaccactgctactaccagagccctgctggctggagcgagcccagcgaccccctggagctggtggtgacagcctacagccggcccaccctgagcgccctgcccagccctgtggtgaccagcggcgtgaatgtgaccctgcgctgtgccagccggctgggcctgggccgcttcaccctgattgaggagggggaccaccggctgtcctggaccctgaacagccaccagcacaaccacggcaagttccaggccctcttccccatgggccccctgaccttcagcaacagaggcaccttccgctgctacggctatgagaacaacaccccctacgtgtggagcgagcccagcgaccccctgcagctgctggtgtctggagtgtccaggaagcccagcctgctgaccctgcagggccctgtggtgaccccaggagagaacctgaccctgcagtgtggcagtgatgtgggctacatccgctacaccctgtacaaggagggcgcagatggcctgccccagaggcctggccggcagccccaggccggcctgagccaggccaacttcaccctgagccctgtgagccgctcctatggaggccagtaccgctgctacggggcccacaacgtgtcctctgagtggagcgcccccagcgaccccctggacatcctgattgctggccagatcagtgaccggcccagcctgtctgtgcagcccggccccaccgtgaccagcggggagaaggtgaccctgctgtgccagagctgggaccccatgttcaccttcctgctgaccaaggagggcgccgcccacccccccctgcggctgcgctccatgtatggagcccacaagtaccaggccgagttccccatgagccctgtgaccagcgcccacgccggcacctaccgctgctacggcagccgcagcagcaacccctacctgctgagccaccccagcgagcccctggagctggtggtgtctggggccacagagaccctgaacccagcccagaagaagagtgacagcaagacagccccccacctgcaggactacacagtggagaacctgatccgcatgggcgtggccggcctggtgctgctcttcctgggcatcctgctgtttgaggcccagcacagccagaggagccccccacgctgcagccaggaggccaacagcaggaaggacaatgcccccttccgggtggtggagccctgggagcagatctag

SEQ ID NO: 35097 - DNA, 978 bp, Artificial Sequence
  Description of Artificial Sequence: Synthetic coding sequence
atggccaatgccctggccagcgccacctgtgagcgctgcaagggcggctttgccccagctgagaagatcgtgaacagcaatggagagctgtaccacgagcagtgctttgtgtgtgcccagtgcttccagcagtttcctgagggcctcttctatgaatttgagggcaggaagtactgtgaacatgacttccagatgctgtttgccccctgctgccaccagtgtggggagttcatcatcggccgggtcatcaaggccatgaacaacagctggcaccctgagtgcttccgctgtgacctgtgccaggaggtgctggccgacattggatttgtgaagaatgccggccgccacctgtgccggccctgccacaaccgggagaaggcccggggcctgggcaagtacatctgccagaagtgccacgccatcattgatgagcagcccctcatcttcaagaatgacccctaccacccagaccacttcaactgtgccaactgtgggaaggagctgacagcagatgcccgggagctgaagggggagctgtactgcctgccctgccacgacaagatgggcgtgcccatctgtggggcctgcagaagacccatcgagggccgggtggtgaatgccatgggcaagcagtggcacgtggagcactttgtgtgtgccaagtgtgagaagcccttcctgggccaccgccactatgaaaggaagggcctggcctactgtgagacccactacaaccagctgtttggagatgtgtgcttccactgcaacagagtgattgaaggagatgtggtgtctgccctgaacaaggcctggtgtgtgaactgctttgcctgcagcacctgcaacaccaagctgaccctgaagaacaagtttgtggagtttgacatgaagcctgtgtgcaagaagtgctatgagaagttccccctggagctgaagaagaggctgaagaagctggccgagaccctgggcaggaagtag

SEQ ID NO: 35098 - DNA, 978 bp, Artificial Sequence; identical to SEQ ID NO: 35097
  Description of Artificial Sequence: Synthetic coding sequence

SEQ ID NO: 35099 - DNA, 978 bp, Artificial Sequence; identical to SEQ ID NO: 35097
  Description of Artificial Sequence: Synthetic coding sequence

SEQ ID NO: 35100 - DNA, 354 bp, Artificial Sequence
  Description of Artificial Sequence: Synthetic coding sequence
atggccttcagcggccgggcccggccctgcatcatcccagaaaatgaggagatccccagggctgccctgaacacagtgcatgaggccaacggcacagaagatgaaagagctgtgtccaagctgcagaggaggcacagtgatgtgaaggtgtacaaggagttctgtgacttctacgccaagttcaacatggccaatgccctggccagcgccacctgtgagcgctgcaagggcggctttgccccagctgagaagatcgtgaacagcaatggagagctgtaccacgagcagtgctttgtgtgtgcccagtgcttccagcagtttcctgagggcctcttctatgaggagaggacatag

SEQ ID NO: 35101 - DNA, 1089 bp, Artificial Sequence
  Description of Artificial Sequence: Synthetic coding sequence
atgacagccctgcagctgaaggagctgagccacagcggcctgtacagaagaagaagagacagaccagacagcctgcgggtgaatggcctgcctgaggaggagctgagcaacatggccaatgccctggccagcgccacctgtgagcgctgcaagggcggctttgccccagctgagaagatcgtgaacagcaatggagagctgtaccacgagcagtgctttgtgtgtgcccagtgcttccagcagtttcctgagggcctcttctatgaatttgagggcaggaagtactgtgaacatgacttccagatgctgtttgccccctgctgccaccagtgtggggagttcatcatcggccgggtcatcaaggccatgaacaacagctggcaccctgagtgcttccgctgtgacctgtgccaggaggtgctggccgacatcggctttgtgaagaatgccggccgccacctgtgccggccctgccacaaccgggagaaggcccggggcctgggcaagtacatctgccagaagtgccacgccatcattgatgagcagcccctcatcttcaagaatgacccctaccacccagaccacttcaactgtgccaactgtgggaaggagctgacagcagatgcccgggagctgaagggggagctgtactgcctgccctgccacgacaagatgggcgtgcccatctgtggggcctgccggcggcccatcgagggccgggtggtgaatgccatgggcaagcagtggcacgtggagcactttgtgtgtgccaagtgtgagaagcccttcctgggccaccgccactatgaaaggaagggcctggcctactgtgagacccactacaaccagctgtttggagatgtgtgcttccactgcaacagagtcatcgagggagatgtggtgtctgccctgaacaaggcctggtgtgtgaactgctttgcctgcagcacctgcaacaccaagctgaccctgaagaacaagtttgtggagtttgacatgaagcctgtgtgcaagaagtgctatgagaagttccccctggagctgaagaagaggctgaagaagctggccgagaccctgggcaggaagtag

SEQ ID NO: 35102 - DNA, 990 bp, Artificial Sequence
  Description of Artificial Sequence: Synthetic coding sequence
atgacctgcaacatggccaatgccctggccagcgccacctgtgagcgctgcaagggcggctttgccccagctgagaagatcgtgaacagcaatggagagctgtaccacgagcagtgctttgtgtgtgcccagtgcttccagcagtttcctgagggcctcttctatgaatttgagggcaggaagtactgtgaacatgacttccagatgctgtttgccccctgctgccaccagtgtggggagttcatcatcggccgggtcatcaaggccatgaacaacagctggcaccctgagtgcttccgctgtgacctgtgccaggaggtgctggccgacattggatttgtgaagaatgccggccgccacctgtgccggccctgccacaaccgggagaaggcccggggcctgggcaagtacatctgccagaagtgccacgccatcattgatgagcagcccctcatcttcaagaatgacccctaccacccagaccacttcaactgtgccaactgtgggaaggagctgacagcagatgcccgggagctgaagggggagctgtactgcctgccctgccacgacaagatgggcgtgcccatctgtggggcctgcagaagacccatcgagggccgggtggtgaatgccatgggcaagcagtggcacgtggagcactttgtgtgtgccaagtgtgagaagcccttcctgggccaccgccactatgaaaggaagggcctggcctactgtgagacccactacaaccagctgtttggagatgtgtgcttccactgcaacagagtgattgaaggagatgtggtgtctgccctgaacaaggcctggtgtgtgaactgctttgcctgcagcacctgcaacaccaagctgaccctgaagaacaagtttgtggagtttgacatgaagcctgtgtgcaagaagtgctatgagaagttccccctggagctgaagaagaggctgaagaagctggccgagaccctgggcaggaagtag

SEQ ID NO: 35103 - DNA, 1164 bp, Artificial Sequence
  Description of Artificial Sequence: Synthetic coding sequence
atggccttcagcggccgggcccggccctgcatcatcccagaaaatgaggagatccccagggctgccctgaacacagtgcatgaggccaacggcacagaagatgaaagagctgtgtccaagctgcagaggaggcacagtgatgtgaaggtgtacaaggagttctgtgacttctacgccaagttcaacatggccaatgccctggccagcgccacctgtgagcgctgcaagggcggctttgccccagctgagaagatcgtgaacagcaatggagagctgtaccacgagcagtgctttgtgtgtgcccagtgcttccagcagtttcctgagggcctcttctatgaatttgagggcaggaagtactgtgaacatgacttccagatgctgtttgccccctgctgccaccagtgtggggagttcatcatcggccgggtcatcaaggccatgaacaacagctggcaccctgagtgcttccgctgtgacctgtgccaggaggtgctggccgacattggatttgtgaagaatgccggccgccacctgtgccggccctgccacaaccgggagaaggcccggggcctgggcaagtacatctgccagaagtgccacgccatcattgatgagcagcccctcatcttcaagaatgacccctaccacccagaccacttcaactgtgccaactgtgggaaggagctgacagcagatgcccgggagctgaagggggagctgtactgcctgccctgccacgacaagatgggcgtgcccatctgtggggcctgcagaagacccatcgagggccgggtggtgaatgccatgggcaagcagtggcacgtggagcactttgtgtgtgccaagtgtgagaagcccttcctgggccaccgccactatgaaaggaagggcctggcctactgtgagacccactacaaccagctgtttggagatgtgtgcttccactgcaacagagtgattgaaggagatgtggtgtctgccctgaacaaggcctggtgtgtgaactgctttgcctgcagcacctgcaacaccaagctgaccctgaagaacaagtttgtggagtttgacatgaagcctgtgtgcaagaagtgctatgagaagttccccctggagctgaagaagaggctgaagaagctggccgagaccctgggcaggaagtag

SEQ ID NO: 35104 - DNA, 1014 bp, Artificial Sequence
  Description of Artificial Sequence: Synthetic coding sequence
atgctgggcgtggccgccggcatgacccacagcaacatggccaatgccctggccagcgccacctgtgagcgctgcaagggcggctttgccccagctgagaagatcgtgaacagcaatggagagctgtaccacgagcagtgctttgtgtgtgcccagtgcttccagcagtttcctgagggcctcttctatgaatttgagggcaggaagtactgtgaacatgacttccagatgctgtttgccccctgctgccaccagtgtggggagttcatcatcggccgggtcatcaaggccatgaacaacagctggcaccctgagtgcttccgctgtgacctgtgccaggaggtgctggccgacattggatttgtgaagaatgccggccgccacctgtgccggccctgccacaaccgggagaaggcccggggcctgggcaagtacatctgccagaagtgccacgccatcattgatgagcagcccctcatcttcaagaatgacccctaccacccagaccacttcaactgtgccaactgtgggaaggagctgacagcagatgcccgggagctgaagggggagctgtactgcctgccctgccacgacaagatgggcgtgcccatctgtggggcctgcagaagacccatcgagggccgggtggtgaatgccatgggcaagcagtggcacgtggagcactttgtgtgtgccaagtgtgagaagcccttcctgggccaccgccactatgaaaggaagggcctggcctactgtgagacccactacaaccagctgtttggagatgtgtgcttccactgcaacagagtgattgaaggagatgtggtgtctgccctgaacaaggcctggtgtgtgaactgctttgcctgcagcacctgcaacaccaagctgaccctgaagaacaagtttgtggagtttgacatgaagcctgtgtgcaagaagtgctatgagaagttccccctggagctgaagaagaggctgaagaagctggccgagaccctgggcaggaagtag

SEQ ID NO: 35105 - DNA, 1098 bp, Artificial Sequence
  Description of Artificial Sequence: Synthetic coding sequence
atggccgcccggctgggcgccctggccgccagcggcctgtacagaagacggcagcaccggcagagccccccaccagccactggaaacatgtctgatgccctggccaatgctgtgtgccagcgctgccaggcccgcttcagccctgctgagcgcatcgtgaacagcaatggagagctgtaccacgagcactgctttgtgtgtgcccagtgcttccggcccttccctgagggcctcttctatgaatttgagggcaggaagtactgtgaacatgacttccagatgctgtttgccccctgctgcggcagctgtggggagttcatcatcggccgggtcatcaaggccatgaacaacaactggcaccctggctgcttccgctgtgagctgtgtgatgtggagctggccgacctgggctttgtgaagaatgccggccgccacctgtgccggccctgccacaaccgggagaaggccaagggcctgggcaagtacatctgccagcgctgccacctggtgattgatgagcagcccctgatgttcagaagtgatgcctaccacccagaccacttcaactgcacccactgcggcaaggagctgacagctgaggcccgggagctgaagggggagctgtactgcctgccctgccacgacaagatgggcgtgcccatctgtggggcctgccggcggcccatcgagggccgggtggtgaatgccctgggcaagcagtggcacgtggagcactttgtgtgtgccaagtgtgagaagcccttcctgggccaccgccactatgagaagaagggcctggcctactgtgagacccactacaaccagctgtttggagatgtgtgctacaactgcagccacgtgattgaaggagatgtggtgtctgccctgaacaaggcctggtgtgtgtcctgcttcagctgcagcacctgcaacagcaagctgaccctgaagaacaagtttgtggagtttgacatgaagcctgtgtgcaagcgctgctatgagaagttccccctggagctgaagaagaggctgaagaagctgtctgagctgaccagcaggaaggcccagcccaaggccacagacctgaacagcgcctag

SEQ ID NO: 35106 - DNA, 750 bp, Artificial Sequence
  Description of Artificial Sequence: Synthetic coding sequence
atggagagccgccaccctgctgtggccgagatcgcctgcacctgctgggccctgctgcacctggccaaccctgagggccggggccacctgtgccggccctgccacaaccgggagaaggccaagggcctgggcaagtacatctgccagcgctgccacctggtgattgatgagcagcccctgatgttcagaagtgatgcctaccacccagaccacttcaactgcacccactgcggcaaggagctgacagctgaggcccgggagctgaagggggagctgtactgcctgccctgccacgacaagatgggcgtgcccatctgtggggcctgccggcggcccatcgagggccgggtggtgaatgccctgggcaagcagtggcacgtggagcactttgtgtgtgccaagtgtgagaagcccttcctgggccaccgccactatgagaagaagggcctggcctactgtgagacccactacaaccagctgtttggagatgtgtgctacaactgcagccacgtgattgaaggagatgtggtgtctgccctgaacaaggcctggtgtgtgtcctgcttcagctgcagcacctgcaacagcaagctgaccctgaagaacaagtttgtggagtttgacatgaagcctgtgtgcaagcgctgctatgagaagttccccctggagctgaagaagaggctgaagaagctgtctgagctgaccagcaggaaggcccagcccaaggccacagacctgaacagcgcctag

SEQ ID NO: 35107 - DNA, 1026 bp, Artificial Sequence
  Description of Artificial Sequence: Synthetic coding sequence
atgacaggcagcaacatgtctgatgccctggccaatgctgtgtgccagcgctgccaggcccgcttcagccctgctgagcgcatcgtgaacagcaatggagagctgtaccacgagcactgctttgtgtgtgcccagtgcttccggcccttccctgagggcctcttctatgaatttgagggcaggaagtactgtgaacatgacttccagatgctgtttgccccctgctgcggcagctgtggggagttcatcatcggccgggtcatcaaggccatgaacaacaactggcaccctggctgcttccgctgtgagctgtgtgatgtggagctggccgacctgggctttgtgaagaatgccggccgccacctgtgccggccctgccacaaccgggagaaggccaagggcctgggcaagtacatctgccagcgctgccacctggtgattgatgagcagcccctgatgttcagaagtgatgcctaccacccagaccacttcaactgcacccactgcggcaaggagctgacagctgaggcccgggagctgaagggggagctgtactgcctgccctgccacgacaagatgggcgtgcccatctgtggggcctgccggcggcccatcgagggccgggtggtgaatgccctgggcaagcagtggcacgtggagcactttgtgtgtgccaagtgtgagaagcccttcctgggccaccgccactatgagaagaagggcctggcctactgtgagacccactacaaccagctgtttggagatgtgtgctacaactgcagccacgtgattgaaggagatgtggtgtctgccctgaacaaggcctggtgtgtgtcctgcttcagctgcagcacctgcaacagcaagctgaccctgaagaacaagtttgtggagtttgacatgaagcctgtgtgcaagcgctgctatgagaagttccccctggagctgaagaagaggctgaagaagctgtctgagctgaccagcaggaaggcccagcccaaggccacagacctgaacagcgcctag

SEQ ID NO: 35108 - DNA, 570 bp, Artificial Sequence
  Description of Artificial Sequence: Synthetic coding sequence
atgttcagaagtgatgcctaccacccagaccacttcaactgcacccactgcggcaaggagctgacagctgaggcccgggagctgaagggggagctgtactgcctgccctgccacgacaagatgggcgtgcccatctgtggggcctgccggcggcccatcgagggccgggtggtgaatgccctgggcaagcagtggcacgtggagcactttgtgtgtgccaagtgtgagaagcccttcctgggccaccgccactatgagaagaagggcctggcctactgtgagacccactacaaccagctgtttggagatgtgtgctacaactgcagccacgtgattgaaggagatgtggtgtctgccctgaacaaggcctggtgtgtgtcctgcttcagctgcagcacctgcaacagcaagctgaccctgaagaacaagtttgtggagtttgacatgaagcctgtgtgcaagcgctgctatgagaagttccccctggagctgaagaagaggctgaagaagctgtctgagctgaccagcaggaaggcccagcccaaggccacagacctgaacagcgcctag

SEQ ID NO: 35109 - DNA, 570 bp, Artificial Sequence; identical to SEQ ID NO: 35108
  Description of Artificial Sequence: Synthetic coding sequence

SEQ ID NO: 35110 - DNA, 1011 bp, Artificial Sequence
  Description of Artificial Sequence: Synthetic coding sequence
atgtctgatgccctggccaatgctgtgtgccagcgctgccaggcccgcttctccccagctgagagaattgtgaacagcaatggagagctgtaccacgagcactgctttgtgtgtgcccagtgcttccggcccttccctgagggcctcttctatgaatttgagggcaggaagtactgtgaacatgacttccagatgctgtttgccccctgctgcggcagctgtggggagttcatcatcggccgggtcatcaaggccatgaacaacaactggcaccctggctgcttccgctgtgagctgtgtgatgtggagctggccgacctgggctttgtgaagaatgccggccgccacctgtgccggccctgccacaaccgggagaaggccaagggcctgggcaagtacatctgccagcgctgccacctggtgattgatgagcagcccctgatgttcagaagtgatgcctaccacccagaccacttcaactgcacccactgtgggaaggagctgacagctgaggcccgggagctgaagggggagctgtactgcctgccctgccacgacaagatgggcgtgcccatctgtggggcctgcagaagacccatcgagggccgggtggtgaatgccctgggcaagcagtggcacgtggagcactttgtgtgtgccaagtgtgagaagcccttcctgggccaccgccactatgagaagaagggcctggcctactgtgagacccactacaaccagctgtttggagatgtgtgctacaactgcagccacgtgattgaaggagatgtggtgtctgccctgaacaaggcctggtgtgtgtcctgcttcagctgcagcacctgcaacagcaagctgaccctgaagaacaagtttgtggagtttgacatgaagcctgtgtgcaagcgctgctatgagaagttccccctggagctgaagaagaggctgaagaagctgtctgagctgaccagcaggaaggcccagcccaaggccacagacctgaacagcgcctag

SEQ ID NO: 35111 - DNA, 570 bp, Artificial Sequence; identical to SEQ ID NO: 35108
  Description of Artificial Sequence: Synthetic coding sequence

SEQ ID NO: 35112 - DNA, 1011 bp, Artificial Sequence; identical to SEQ ID NO: 35110
  Description of Artificial Sequence: Synthetic coding sequence

SEQ ID NO: 35113 - DNA, 1011 bp, Artificial Sequence; identical to SEQ ID NO: 35110
  Description of Artificial Sequence: Synthetic coding sequence

SEQ ID NO: 35114 - DNA, 570 bp, Artificial Sequence; identical to SEQ ID NO: 35108
  Description of Artificial Sequence: Synthetic coding sequence

SEQ ID NO: 35115 - DNA, 1011 bp, Artificial Sequence; identical to SEQ ID NO: 35110
  Description of Artificial Sequence: Synthetic coding sequence

SEQ ID NO: 35116 - DNA, 441 bp, Artificial Sequence
  Description of Artificial Sequence: Synthetic coding sequence
atgtctgatgccctggccaatgctgtgtgccagcgctgccaggcccgcttctccccagctgagagaattgtgaacagcaatggagagctgtaccacgagcactgctttgtgtgtgcccagtgcttccggcccttccctgagggcctcttctatgaatttgagggcaggaagtactgtgaacatgacttccagatgctgtttgccccctgctgcggcagctgtggggagttcatcatcggccgggtcatcaaggccatgaacaacaactggcaccctggctgcttccgctgtgagctgtgtgatgtggagctggccgacctgggctttgtgaagaatgccggccgccacctgtgccggccctgccacaaccgggagaaggccaagggcctgggcaagtacatctgccagcgctgccacctggtgattgatgagcagccctag

SEQ ID NO: 35117 - DNA, 570 bp, Artificial Sequence; identical to SEQ ID NO: 35108
  Description of Artificial Sequence: Synthetic coding sequence

SEQ ID NO: 35118 - DNA, 1092 bp, Artificial Sequence
  Description of Artificial Sequence: Synthetic coding sequence
atgacaggcaggaagaggaagtggggcgagactggaactggaagtggagctgccccagctgctgccctgcgctggagcaacatgtctgatgccctggccaatgctgtgtgccagcgctgccaggcccgcttcagccctgctgagcgcatcgtgaacagcaatggagagctgtaccacgagcactgctttgtgtgtgcccagtgcttccggcccttccctgagggcctcttctatgaatttgagggcaggaagtactgtgaacatgacttccagatgctgtttgccccctgctgcggcagctgtggggagttcatcatcggccgggtcatcaaggccatgaacaacaactggcaccctggctgcttccgctgtgagctgtgtgatgtggagctggccgacctgggctttgtgaagaatgccggccgccacctgtgccggccctgccacaaccgggagaaggccaagggcctgggcaagtacatctgccagcgctgccacctggtgattgatgagcagcccctgatgttcagaagtgatgcctaccacccagaccacttcaactgcacccactgcggcaaggagctgacagctgaggcccgggagctgaagggggagctgtactgcctgccctgccacgacaagatgggcgtgcccatctgtggggcctgccggcggcccatcgagggccgggtggtgaatgccctgggcaagcagtggcacgtggagcactttgtgtgtgccaagtgtgagaagcccttcctgggccaccgccactatgagaagaagggcctggcctactgtgagacccactacaaccagctgtttggagatgtgtgctacaactgcagccacgtgattgaaggagatgtggtgtctgccctgaacaaggcctggtgtgtgtcctgcttcagctgcagcacctgcaacagcaagctgaccctgaagaacaagtttgtggagtttgacatgaagcctgtgtgcaagcgctgctatgagaagttccccctggagctgaagaagaggctgaagaagctgtctgagctgaccagcaggaaggcccagcccaaggccacagacctgaacagcgcctag

SEQ ID NO: 35119 - DNA, 1092 bp, Artificial Sequence; identical to SEQ ID NO: 35118
  Description of Artificial Sequence: Synthetic coding sequence

SEQ ID NO: 35120 - DNA, 702 bp, Artificial Sequence
  Description of Artificial Sequence: Synthetic coding sequence
atgctgaagcccagcgtgaccagcgcccccacagctgacatggccaccctgactgtggtgcagcccctgaccctggacagagatgtggcccgggccatcgagctgctggagaagctgcaggagagcggggaggtgcctgtgcacaagctgcagagcctgaagaaggtgctgcagagcgagttctgcacagccatccgggaggtgtaccagtacatgcatgagaccatcaccgtgaatggctgcccagagttccgggcccgggccacagccaaggccaccgtggccgcctttgctgccagcgagggccacagccacccccgggtggtggagctgcccaagacagatgagggcctgggcttcaacgtgatgggcggcaaggagcagaacagccccatctacatcagccgcatcatccctggaggagtggccgagcggcacggcggcctgaagagaggagaccagctgctgtctgtgaatggagtgtctgtggagggggagcaccacgagaaggctgtggagctgctgaaggccgccaaggacagcgtgaagctggtggtgcgctacacccccaaggtgctggaggagatggaggccaggtttgagaagctgaggacagcccggcggcggcagcagcagcagctgctgatccagcagcagcagcagcagcagcagcagcagacccagcagaaccacatgtcctag

SEQ ID NO: 35121 - DNA, 858 bp, Artificial Sequence
  Description of Artificial Sequence: Synthetic coding sequence
atgaaggtgacagtgggccctgaccccagcctggtgtacagaccagatgtggaccctgaggtggccaaggacaaggccagcttcaggaactacaccagcggccccctgctggacagagtcttcaccacctacaagctgatgcacacccaccagacagtggactttgtgcgcagcaagcacgcccagtttggaggcttctcctacaagaagatgacagtgatggaggccgtggacctgctggatggcctggtggatgaaagtgaccctgatgtggacttccccaacagcttccacgccttccagacagctgagggcatcaggaaggcccacccagacaaggactggttccacctggtgggcctgctgcatgacctgggcaaggtgctggccctgtttggagagccccagtgggccgtggtgggggacaccttccctgtgggctgccggccccaggcctctgtggtgttctgtgacagcaccttccaggacaacccagacctgcaggacccccgctacagcacagagctgggcatgtaccagccccactgcggcctggacagagtgctgatgtcctggggccatgatgagtacatgtaccaggtgatgaagttcaacaagttcagcctgcccccagaggccttctacatgatccgcttccacagcttctacccctggcacacaggccgggactaccagcagctgtgcagccagcaggacctggccatgctgccctgggtgcgggagttcaacaagtttgacctgtacaccaagtgcccagacctgcctgatgtggacaagctgcggccctactaccagggcctgattgacaagtactgccccggcatcctgtcctggtag

SEQ ID NO: 35122 - DNA, 1785 bp, Artificial Sequence
  Description of Artificial Sequence: Synthetic coding sequence
atggccggcagccggctgccccggcagctgttcctgcagggcgtggccgctgtgttcatgtttgcctttgccagcctgtacacccagatccctggcctgtatggccctgagggcatcctgcctgcccggaggaccctgcggccccagggcaagggccgctggcagcagctgtgggagacccccaccctgctgtgggaggccccccggctgggcctggacacagcccagggcctggagctgctgagcctgctgggcgccctggtggccctgggcgccctgctgctgagccccctgcggcaccctgtgatctacctgctgctgtgggccgcctacctgagcgcctgccaggtgggccaggtgttcctgtacttccagtgggacagcctgctgctggagaccggcttcctggccgtgctggtggcccccctgcggcctgccagccacaggaaggaggccccccagggccggcaggccggggccctgccccatgaggacctgcccttctggctggtgcgctggctgctcttccggctgatgtttgccagcggcgtggtgaagctgaccagccgctgcccagcctggtggggcctgacagccctgacctaccactatgagacccagtgcctgcccaccccagctgcctggtttgcccaccacctgcctgtgtggctgcacaagctgtctgtggtggccaccttcctgattgaaattgctgtgcccccactcttctttgcccccatccggcggctgcggctggccgccttctacagccaggtgctgctgcaggtgctgatcatcatcaccggcaactacaacttcttcaacctgatgaccctggtgctgaccacagccctgctggatgaccagcacctggccgctgagcccggccacggcagcaggaagaagacagccacctcctggcccaaggccctgctggccaccctgagcctgctgctggagctggccgtgtatggcctgctggcctatggaacagtgcactacttcggcctggaggtggactggcagcagaggaccatccacagcaggaccaccttcaccttccaccagttcagccagtggctgaagaccctgaccctgcccaccgtgtggctgggcgtggccagcctggtgtgggagctgctgagcgccctgtggcgctggacccaggtgcgggactggcagatgtggtttgctgccctgggcccccacacccacagcccctggttcaccagcctggtgctgcggctgctgcagggcaaggagcccgtcatccggctggtgcagagccaggtggcccgctaccccttccacaagcagccccccacctacgtgcgggcccagcgctacaagtactggttcagccagcccggggagcagggccagtggtggaggcggcagtgggtggaggagttcttccccagcgtgtccctgggggaccccaccctggagaccctgctgcggcagtttggcctgcaggagaagagcccccccaggaccaggtctgccaacagcaccctggcccaggccctgcactggaccaggagccagctgagccccctggaggccccagccctgctgtggggcctgctgatggctgtgggcgctgtgcgctttgtgcaggccctgctggccccctgcagcctgcggagcagccccctggcccctgtgtctggagagaagagaagacctgccagccagaaggacagcggggccgccagcgagcaggccacagctgcccccaacccctgcagcagcagcagcaggaccaccaggaggaagaagtag

SEQ ID NO: 35123 - DNA, 2124 bp, Artificial Sequence
  Description of Artificial Sequence: Synthetic coding sequence
atggccggcagccggctgccccggcagctgttcctgcagggcgtggccgctgtgttcatgtttgcctttgccagcctgtacacccagatccctggcctgtatggccctgagggcatcctgcctgcccggaggaccctgcggccccagggcaagggccgctggcagcagctgtgggagacccccaccctgctgtgggaggccccccggctgggcctggacacagcccagggcctggagctgctgagcctgctgggcgccctggtggccctgggcgccctgctgctgagccccctgcggcaccctgtgatctacctgctgctgtgggccgcctacctgagcgcctgccaggtgggccaggtgttcctgtacttccagtgggacagcctgctgctggagaccggcttcctggccgtgctggtggcccccctgcggcctgccagccacaggaaggaggccccccagggccggcaggccggggccctgccccatgaggacctgcccttctggctggtgcgctggctgctcttccggctgatgtttgccagcggcgtggtgaagctgaccagccgctgcccagcctggtggggcctgacagccctgacctaccactatgagacccagtgcctgcccaccccagctgcctggtttgcccaccacctgcctgtgtggctgcacaagctgtctgtggtggccaccttcctgattgaaattgctgtgcccccactcttctttgcccccatccggcggctgcggctggccgccttctacagccaggtgctgctgcaggtgctgatcatcatcaccggcaactacaacttcttcaacctgatgaccctggtgctgaccacagccctgctggatgaccagcacctggccgctgagcccggccacggcagcaggaagaagacagccacctcctggcccaaggccctgctggccaccctgagcctgctgctggagctggccgtgtatggcctgctggcctatggaacagtgcactacttcggcctggaggtggactggcagcagaggaccatccacagcaggaccaccttcaccttccaccagttcagccagtggctgaagaccctgaccctgcccaccgtgtggctgggcgtggccagcctggtgtgggagctgctgagcgccctgtggcgctggacccaggtgcggggctggctgaggaagctgtctgctgtggtgcagctgagcctggtgggcacagccaccgtggccctcttcctgatcagcctggtgccctacagctatgtggagcccggcacccacggccgcctgtggacaggagcccaccggctgtttggagctgtggagcacctgcagctggccaacagctatggcctcttccggaggatgacaggcctgggcggccggcctgaggtggtgctggagggcagctatgatggccaccactggacagaaattgagttcatgtacaagccaggcaacctgagcaggcctcctcctgtggtggtgccccaccagccccggctggactggcagatgtggtttgctgccctgggcccccacacccacagcccctggttcaccagcctggtgctgcggctgctgcagggcaaggagcctgtgatccggctggtgcagagccaggtggcccgctaccccttccacaagcagccccccacctacgtgcgggcccagcgctacaagtactggttcagccagcctggagagcagggccagtggtggaggcggcagtgggtggaggagttcttccccagcgtgtccctgggggaccccaccctggagaccctgctgcggcagtttggcctgcaggagaagagcccccccaggaccaggtctgccaacagcaccctggcccaggccctgcactggaccaggagccagctgagccccctggaggccccagccctgctgtggggcctgctgatggctgtgggcgctgtgcgctttgtgcaggccctgctggccccctgcagcctgcggagcagccccctggcccctgtgtctggagagaagaggaggcctgccagccagaaggacagcggggccgccagcgagcaggccacagctgcccccaacccctgcagcagcagcagcaggaccaccaggaggaagaagtag

SEQ ID NO: 35124 - DNA, 978 bp, Artificial Sequence
  Description of Artificial Sequence: Synthetic coding sequence
atggctgtgggcaacaacacccagaggagctacagcatcatcccctgcttcatctttgtggagctggtgatcatggccggcaccgtgctgctggcctactactttgagtgcacagacaccttccaggtgcacatccagggcttcttctgccaggatggagacctgatgaagccctacccaggcacagaggaggagagcttcatcacccccctggtgctgtactgtgtgctggccgccacccccacagccatcatcttcatcggggagatctccatgtacttcatcaagagcacccgggagagcctgattgcccaggagaagaccatcctgactggagagtgctgctacctgaaccccctgctgcggcgcatcatccgcttcaccggggtgtttgccttcggcctgtttgccacagacatctttgtgaatgccggccaggtggtgacaggccacctgaccccctacttcctgactgtgtgcaagcccaactacaccagcgctgactgccaggcccaccaccagttcatcaacaacggcaacatctgcacaggagacctggaggtgattgagaaggcccggcgctccttccccagcaagcatgctgccctgagcatctacagcgccctgtatgccaccatgtacatcaccagcaccatcaagaccaagagcagccggctggccaagcctgtgctgtgcctgggcaccctgtgcacagccttcctgaccggcctgaacagagtgtctgagtacagaaaccactgcagtgatgtgattgctggcttcatcctgggcacagctgtggccctcttcctgggcatgtgtgtggtgcacaacttcaagggcacccagggcagccccagcaagcccaagccagaggacccccggggcgtgcccctgatggccttccccagaattgagagccccctggagaccctgagcgcccagaaccacagcgcctccatgacagaggtgacctag

SEQ ID NO: 35125 - DNA, 978 bp, Artificial Sequence; identical to SEQ ID NO: 35124
  Description of Artificial Sequence: Synthetic coding sequence

SEQ ID NO: 35126 - DNA, 978 bp, Artificial Sequence; identical to SEQ ID NO: 35124
  Description of Artificial Sequence: Synthetic coding sequence

SEQ ID NO: 35127 - DNA, 312 bp, Artificial Sequence
  Description of Artificial Sequence: Synthetic coding sequence
atggctgtgggcaacaacacccagaggagctacagcatcatcccctgcttcatctttgtggagctggtgatcatggccggcaccgtgctgctggcctactactttgagtgcacagacaccttccaggtgcacatccagggcttcttctgccaggatggagacctgatgaagccctacccaggcacagaggaggagagcttcatcacccccctggtgctgtactgtgtgctggccgccacccccacagccatcatcttcatcggggagatctccatgtacttcatcaagagcacccgggagagcctcatctag

SEQ ID NO: 35128 - DNA, 1032 bp, Artificial Sequence
  Description of Artificial Sequence: Synthetic coding sequence
atggccggcggccggccccacctgaagaggagcttcagcatcatcccctgctttgtgtttgtggagagcgtgctgctgggcatcgtcatcctgctggcctaccgcctggagttcacagacaccttccctgtgcacacccagggcttcttctgctatgacagcacctacgccaagccctacccaggccctgaggccgccagccgggtgcccccagccctggtgtatgccctggtgacagctggccccaccctgaccatcctgctgggggagctggcccgggccttcttccctgcccctccttctgctgtgcctgtgattggagagagcaccatcgtgtctggggcctgctgccgcttcagcccccctgtgcggcggctggtgcgcttcctgggcgtgtacagctttggcctcttcaccaccaccatctttgccaatgccggccaggtggtgactggaaaccccaccccccacttcctgtctgtgtgccggcccaactacacagccctgggctgcctgccccccagcccagacaggcctggccctgacagatttgtgacagaccagggcgcctgtgccggcagccccagcctggtggccgccgcccggcgggccttcccctgcaaggatgctgccctgtgtgcctatgctgtgacctacacagccatgtatgtgaccctggtgttccgggtgaagggcagccggctggtgaagcccagcctgtgcctggccctgctgtgcccagccttcctggtgggcgtggtgcgggtggccgagtacagaaaccactggagcgatgtgctggccggcttcctgaccggggccgccatcgccaccttcctggtgacctgtgtggtgcacaacttccagagccggccccccagcggccggcggctgagcccctgggaggacctgggccaggcccccaccatggacagccccctggagaagaaccccaggtctgctggccgcatccgccaccgccacggcagcccccaccccagcagaagaacagccccagctgtggccacctag

SEQ ID NO: 35129 - DNA, 1284 bp, Artificial Sequence
  Description of Artificial Sequence: Synthetic coding sequence
atggccggcggccggccccacctgaagaggagcttcagcatcatcccctgctttgtgtttgtggagggcttcttctgctatgacagcacctacgccaagccctacccaggccctgaggccgccagccgggtgcccccagccctggtgtatgccctggtgacagctggccccaccctgaccatcctgctgggggagctggcccgggccttcttccctgccccacccagcgctgtgcctgtgattggagagagcaccatcgtgtctggggcctgctgccgcttcagcccccctgtgcggcggctggtgcgcttcctgggcgtgtacagctttggcctcttcaccaccaccatctttgccaatgccggccaggtggtgacaggcaaccccaccccccacttcctgtctgtgtgccggcccaactacacagccctgggctgcctgccccccagcccagaccggcccggccctgacagatttgtgacagaccagggcgcctgtgccggcagccccagcctggtggccgccgcccggcgggccttcccctgcaaggatgctgccctgtgtgcctatgctgtgacctacacagccatgtatgtgaccctggtgttccgggtgaagggcagccggctggtgaagcccagcctgtgcctggccctgctgtgcccagccttcctggtgggcgtggtgcgggtggccgagtacagaaaccactggagcgatgtgctggccggcttcctgactggagctgccatcgccaccttcctggtgacctgtgtggtgcacaacttccagagcaggcctccttctggaagaaggctgagcccctgggaggacctgggccaggcccccaccatggacagccccctggagaagctgtctgtggcccaggagcctgaggtgtgccggccccacagcaccccagcccggctgacccccagcaagagccagaactgtgcccggcggggccacctgatccccagctgtgtgagcagccgggccccagccatgtgcagcagcccccgggtgccccggccccggctgcggtctgagcccacccccctgcccctgcccctgcccctgcctgcccccacccccagccagggccccagccccagcagccctggccctgggggccctgggggcggcggcggccggggcaggaagctgctgctgcccacccccctgctgcgggacctgtacaccctgagcggcctgtaccccagccccttccaccgggacaacttcagcccctacctgtttgccagccgggaccacctgctgtag

SEQ ID NO: 35130 - DNA, 2160 bp, Artificial Sequence
  Description of Artificial Sequence: Synthetic coding sequence
atgatcagcaccaaggagaagaacaagatccccaaggacagcatgaccctgctgccctgcttctactttgtggagctgcccatcgtggccagcagcatcgtgtccctgtacttcctggagctgacagacctcttcaagccagccaaggtgggcttccagtgctatgacaggaccctgtccatgccctacgtggagaccaatgaggagctgatccccctgctgatgctgctgagcctggcctttgctgccccagctgccagcatcatggtggccgagggcatgctgtactgcctgcagagccggctgtggggccgggccggcggccctgctggagctgagggcagcatcaatgctgggggctgcaacttcaacagcttcctgcggaggacagtgcgctttgtggccggcgtgcacgtgtttggcctgtgtgccacagccctggtgacagatgtgatccagctggccaccggctaccacacccccttcttcctgactgtgtgcaagcccaactacaccctgctgggcaccagctgtgaggtgaacccctacatcacccaggacatctgcagcggccatgacatccacgccatcctgagcgccaggaagaccttccccagccagcacgccaccctgagcgcctttgctgctgtgtatgtgtccatgtacttcaacagcgtcatcagtgacaccaccaagctgctgaagcccatcctggtgtttgcctttgccatcgccgccggcgtgtgtggcctgacccagatcacccagtaccgcagccaccctgtggatgtgtatgccggcttcctgattggagctggcattgctgcctacctggcctgccacgctgtgggcaacttccaggcccctcctgctgagaagccagctgccccagccccagccaaggatgccctgcgggccctgacccagaggggccatgacagcgtgtaccagcagaacaagtctgtgtccacagatgagctgggccccccaggccgcctggagggcgcccccaggcctgtggcccgggagaagaccagcctgggcagcctgaagagggcctctgtggatgtggacctgctggcccccaggagccccatggccaaggagaacatggtgaccttcagccacaccctgccccgggccagcgcccccagcctggatgatcctgcccggcggcacatgaccatccacgtgcccctggatgccagccgcagcaagcagctgatcagcgagtggaagcagaagagcctggagggccggggcctgggcctgcctgatgatgccagccctggccacctgcgggccccagctgagcccatggccgaggaggaggaggaggaggaggatgaggaggaggaggaggaggaggaggaggaggaggatgagggccctgccccacccagcctgtaccccaccgtgcaggcccggcccggcctgggccccagggtcatcctgccccccagggctggccccccacccctggtgcacatccctgaggagggcgcccagacaggagctggcctgagccccaagagcggggccggcgtgcgggccaagtggctgatgatggccgagaagtctggagctgctgtggccaaccccccccggctgctgcaggtgattgccatgagcaaggcccctggggcccctggccccaaggctgctgagacagccagcagcagcagcgccagcagtgacagcagccagtaccgcagccccagcgaccgggacagcgccagcatcgtgaccattgatgcccacgccccccaccaccctgtggtgcacctgtctgctgggggcgccccctgggagtggaaggccgccggcggcggggccaaggccgaggctgatggcggctatgagctgggggacctggcccggggcttccggggcggggccaagcccccaggagtgtccccaggcagctctgtgtctgatgtggaccaggaggagcccaggtttggagctgtggccaccgtgaacctggccaccggggagggcctgccccccctgggcgctgctgatggagccctgggccctggcagccgggagagcaccctgcggagacatgctgggggcctgggcctggccgagcgggaggccgaggccgaggccgagggctacttcaggaagatgcaggcccggcgcttcccagactag

SEQ ID NO: 35131 - DNA, 2241 bp, Artificial Sequence
  Description of Artificial Sequence: Synthetic coding sequence
atgatcagcaccaaggagaagaacaagatccccaaggacagcatgaccctgctgccctgcttctactttgtggagctgcccatcgtggccagcagcatcgtgtccctgtacttcctggagctgacagacctcttcaagccagccaaggtgggcttccagtgctatgacaggaccctgtccatgccctacgtggagaccaatgaggagctgatccccctgctgatgctgctgagcctggcctttgctgccccagctgccagcatcatggtggccgagggcatgctgtactgcctgcagagccggctgtggggccgggccggcggccctgctggagctgagggcagcatcaatgctgggggctgcaacttcaacagcttcctgcggaggacagtgcgctttgtgggcgtgcacgtgtttggcctgtgtgccacagccctggtgacagatgtgatccagctggccaccggctaccacacccccttcttcctgactgtgtgcaagcccaactacaccctgctgggcaccagctgtgaggtgaacccctacatcacccaggacatctgcagcggccatgacatccacgccatcctgagcgccaggaagaccttccccagccagcacgccaccctgagcgcctttgctgctgtgtatgtgtctgtgtccccagccccccactgccccagccaggccctgctgctgaccagaggagagcccagcctgacccccacccccatgccccagatgtacttcaacagcgtcatcagtgacaccaccaagctgctgaagcccatcctggtgtttgcctttgccatcgctgctggggtgtgtggcctgacccagatcacccagtaccgcagccaccctgtggatgtgtatgccggcttcctgattggagctggcattgctgcctacctggcctgccacgctgtgggcaacttccaggcccccccagctgagaagccagctgccccagccccagccaaggatgccctgcgggccctgacccagaggggccatgattctgtgtaccagcagaacaagtctgtgtccacagatgagctgggccccccaggccgcctggagggcgcccccaggcctgtggcccgggagaagaccagcctgggcagcctgaagagggcctctgtggatgtggacctgctggcccccaggagccccatggccaaggagaacatggtgaccttcagccacaccctgccccgggccagcgcccccagcctggatgatcctgcccggcggcacatgaccatccacgtgcccctggatgccagccgcagcaagcagctgatcagcgagtggaagcagaagagcctggagggccggggcctgggcctgcctgatgatgccagccctggccacctgcgggccccagctgagcccatggccgaggaggaggaggaggaggaggatgaggaggaggaggaggaggaggaggaggaggaggatgagggccctgccccacccagcctgtaccccaccgtgcaggcccggcccggcctgggccccagggtcatcctgcccccccgggccggccccccacccctggtgcacatccctgaggagggcgcccagacaggagctggcctgagccccaagtctggagctggggtgcgggccaagtggctgatgatggccgagaagagcggggctgctgtggccaaccccccccggctgctgcaggtgattgccatgagcaaggcccctggggcccctggccccaaggctgctgagacagccagcagcagcagcgccagcagtgacagcagccagtaccgcagccccagcgaccgggacagcgccagcatcgtgaccattgatgcccacgccccccaccaccctgtggtgcacctgtctgctggaggagccccctgggagtggaaggctgctgggggcggggccaaggccgaggctgatggcggctatgagctgggggacctggcccggggcttccggggcggggccaagcccccaggagtgtccccaggcagctctgtgtctgatgtggaccaggaggagcccaggtttggagctgtggccaccgtgaacctggccactggagagggcctgccccccctgggcgctgctgatggagccctgggccctggcagccgggagagcaccctgcggagacatgctgggggcctgggcctggccgagcgggaggccgaggccgaggccgagggctacttcaggaagatgcaggcccggcgcttcccagactag

SEQ ID NO: 35132 - DNA, 2157 bp, Artificial Sequence
  Description of Artificial Sequence: Synthetic coding sequence
atgatcagcaccaaggagaagaacaagatccccaaggacagcatgaccctgctgccctgcttctactttgtggagctgcccatcgtggccagcagcatcgtgtccctgtacttcctggagctgacagacctcttcaagccagccaaggtgggcttccagtgctatgacaggaccctgtccatgccctacgtggagaccaatgaggagctgatccccctgctgatgctgctgagcctggcctttgctgccccagctgccagcatcatggtggccgagggcatgctgtactgcctgcagagccggctgtggggccgggccggcggccctgctggagctgagggcagcatcaatgctgggggctgcaacttcaacagcttcctgcggaggacagtgcgctttgtgggcgtgcacgtgtttggcctgtgtgccacagccctggtgacagatgtgatccagctggccaccggctaccacacccccttcttcctgactgtgtgcaagcccaactacaccctgctgggcaccagctgtgaggtgaacccctacatcacccaggacatctgcagcggccatgacatccacgccatcctgagcgccaggaagaccttccccagccagcacgccaccctgagcgcctttgctgctgtgtatgtgtccatgtacttcaacagcgtcatcagtgacaccaccaagctgctgaagcccatcctggtgtttgcctttgccatcgctgctggggtgtgtggcctgacccagatcacccagtaccgcagccaccctgtggatgtgtatgccggcttcctgattggagctggcattgctgcctacctggcctgccacgctgtgggcaacttccaggcccccccagctgagaagccagctgccccagccccagccaaggatgccctgcgggccctgacccagaggggccatgattctgtgtaccagcagaacaagtctgtgtccacagatgagctgggccccccaggccgcctggagggcgcccccaggcctgtggcccgggagaagaccagcctgggcagcctgaagagggcctctgtggatgtggacctgctggcccccaggagccccatggccaaggagaacatggtgaccttcagccacaccctgccccgggccagcgcccccagcctggatgatcctgcccggcggcacatgaccatccacgtgcccctggatgccagccgcagcaagcagctgatcagcgagtggaagcagaagagcctggagggccggggcctgggcctgcctgatgatgccagccctggccacctgcgggccccagctgagcccatggccgaggaggaggaggaggaggaggatgaggaggaggaggaggaggaggaggaggaggaggatgagggccctgccccacccagcctgtaccccaccgtgcaggcccggcccggcctgggccccagggtcatcctgcccccccgggccggccccccacccctggtgcacatccctgaggagggcgcccagacaggagctggcctgagccccaagtctggagctggggtgcgggccaagtggctgatgatggccgagaagagcggggctgctgtggccaaccccccccggctgctgcaggtgattgccatgagcaaggcccctggggcccctggccccaaggctgctgagacagccagcagcagcagcgccagcagtgacagcagccagtaccgcagccccagcgaccgggacagcgccagcatcgtgaccattgatgcccacgccccccaccaccctgtggtgcacctgtctgctggaggagccccctgggagtggaaggctgctgggggcggggccaaggccgaggctgatggcggctatgagctgggggacctggcccggggcttccggggcggggccaagcccccaggagtgtccccaggcagctctgtgtctgatgtggaccaggaggagcccaggtttggagctgtggccaccgtgaacctggccactggagagggcctgccccccctgggcgctgctgatggagccctgggccctggcagccgggagagcaccctgcggagacatgctgggggcctgggcctggccgagcgggaggccgaggccgaggccgagggctacttcaggaagatgcaggcccggcgcttcccagactag

SEQ ID NO: 35133 - DNA, 1734 bp, Artificial Sequence
  Description of Artificial Sequence: Synthetic coding sequence
atgcagagagctggcagcagcggcggccgcggggagtgtgacatcagcggggccggccgcctgggcctggaggaggccgcccggctgagctgtgctgtgcacaccagccctgggggcggcagaagacctggccaggccgccggcatgtctgccaaggagcggcccaagggcaaggtgatcaaggacagcgtgaccctgctgccctgcttctactttgtggagctgcccatcctggccagctctgtggtgtccctgtacttcctggagctgacagatgtgttcaagcctgtgcacagcggcttcagctgctatgacaggagcctgtccatgccctacatcgagcccacccaggaggccatccccttcctgatgctgctgagcctggcctttgctggccctgccatcaccatcatggtgggggagggcatcctgtactgctgcctgagcaagagaagaaatggagtgggcctggagcccaacatcaatgccggcggctgcaacttcaacagcttcctgcggcgggctgtgcgctttgtgggcgtgcacgtgtttggcctgtgcagcacagccctgatcacagacatcatccagctgagcacaggctaccaggccccctacttcctgactgtgtgcaagcccaactacaccagcctgaatgtgtcctgcaaggagaacagctacatcgtggaggacatctgcagcggcagtgacctgaccgtcatcaacagcggcaggaagagcttccccagccagcacgccaccctggccgcctttgctgctgtgtatgtgtccatgtacttcaacagcaccctgacagacagcagcaagctgctgaagcccctgctggtgttcaccttcatcatctgtggcatcatctgtggcctgacccgcatcacccagtacaagaaccaccctgtggatgtgtactgcggcttcctgattggaggcggcatcgccctgtacctgggcctgtatgctgtgggcaacttcctgcccagtgatgagagcatgttccagcacagagatgccctgcggagcctgacagacctgaaccaggaccccaaccggctgctgagcgccaagaatggcagcagcagtgatggcatcgcccacacagagggcatcctgaacagaaaccacagagatgccagcagcctgaccaacctgaagagggccaatgctgatgtggagatcatcacccccaggagccccatgggcaaggagaacatggtgaccttcagcaacaccctgccccgggccaacacccccagcgtggaggaccctgtgagaagaaatgccagcatccacgcctccatggattctgcccggagcaagcagctgctgacccagtggaagaacaagaatgaaagcaggaagctgagcctgcaggtgattgagcctgagcccggccagagccccccaagaagcattgagatgaggagcagcagcgagcccagccgggtgggcgtgaatggagaccaccacggccctggcaaccagtacctgaagatccagcccggggctgtgcccggctgcaacaacagcatgcctgggggcccccgggtgtccatccagagccggcccggcagcagccagctggtgcacatccctgaggagacccaggagaacatcagcaccagccccaagagcagccgggtgagcagcaaggccgcccccaggaccctgaaggccgcccggagccctgccctggcccccagcgccatcaagccctag

SEQ ID NO: 35134 - DNA, 1818 bp, Artificial Sequence
  Description of Artificial Sequence: Synthetic coding sequence
atgaacatgtttgatgctgacaccaccaccaacctggtgaccatctccttcatcctgcccatcggcgtgcacgtgtttggcctgtgcagcacagccctgatcacagacatcatccagctgagcacaggctaccaggccccctacttcctgactgtgtgcaagcccaactacaccagcctgaatgtgtcctgcaaggagaacagctacatcgtggaggacatctgcagcggcagtgacctgaccgtcatcaacagcggcaggaagagcttccccagccagcacgccaccctggccgcctttgctgctgtgtatgtgtccatgtacttcaacagcaccctgacagacagcagcaagctgctgaagcccctgctggtgttcaccttcatcatctgtggcatcatctgtggcctgacccgcatcacccagtacaagaaccaccctgtggatgtgtactgcggcttcctgattggaggcggcatcgccctgtacctgggcctgtatgctgtgggcaacttcctgcccagtgatgagagcatgttccagcacagagatgccctgcggagcctgacagacctgaaccaggaccccaaccggctgctgagcgccaagaatggcagcagcagtgatggcatcgcccacacagagggcatcctgaacagaaaccacagagatgccagcagcctgaccaacctgaagagggccaatgctgatgtggagatcatcacccccaggagccccatgggcaaggagaacatggtgaccttcagcaacaccctgccccgggccaacacccccagcgtggaggaccctgtgagaagaaatgccagcatccacgcctccatggattctgcccggagcaagcagctgctgacccagtggaagaacaagaatgaaagcaggaagctgagcctgcaggtgattgagcctgagcccggccagagccccccaagaagcattgagatgaggagcagcagcgagcccagccgggtgggcgtgaatggagaccaccacggccctggcaaccagtacctgaagatccagcccggggctgtgcccggctgcaacaacagcatgcctgggggcccccgggtgtccatccagagccggcccggcagcagccagctggtgcacatccctgaggagacccaggagaacatcagcaccagccccaagagcagcagcgcccgggccaagtggctgaaggctgctgagaagacagtggcctgcaacagaagcaacagccagccccgcatcatgcaggtgattgccatgagcaagcagcagggcgtgctgcagagcagccccaagaacacagagggcagcacagtgtcctgcaccggcagcatccgctacaagaccctgacagaccacgagcccagcggcatcgtgcgggtggaggcccaccctgagaacaaccggcccatcatccagatccccagcacagaaggagagggcagcggctcctggaagtggaaggcccctgagaagggcagcctgcggcagacctatgagctgaatgacctgaacagagacagcgagagctgtgagagcctgaaggacagctttggcagcggggacaggaagaggagcaacatcgacagcaatgagcaccaccaccacggcatcaccaccatccgggtgacccctgtggagggcagcgagatcggcagcgagaccctgagcatcagcagcagccgggacagcaccctgcggaggaaaggaaacatcatcctgatccctgagaggagcaacagccctgagaacaccaggaacatcttctacaagggcaccagccccacccgggcctacaaggactag

SEQ ID NO: 35135 - DNA, 2292 bp, Artificial Sequence
  Description of Artificial Sequence: Synthetic coding sequence
atgcagagagctggcagcagcggcggccgcggggagtgtgacatcagcggggccggccgcctgggcctggaggaggccgcccggctgagctgtgctgtgcacaccagccctgggggcggcagaagacctggccaggccgccggcatgtctgccaaggagcggcccaagggcaaggtgatcaaggacagcgtgaccctgctgccctgcttctactttgtggagctgcccatcctggccagctctgtggtgtccctgtacttcctggagctgacagatgtgttcaagcctgtgcacagcggcttcagctgctatgacaggagcctgtccatgccctacatcgagcccacccaggaggccatccccttcctgatgctgctgagcctggcctttgctggccctgccatcaccatcatggtgggggagggcatcctgtactgctgcctgagcaagagaagaaatggagtgggcctggagcccaacatcaatgccggcggctgcaacttcaacagcttcctgcggcgggctgtgcgctttgtgggcgtgcacgtgtttggcctgtgcagcacagccctgatcacagacatcatccagctgagcacaggctaccaggccccctacttcctgactgtgtgcaagcccaactacaccagcctgaatgtgtcctgcaaggagaacagctacatcgtggaggacatctgcagcggcagtgacctgaccgtcatcaacagcggcaggaagagcttccccagccagcacgccaccctggccgcctttgctgctgtgtatgtgtccatgtacttcaacagcaccctgacagacagcagcaagctgctgaagcccctgctggtgttcaccttcatcatctgtggcatcatctgtggcctgacccgcatcacccagtacaagaaccaccctgtggatgtgtactgcggcttcctgattggaggcggcatcgccctgtacctgggcctgtatgctgtgggcaacttcctgcccagtgatgagagcatgttccagcacagagatgccctgcggagcctgacagacctgaaccaggaccccaaccggctgctgagcgccaagaatggcagcagcagtgatggcatcgcccacacagagggcatcctgaacagaaaccacagagatgccagcagcctgaccaacctgaagagggccaatgctgatgtggagatcatcacccccaggagccccatgggcaaggagaacatggtgaccttcagcaacaccctgccccgggccaacacccccagcgtggaggaccctgtgagaagaaatgccagcatccacgcctccatggattctgcccggagcaagcagctgctgacccagtggaagaacaagaatgaaagcaggaagctgagcctgcaggtgattgagcctgagcccggccagagccccccaagaagcattgagatgaggagcagcagcgagcccagccgggtgggcgtgaatggagaccaccacggccctggcaaccagtacctgaagatccagcccggggctgtgcccggctgcaacaacagcatgcctgggggcccccgggtgtccatccagagccggcccggcagcagccagctggtgcacatccctgaggagacccaggagaacatcagcaccagccccaagagcagcagcgcccgggccaagtggctgaaggctgctgagaagacagtggcctgcaacagaagcaacagccagccccgcatcatgcaggtgattgccatgagcaagcagcagggcgtgctgcagagcagccccaagaacacagagggcagcacagtgtcctgcaccggcagcatccgctacaagaccctgacagaccacgagcccagcggcatcgtgcgggtggaggcccaccctgagaacaaccggcccatcatccagatccccagcacagaaggagagggcagcggctcctggaagtggaaggcccctgagaagggcagcctgcggcagacctatgagctgaatgacctgaacagagacagcgagagctgtgagagcctgaaggacagctttggcagcggggacaggaagaggagcaacatcgacagcaatgagcaccaccaccacggcatcaccaccatccgggtgacccctgtggagggcagcgagatcggcagcgagaccctgagcatcagcagcagccgggacagcaccctgcggaggaaaggaaacatcatcctgatccctgagaggagcaacagccctgagaacaccaggaacatcttctacaagggcaccagccccacccgggcctacaaggactag

SEQ ID NO: 35136 - DNA, 2118 bp, Artificial Sequence
  Description of Artificial Sequence: Synthetic coding sequence
atgcagagagctggcagcagcggcggccgcggggagtgtgacatcagcggggccggccgcctgggcctggaggaggccgcccggctgagctgtgctgtgcacaccagccctgggggcggcagaagacctggccaggccgccggcatgtctgccaaggagcggcccaagggcaaggtgatcaaggacagcgtgaccctgctgccctgcttctactttgtggagctgcccatcctggccagctctgtggtgtccctgtacttcctggagctgacagatgtgttcaagcctgtgcacagcggcttcagctgctatgacaggagcctgtccatgccctacatcgagcccacccaggaggccatccccttcctgatgctgctgagcctggcctttgctggccctgccatcaccatcatggtgggggagggcatcctgtactgctgcctgagcaagagaagaaatggagtgggcctggagcccaacatcaatgccggcggctgcaacttcaacagcttcctgcggcgggctgtgcgctttgtgggcgtgcacgtgtttggcctgtgcagcacagccctgatcacagacatcatccagctgagcacaggctaccaggccccctacttcctgactgtgtgcaagcccaactacaccagcctgaatgtgtcctgcaaggagaacagctacatcgtggaggacatctgcagcggcagtgacctgaccgtcatcaacagcggcaggaagagcttccccagccagcacgccaccctggccgcctttgctgctgtgtatgtgtctggcctgtatgctgtgggcaacttcctgcccagtgatgagagcatgttccagcacagagatgccctgcggagcctgacagacctgaaccaggaccccaaccggctgctgagcgccaagaatggcagcagcagtgatggcatcgcccacacagagggcatcctgaacagaaaccacagagatgccagcagcctgaccaacctgaagagggccaatgctgatgtggagatcatcacccccaggagccccatgggcaaggagaacatggtgaccttcagcaacaccctgccccgggccaacacccccagcgtggaggaccctgtgagaagaaatgccagcatccacgcctccatggattctgcccggagcaagcagctgctgacccagtggaagaacaagaatgaaagcaggaagctgagcctgcaggtgattgagcctgagcccggccagagccccccaagaagcattgagatgaggagcagcagcgagcccagccgggtgggcgtgaatggagaccaccacggccctggcaaccagtacctgaagatccagcccggggctgtgcccggctgcaacaacagcatgcctgggggcccccgggtgtccatccagagccggcccggcagcagccagctggtgcacatccctgaggagacccaggagaacatcagcaccagccccaagagcagcagcgcccgggccaagtggctgaaggctgctgagaagacagtggcctgcaacagaagcaacagccagccccgcatcatgcaggtgattgccatgagcaagcagcagggcgtgctgcagagcagccccaagaacacagagggcagcacagtgtcctgcaccggcagcatccgctacaagaccctgacagaccacgagcccagcggcatcgtgcgggtggaggcccaccctgagaacaaccggcccatcatccagatccccagcacagaaggagagggcagcggctcctggaagtggaaggcccctgagaagggcagcctgcggcagacctatgagctgaatgacctgaacagagacagcgagagctgtgagagcctgaaggacagctttggcagcggggacaggaagaggagcaacatcgacagcaatgagcaccaccaccacggcatcaccaccatccgggtgacccctgtggagggcagcgagatcggcagcgagaccctgagcatcagcagcagccgggacagcaccctgcggaggaaaggaaacatcatcctgatccctgagaggagcaacagccctgagaacaccaggaacatcttctacaagggcaccagccccacccgggcctacaaggactag

SEQ ID NO: 35137 - DNA, 966 bp, Artificial Sequence
  Description of Artificial Sequence: Synthetic coding sequence
atgcccctgctgcctgctgccctgaccagctccatgctgtacttccagatggtgatcatggccggcaccgtgatgctggcctactactttgagtacacagacaccttcaccgtgaatgtgcagggcttcttctgccacgacagcgcctacaggaagccctacccaggccctgaggacagcagcgctgtgccccctgtgctgctgtacagcctggccgccggcgtgcctgtgctggtgatcatcgtgggggagacagctgtgttctgcctgcagctggccacccgggactttgagaaccaggagaagaccatcctgaccggggactgctgctacatcaaccccctggtgagaagaacagtgcgcttcctgggcatctacaccttcggcctgtttgccacagacatctttgtgaatgccggccaggtggtgacaggcaacctggccccccacttcctggccctgtgcaagcccaactacacagccctgggctgccagcagtacacccagttcatcagcggggaggaggcctgcaccggcaacccagacctgatcatgagggccaggaagaccttccccagcaaggaggccgccctgtctgtgtatgctgccatgtacctgaccatgtacatcaccaacaccatcaaggccaagggcacccggctggccaagcctgtgctgtgcctgggcctgatgtgcctggccttcctgaccggcctgaacagagtggccgagtacagaaaccactggagcgatgtgattgctggcttcctggtgggcatcagcattgctgtgttcctggtggtgtgtgtggtgaacaacttcaagggccggcaggccgagaatgagcacatccacatggacaacctggcccagatgcccatgatcagcatcccccgggtggagagccccctggagaaggtgacctctgtgcagaaccacatcacagcctttgctgaggtgacctag

SEQ ID NO: 35138 - DNA, 951 bp, Artificial Sequence
  Description of Artificial Sequence: Synthetic coding sequence
atgcccctgctgcctgctgccctgaccagctccatgctgtacttccagatggtgatcatggccggcaccgtgatgctggcctactactttgagtacacagacaccttcaccgtgaatgtgcagggcttcttctgccacgacagcgcctacaggaagccctacccaggccctgaggacagcagcgctgtgccccctgtgctgctgtacagcctggccgccggcgtgcctgtgctggtgatcatcgtgggggagacagctgtgttctgcctgcagctggccacccgggactttgagaaccaggagaagaccatcctgaccggggactgctgctacatcaaccccctggtgagaagaacagtgcgcttcctgggcatctacaccttcggcctgtttgccacagacatctttgtgaatgccggccaggtggtgacaggcaacctggccccccacttcctggccctgtgcaagcccaactacacagccctgggctgccagcagtacacccagttcatcagcggggaggaggcctgcaccggcaacccagacctgatcatgagggccaggaagaccttccccagcaaggaggccgccctgtctgtgtatgctgccatgtacctgaccatgtacatcaccaacaccatcaaggccaagggcacccggctggccaagcctgtgctgtgcctgggcctgatgtgcctggccttcctgaccggcctgaacagagtggccgagtacagaaaccactggagcgatgtgattgctggcttcctggtgggcatcagcattgctgtgttcctggtggtgtgtgtggtgaacaacttcaagggccggcaggccgagaatgagcacatccacatggacaacctggcccagatgcccatgatcagcatcccccgggtggagagccccctggagaagaaccacatcacagcctttgctgaggtgacctag

SEQ ID NO: 35139 - DNA, 744 bp, Artificial Sequence
  Description of Artificial Sequence: Synthetic coding sequence
atgctgcccagccaggaggccagcaagctgtaccacgagcactacatgaggaacagccgggccatcggcgtgctgtgggccatcttcaccatctgctttgccatcatcaacgtggtggtgttcatccagccctactgggtgggggacagcgtgtccacccccaagccaggctacttcggcctcttccactactgtgtgggcagcggcctggccggccgggagctgacctgccggggcagcttcacagacttcagcaccatccccagcagcgccttcaaggctgctgccttctttgtgctgctgtccatggtgctgatcctgggctgcatcacctgcttcagcctcttcttcttctgcaacacagccaccgtgtacaagatctgtgcctggatgcagctgctggccgccctgtgcctggtgctgggctgcatgatcttcccagatggctgggatgctgagaccatccgggacatgtgtggggccaagacaggcaagtacagcctgggggactgcagcgtgcgctgggcctacatcctggccatcatcggcatcctgaatgccctgatcctgtccttcctggcctttgtgctgggcaaccggcagacagacctgctgcaggaggagctgaagccagagaacaaggactttgtgggcagcacagtgtcctctgtgctgcggcctggaggagatgtgtctggctggggcgtgctgccctgccctgtggcccacagccagggcccctag

SEQ ID NO: 35140 - DNA, 2088 bp, Artificial Sequence
  Description of Artificial Sequence: Synthetic coding sequence
atgtctggggccgccctgggcctggagatcgtgtttgtgttcttcctggccctcttcctgctgcaccgctacggggacttcaagaagcagcaccggctggtgatcatcggcaccctgctggcctggtacctgtgcttcctgattgtgttcatcctgcccctggatgtgtccaccaccatctacaaccgctgcaagcatgctgctgccaacagcagccccccagagaacagcaacatcaccggcctgtatgccacagccaaccctgtgcccagccagcacccctgcttcaagccctggagctacatcccagatggcatcatgcccatcttctggagggtggtgtactggaccagccagttcctgacctggatcctgctgcccttcatgcagagctatgcccggagcggcggcttcagcatcaccgggaagatcaagacagccctgattgaaaatgccatctactacggcacctacctgctgatctttggagccttcctgatctacgtggccgtgaacccccacctgcacctggagtggaaccagctgcagaccatcggcattgctgctgccaacacctggggcctcttcctgctggtgctgctgctgggctacggcctggtggagatccccaggagctactggaatggagccaagaggggctacctgctgatgaagacctacttcaaggccgccaagctgatgacagagaaggcagatgctgaggagaacctggaggatgccatggaggaggtgaggaaggtgaatgaaagcatcaagtacaaccaccccctgaggaaatgtgtggacaccatcctgaagaagtgccccacagagtaccaggagaagatgggcaggaacatggatgattatgaagattttgatgagaagcacagcatctaccccagcgagaagagcctggtgaagctgcacaagcaggtgatctacagcgtgcagaggcacaggaggacccaggtgcagtggcagatcctgctggagcaggccttctacctggaggatgtggccaagaatgagaccagcgccacccaccagtttgtgcacaccttccagagccctgagccagaaaatcgcttcatccagtacttctacaaccccacctttgagtggtactgggagtgcctgctgcggccctggttctacaagatcctggccgtggtgctgagcatcttctctgtgattgtggtgtggagcgagtgcaccttcttcagcaccacccctgtgctgagcctgtttgctgtgttcatccagctggccgagaagacctacaactacatctacattgaaattgcctgcttcctgagcatcttcttcctgagcatctgtgtgtacagcacagtgttccgcatccgggtcttcaactactactacctggccagccaccaccagacagatgcctacagcctgctcttcagcggcatgctgttctgccgcctgaccccacccctgtgcctgaacttcctgggcctgacccacatggacagcagcatcagccacaagaacacccagcccacagcctacaccagcatcatgggctccatgaaggtgctgtccttcatcgcagatggcttctacatctactaccccatgctggtggtgatcctgtgcatcgccacctacttcagcctgggcacccgctgcctgaacctgctgggcttccagcagttcatgggagatgatgacatgaccagtgacctggtgaatgaaggcaaggagctgatcaggaaggagaagaggaagaggcagaggcaggaggagggagaaaatagaagaagagagtggaaggagagatatggccacaaccgggaggacagcaccaggaacagaaacatccacacagaccccaaggagagcaacttcagtgatgtgaacaccaacagaagtgccttcaagtacacccgggccaacaacagaacagagcgggacagaattgagctgctgcaggatgctgagcccctggacttcaatgctgagaccttcacagatgaccccctggagagcgagagcggccgctaccagcccggcggccgctacctgtccatgagcagaagtgacatcttcaatgatgtgtag

SEQ ID NO: 35141 - DNA, 1770 bp, Artificial Sequence
  Description of Artificial Sequence: Synthetic coding sequence
atgcccatcttctggagggtggtgtactggaccagccagttcctgacctggatcctgctgcccttcatgcagagctatgcccggagcggcggcttcagcatcaccgggaagatcaagacagccctgattgaaaatgccatctactacggcacctacctgctgatctttggagccttcctgatctacgtggccgtgaacccccacctgcacctggagtggaaccagctgcagaccatcggcattgctgctgccaacacctggggcctcttcctgctggtgctgctgctgggctacggcctggtggagatccccaggagctactggaatggagccaagaggggctacctgctgatgaagacctacttcaaggccgccaagctgatgacagagaaggcagatgctgaggagaacctggaggatgccatggaggaggtgaggaaggtgaatgaaagcatcaagtacaaccaccccctgaggaaatgtgtggacaccatcctgaagaagtgccccacagagtaccaggagaagatgggcaggaacatggatgattatgaagattttgatgagaagcacagcatctaccccagcgagaagagcctggtgaagctgcacaagcaggtgatctacagcgtgcagaggcacaggaggacccaggtgcagtggcagatcctgctggagcaggccttctacctggaggatgtggccaagaatgagaccagcgccacccaccagtttgtgcacaccttccagagccctgagccagaaaatcgcttcatccagtacttctacaaccccacctttgagtggtactgggagtgcctgctgcggccctggttctacaagatcctggccgtggtgctgagcatcttctctgtgattgtggtgtggagcgagtgcaccttcttcagcaccacccctgtgctgagcctgtttgctgtgttcatccagctggccgagaagacctacaactacatctacattgaaattgcctgcttcctgagcatcttcttcctgagcatctgtgtgtacagcacagtgttccgcatccgggtcttcaactactactacctggccagccaccaccagacagatgcctacagcctgctcttcagcggcatgctgttctgccgcctgaccccacccctgtgcctgaacttcctgggcctgacccacatggacagcagcatcagccacaagaacacccagcccacagcctacaccagcatcatgggctccatgaaggtgctgtccttcatcgcagatggcttctacatctactaccccatgctggtggtgatcctgtgcatcgccacctacttcagcctgggcacccgctgcctgaacctgctgggcttccagcagttcatgggagatgatgacatgaccagtgacctggtgaatgaaggcaaggagctgatcaggaaggagaagaggaagaggcagaggcaggaggagggagaaaatagaagaagagagtggaaggagagatatggccacaaccgggaggacagcaccaggaacagaaacatccacacagaccccaaggagagcaacttcagtgatgtgaacaccaacagaagtgccttcaagtacacccgggccaacaacagaacagagcgggacagaattgagctgctgcaggatgctgagcccctggacttcaatgctgagaccttcacagatgaccccctggagagcgagagcggccgctaccagcccggcggccgctacctgtccatgagcagaagtgacatcttcaatgatgtgtag

SEQ ID NO: 35142 - DNA, 618 bp, Artificial Sequence
  Description of Artificial Sequence: Synthetic coding sequence
atgaacaaggtgttcccccagggagaaaatggctacacagctgctgagagcaaggcccaccctggaggagaggccggcggcggccacctgtgctgcagccggcggggggcctgcctgagcgccagcctgctgctgctgctggccaccgtggccgccctgattgccctggtgaccatcctgggcctgcccagctgcacccctggggcccaggcctgcatcaccctgaccaacagaacaggcttcctgtgccacgaccagaggagctgcatcccagccagcggcgtgtgtgatggagtgaggacctgcacccacggggaggatgaagatgagagcctgtgcagagatgtgccccagagcctgccccacttcctggtggcccactgtggggaccctgcctcctggatctacagcgaccagaagtgtgatggcaccaacaactgtggggactgcagtgatgagctgagccctgtgacagtgtgccccccctgtggccctggctggtggcgctgccccagcaccttcttcaagtactgtgactgcatccccaggcacctgtgccgggaccacgtgcagcactgcagcgactggagcgatgaatatgcctgccccggcccctag

SEQ ID NO: 35143 - DNA, 351 bp, Artificial Sequence
  Description of Artificial Sequence: Synthetic coding sequence
atgaacaaggtgttcccccagggagaaaatggctacacagctgctgagagcaaggcccaccctggaggagaaggagatgtgccccagagcctgccccacttcctggtggcccactgtggggaccctgcctcctggatctacagcgaccagaagtgtgatggcaccaacaactgtggggactgcagtgatgagctgagccctgtgacagtgtgccccccctgtggccctggctggtggcgctgccccagcaccttcttcaagtactgtgactgcatccccaggcacctgtgccgggaccacgtgcagcactgcagcgactggagcgatgaatatgcctgccccggcccctag

SEQ ID NO: 35144 - DNA, 819 bp, Artificial Sequence
  Description of Artificial Sequence: Synthetic coding sequence
atggaggcctgctgcctgctgcagctgccccagaggctgctgctgctgggcgctgctgccctgacagccacagccctggagacagctgacctggccgagctgtgtggccagacctggcagggagatggcctgctgctgcggagccacgccgccagccgccgcttctactttgtggccccagacacagactgtggcctgtgggtgcaggccgccgcccctggggaccgcatccgcttccagttccgcttcttcctggtgtacagcctgaccccagcccccccagccctgaacaccagcagccctgccccagctgacccctgtgcccctggcagctacctgcagttctatgagggccccccaggggccccccggcccctgggcagccccctgtgtggcctgaacatccctgtgcctgtggccagcagcggccccttcctgggcctgcggctggtgacccggggccggcagccccgggtggactttgtgggggaggtgaccagcttccggctgggcccctgtggggcctacttccgctgccagaatggccgctgcatccccagcagcctggtgtgtgacccctggggcatggacaactgtggagatggcagtgaccagggctcctggagccctgctgactgccggggccccagccctgtgcccagccagacaggcagcacagatgcccacaccagccgcagcctgacccccagccctgccctgggcagcgctggcagcctgtggattgctgctgagaggagcagccctgctggccgggaccccacccggcaggatgctgccctggagggcagcacagaatag

SEQ ID NO: 35145 - DNA, 819 bp, Artificial Sequence; identical to SEQ ID NO: 35144
  Description of Artificial Sequence: Synthetic coding sequence

SEQ ID NO: 35146 - DNA, 1038 bp, Artificial Sequence
  Description of Artificial Sequence: Synthetic coding sequence
atgtggctgctgggccccctgtgcctgctgctgagcagcgctgctgagagccagctgctgcccggcaacaacttcaccaatgaatgcaacatccctggcaacttcatgtgcagcaatggccgctgcatccctggggcctggcagtgtgatggcctgcctgactgctttgacaagagtgatgagaaggaatgtcccaaggccaagagcaaatgtggccccaccttcttcccctgtgccagcggcatccactgcatcatcggccgcttccgctgcaatggatttgaggactgcccagatggcagtgatgaggagaactgcacagccaaccccctgctgtgcagcacagcccgctaccactgcaagaatggcctgtgcatcgacaagagcttcatctgtgatggccagaacaactgccaggacaacagtgatgaggagagctgtgagagcagccaggagcccggcagcggccaggtgtttgtgaccagcgagaaccagctggtgtactaccccagcatcacctacgccatcatcggcagcagcgtcatctttgtgctggtggtggccctgctggccctggtgctgcaccaccagaggaagaggaacaacctgatgaccctgcctgtgcaccggctgcagcaccctgtgctgctgagccggctggtggtgctggaccacccccaccactgcaatgtgacctacaacgtgaacaacggcatccagtatgtggccagccaggccgagcagaatgccagcgaggtgggcagcccccccagctacagcgaggccctgctggaccagaggcctgcctggtatgacctgcccccaccaccctacagcagtgacacagagagcctgaaccaggccgacctgcccccctaccgcagccgcagcggcagcgccaacagcgccagcagccaggccgccagcagcctgctgtctgtggaggacaccagccacagccctggccagcccggcccccaggagggcacagctgagccccgggacagcgagcccagccagggcacagaggaggtgtag

SEQ ID NO: 35147 - DNA, 468 bp, Artificial Sequence
  Description of Artificial Sequence: Synthetic coding sequence
atgtggctgctgggccccctgtgcctgctgctgagcagcgctgctgagagccagctgctgcccggcaacaacttcaccaatgaatgcaacatccctggcaacttcatgtgcagcaatggccgctgcatccctggggcctggcagtgtgatggcctgcctgactgctttgacaagagtgatgagaaggaatgtcccaaggccaagagcaaatgtggccccaccttcttcccctgtgccagcggcatccactgcatcatcggccgcttccgctgcaatggatttgaggactgcccagatggcagtgatgaggagaactgcaagaatggcctgtgcatcgacaagagcttcatctgtgatggccagaacaactgccaggacaacagtgatgaggagagctgtgagagcagccagggcctgcggggcatgaccttcctgcaccggcccaccctgctgaccaggaacctgtag

SEQ ID NO: 35148 - DNA, 1503 bp, Artificial Sequence
  Description of Artificial Sequence: Synthetic coding sequence
atggcctctgtggcccaggagagcgctggcagccagaggcggctgccccccaggcatggagccctgcggggcctgctgctgctgtgcctgtggctgcccagcggccgggccgccctgcccccagctgcccccctgtctgagctgcacgcccagctgtctggagtggagcagctgctggaggagttccggcggcagctgcagcaggagcggccccaggaggagctggagctggagctgcgggccggcggcggcccccaggaggactgccccggccctggcagcggcggctacagcgccatgccagatgccatcatccgcaccaaggacagcctggccgccggggccagcttcctgcgggccccagctgctgtgcggggctggaggcagtgtgtggccgcctgctgcagcgagccccgctgcagcgtggccgtggtggagctgcccaggaggcctgcccctcctgctgctgtgctgggctgctacctgttcaactgcacagcccggggcagaaatgtgtgcaagtttgccctgcacagcggctacagcagctacagcctgagccgggccccagatggagctgccctggccacagcccgggccagcccccggcaggagaaggatgccccacccctgagcaaggccggccaggatgtggtgctgcacctgcccacagatggagtggtgctggatggccgggagagcacagatgaccacgccatcgtgcagtatgagtgggccctgctgcagggcgaccccagcgtggacatgaaggtgccccagagcggcaccctgaagctgagccacctgcaggagggcacctacaccttccagctgactgtgacagacacagctggccagaggagcagtgacaacgtgtctgtgacagtgctgcgggccgcctacagcactggaggctgcctgcacacctgcagccgctaccacttcttctgtgatgatggctgctgcatcgacatcaccctggcctgtgatggagtgcagcagtgcccagatggcagtgatgaggacttctgccagaacctgggcctggacaggaagatggtgacccacacagctgccagccctgccctgcccaggaccaccggccccagtgaagatgctggaggagacagcctggtggagaagagccagaaggccacagcccccaacaagcccccagccctgagcaacacagagaagaggaaccacagcgccttctggggccctgagagccagatcatccctgtgatgccagacagcagcagcagcggcaagaacaggaaggaggagagctacatctttgagagcaaaggagatggcggcggcggggagcacccagcccctgagactggagctgtgctgcccctggccctgggcctggccatcacagccctgctgctgctgatggtggcctgccgcctgcggctggtgaagcagaagctgaagaaggcccggcccatcaccagcgaggagagtgactacctgatcaatggcatgtacctgtag

SEQ ID NO: 35149 - DNA, 978 bp, Artificial Sequence
  Description of Artificial Sequence: Synthetic coding sequence
atggcctctgtggcccaggagagcgctggcagccagaggcggctgccccccaggcatggagccctgcggggcctgctgctgctgtgcctgtggctgcccagcggccgggccgccctgcccccagctgcccccctgtctgagctgcacgcccagctgtctggagtggagcagctgctggaggagttccggcggcagctgcagcaggagcggccccaggaggagctggagctggagctgcgggccggcggcggcccccaggaggactgccccggccctggcagcggcggctacagcgccatgccagatgccatcatccgcaccaaggacagcctggccgccggggccagcttcctgcgggccccagctgctgtgcggggctggaggcagtgtgtggccgcctgctgcagcgagccccgctgcagcgtggccgtggtggagctgcccaggaggcctgcccctcctgctgctgtgctgggctgctacctgttcaactgcacagcccggggcagaaatgtgtgcaagtttgccctgcacagcggctacagcagctacagcctgagccgggccccagatggagctgccctggccacagcccgggccagcccccggcaggagaaggatgccccacccctgagcaaggccggccaggatgtggtgctgcacctgcccacagatggagtggtgctggatggccgggagagcacagatgaccacgccatcgtgcagtatgagtgggccctgctgcagggcgaccccagcgtggacatgaaggtgccccagagcggcaccctgaagctgagccacctgcaggagggcacctacaccttccagctgactgtgacagacacagctggccagaggagcagtgacaacgtgtctgtgacagtgctgcgggccgcctacagcactggagatggctggagcatctgctgcatctgcagcaagcgggaggccaaggagttcagcgagaccagctag

SEQ ID NO: 35150 - DNA, 738 bp, Artificial Sequence
  Description of Artificial Sequence: Synthetic coding sequence
atgaaggtgccccagagcggcaccctgaagctgagccacctgcaggagggcacctacaccttccagctgactgtgacagacacagctggccagaggagcagtgacaacgtgtctgtgacagtgctgcgggccgcctacagcactggaggctgcctgcacacctgcagccgctaccacttcttctgtgatgatggctgctgcatcgacatcaccctggcctgtgatggagtgcagcagtgcccagatggcagtgatgaggacttctgccagaacctgggcctggacaggaagatggtgacccacacagctgccagccctgccctgcccaggaccaccggccccagtgaagatgctggaggagacagcctggtggagaagagccagaaggccacagcccccaacaagcccccagccctgagcaacacagagaagaggaaccacagcgccttctggggccctgagagccagatcatccctgtgatgccagacagcagcagcagcggcaagaacaggaaggaggagagctacatctttgagagcaaaggagatggcggcggcggggagcacccagcccctgagaccggggctgtgctgcccctggccctgggcctggccatcacagccctgctgctgctgatggtggcctgccgcctgcggctggtgaagcagaagctgaagaaggcccggcccatcaccagcgaggagagtgactacctgatcaatggcatgtacctgtag

SEQ ID NO: 35151 - DNA, 2580 bp, Artificial Sequence
  Description of Artificial Sequence: Synthetic coding sequence
atggcctgccgctggagcaccaaggagagcccccgctggaggtctgccctgctgctgctcttcctggccggcgtgtatggaaatggagccctggccgagcacagtgaaaatgtgcacatctctggagtgtccacagcctgtggggagaccccagagcagatccgggcccccagcggcatcatcaccagccctggctggcccagcgagtacccagccaagatcaactgctcctggttcatccgggccaaccctggagagatcatcaccatctccttccaggactttgacatccagggcagccgccgctgcaacctggactggctgaccatcgagacctacaagaacatcgagagctaccgggcctgtggcagcaccatccccccaccctacatcagcagccaggaccacatctggatccgcttccacagtgatgacaacatcagcaggaagggcttccggctggcctacttcagcggcaagtctgaggagcccaactgtgcctgtgaccagttccgctgtggaaatggcaagtgcatccctgaggcctggaagtgcaacaacatggatgaatgtggggacagcagtgatgaggagatctgtgccaaggaggccaaccccccaacagctgctgccttccagccctgtgcctacaaccagttccagtgcctgagccgcttcaccaaggtgtacacctgcctgcctgagagcctgaagtgtgatggcaacatcgactgcctggacctgggagatgaaattgactgtgatgtgcccacctgtggccagtggctgaagtacttctacggcaccttcaacagccccaactacccagacttctacccacctggcagcaactgcacctggctgattgacacaggagaccacaggaaggtgatcctgcgcttcacagacttcaagctggatggcaccggctatggagactatgtgaagatctatgatggcctggaggagaacccccacaagctgctgcgggtgctgacagcctttgacagccacgcccccctgactgtggtgagcagcagcggccagatccgggtgcacttctgtgccgacaaggtgaatgctgcccggggcttcaatgccacctaccaggtggatggcttctgcctgccctgggagatcccctgtggcggcaactggggctgctacacagagcagcagagatgtgatggctactggcactgccccaacggcagagatgagaccaactgcaccatgtgccagaaggaggagttcccctgcagcagaaatggagtgtgctaccccaggagtgaccgctgcaactaccagaaccactgccccaatggaagtgatgagaagaactgcttcttctgccagcccggcaacttccactgcaagaacaacagatgtgtgtttgagagctgggtgtgtgacagccaggatgactgtggagatggcagtgatgaggagaactgccctgtgattgtgcccaccagggtcatcacagctgctgtgattggcagcctcatctgtggcctgctgctggtgattgccctgggctgcacctgcaagctgtacagcctgaggatgtttgagcggcgcagctttgagacccagctgagccgggtggaggccgagctgctgcggcgggaggccccacccagctatggccagctgattgcccagggcctcatcccccctgtggaggacttccctgtgtgcagccccaaccaggcctctgtgctggagaacctgcggctggccgtgcgcagccagctgggcttcacctctgtgcggctgcccatggccggccgcagcagcaacatctggaaccgcatcttcaactttgcccggagccgccacagcggcagcctggccctggtgtctgcagatggagatgaggtggtgcccagccagagcaccagccgggagcctgagaggaaccacacccacaggagcctcttctctgtggagagtgatgacacagacacagaaaatgaaagaagagacatggccggggccagcggcggcgtggccgcccccctgccccagaaggtgccccccaccacagctgtggaggccaccgtgggcgcctgtgccagcagcagcacccagagcacccggggcggccatgctgacaatggaagagatgtgacctctgtggagccccccagcgtgtccccagcccggcaccagctgaccagcgccctgagcaggatgacccagggcctgcgctgggtgcgcttcaccctgggccgcagcagcagcctgagccagaaccagagccccctgcggcagctggacaacggggtgtctggccgggaggatgatgatgatgtggagatgctgatccccatcagtgatggcagcagtgactttgatgtgaatgactgcagccggcccctgctggacctggccagtgaccagggccagggcctgcggcagccctacaatgccaccaaccctggggtgcggcccagcaacagagatggcccctgtgagcgctgtggcatcgtgcacacagcccagatcccagacacctgcctggaggtgaccctgaagaatgagaccagtgatgatgaggccctgctgctgtgctag

SEQ ID NO: 35152 - DNA, 2523 bp, Artificial Sequence
  Description of Artificial Sequence: Synthetic coding sequence
atggcctgccgctggagcaccaaggagagcccccgctggaggtctgccctgctgctgctcttcctggccggcgtgtatgcctgtggggagaccccagagcagatccgggcccccagcggcatcatcaccagccctggctggcccagcgagtacccagccaagatcaactgctcctggttcatccgggccaaccctggagagatcatcaccatctccttccaggactttgacatccagggcagccgccgctgcaacctggactggctgaccatcgagacctacaagaacatcgagagctaccgggcctgtggcagcaccatccccccaccctacatcagcagccaggaccacatctggatccgcttccacagtgatgacaacatcagcaggaagggcttccggctggcctacttcagcggcaagtctgaggagcccaactgtgcctgtgaccagttccgctgtggaaatggcaagtgcatccctgaggcctggaagtgcaacaacatggatgaatgtggggacagcagtgatgaggagatctgtgccaaggaggccaaccccccaacagctgctgccttccagccctgtgcctacaaccagttccagtgcctgagccgcttcaccaaggtgtacacctgcctgcctgagagcctgaagtgtgatggcaacatcgactgcctggacctgggagatgaaattgactgtgatgtgcccacctgtggccagtggctgaagtacttctacggcaccttcaacagccccaactacccagacttctacccacctggcagcaactgcacctggctgattgacaccggggaccacaggaaggtgatcctgcgcttcacagacttcaagctggatggcaccggctacggggactatgtgaagatctatgatggcctggaggagaacccccacaagctgctgcgggtgctgacagcctttgacagccacgcccccctgactgtggtgagcagcagcggccagatccgggtgcacttctgtgccgacaaggtgaatgctgcccggggcttcaatgccacctaccaggtggatggcttctgcctgccctgggagatcccctgtggcggcaactggggctgctacacagagcagcagagatgtgatggctactggcactgccccaacggcagagatgagaccaactgcaccatgtgccagaaggaggagttcccctgcagcagaaatggagtgtgctaccccaggagtgaccgctgcaactaccagaaccactgccccaacggcagtgatgagaagaactgcttcttctgccagcccggcaacttccactgcaagaacaacagatgtgtgtttgagagctgggtgtgtgacagccaggatgactgtggagatggcagtgatgaggagaactgccctgtgattgtgcccaccagggtcatcacagctgctgtgattggcagcctcatctgtggcctgctgctggtgattgccctgggctgcacctgcaagctgtacagcctgaggatgtttgaaagaagaagctttgagacccagctgagccgggtggaggccgagctgctgcggcgggaggcccctccttcctatggccagctgattgcccagggcctcatcccccctgtggaggacttccctgtgtgcagccccaaccaggcctctgtgctggagaacctgcggctggccgtgcgcagccagctgggcttcacctctgtgcggctgcccatggccggccgcagcagcaacatctggaaccgcatcttcaactttgcccggagccgccacagcggcagcctggccctggtgtctgcagatggagatgaggtggtgcccagccagagcaccagccgggagcctgagaggaaccacacccacaggagcctcttctctgtggagagtgatgacacagacacagaaaatgaaagaagagacatggccggggccagcggaggagtggccgcccccctgccccagaaggtgccccccaccacagctgtggaggccaccgtgggcgcctgtgccagcagcagcacccagagcacccggggcggccacgccgacaatggaagagatgtgacctctgtggagcccccatctgtgtccccagcccggcaccagctgaccagcgccctgagcaggatgacccagggcctgcgctgggtgcgcttcaccctgggccgcagcagcagcctgagccagaaccagagccccctgcggcagctggacaatggagtgtctggaagagaagatgatgatgatgtggagatgctgatccccatcagtgatggcagcagtgactttgatgtgaatgactgcagccggcccctgctggacctggccagtgaccagggccagggcctgcggcagccctacaatgccaccaaccctggggtgcggcccagcaacagagatggcccctgtgagcgctgtggcatcgtgcacacagcccagatcccagacacctgcctggaggtgaccctgaagaatgagaccagtgatgatgaggccctgctgctgtgctag

SEQ ID NO: 35153 - DNA, 8592 bp, Artificial Sequence
  Description of Artificial Sequence: Synthetic coding sequence
atggccagcgaggacaacagagtgcccagccccccacccactggagatgatggcggcggcggcggccgggaggagacccccacagagggcggggccctgagcctgaagccaggcctgcccatccggggcatccgcatgaagtttgctgtgctgaccggcctggtggaggtgggggaggtgagcaacagagacatcgtggagaccgtcttcaacctgctggtgggcggccagtttgacctggagatgaacttcatcatccaggagggggagagcatcaactgcatggtggacctgctggagaagtgtgacatcacctgccaggccgaggtgtggagcatgttcaccgccatcctgaagaagagcatccggaacctgcaggtgtgcacagaggtgggcctggtggagaaggtgctgggcaagattgagaaggtggacaacatgattgctgacctgctggtggacatgctgggcgtgctggccagctacaacctgactgtgcgggagctgaagctgttcttcagcaagctgcagggcgacaagggccgctggccccctcatgctgggaagctgctgtctgtgctgaagcacatgccccagaagtatggcccagatgccttcttcaacttccctgggaagtctgctgctgccatcgccctgccccccatcgccaagtggccctaccagaatggcttcaccttccacacctggctgaggatggaccctgtgaacaacatcaacgtggacaaggacaagccctacctgtactgcttccgcaccagcaagggcctgggctacagcgcccactttgtgggcggctgcctgattgtgaccagcatcaagagcaagggcaagggcttccagcactgtgtgaagtttgacttcaagccccagaagtggtacatggtgaccatcgtgcacatctacaaccgctggaagaacagcgagctgcgctgctacgtgaatggagagctggccagctatggagagatcacctggtttgtgaacaccagtgacacctttgacaagtgcttcctgggcagcagcgagacagcagatgccaacagagtcttctgtggccagatgacagctgtgtacctgttcagcgaggccctgaatgctgcccagatctttgccatctaccagctgggcctgggctacaagggcaccttcaagttcaaggccgagagtgacctcttcctggccgagcaccacaagctgctgctgtatgatggcaagctgagcagcgccatcgccttcacctacaacccccgggccacagatgcccagctgtgcctggagagcagccccaaggacaaccccagcatctttgtgcacagcccccacgccctgatgctgcaggatgtgaaggctgtgctgacccacagcatccagagcgccatgcacagcatcggcggcgtgcaggtgctcttccccctgtttgcccagctggactaccggcagtacctgagtgatgaaattgacctgaccatctgcagcaccctgctggccttcatcatggagctgctgaagaacagcatcgccatgcaggagcagatgctggcctgcaagggcttcctggtgattggctacagcctggagaagagcagcaagagccacgtgtccagagctgtgctggagctgtgcctggccttcagcaagtacctgagcaacctgcagaatggcatgcccctgctgaagcagctgtgtgaccacgtgctgctgaacccagccatctggatccacaccccagccaaggtgcagctgatgctgtacacctacctgagcacagagttcatcggcaccgtgaacatctacaacaccatcagaagagtgggcaccgtgctgctgatcatgcacaccctgaagtactactactgggccgtgaacccccaggacaggagcggcatcacccccaagggcctggatggcccccggcccaaccagaaggagatgctgagcctgcgggccttcctgctgatgttcatcaagcagctggtgatgaaggacagcggcgtgaaggaggatgagctgcaggccatcctgaactacctgctgaccatgcatgaagatgacaacctgatggatgtgctgcagctgctggtggccctgatgtctgagcaccccaacagcatgatcccagcctttgaccagagaaatggcctgcgggtcatctacaagctgctggccagcaagtctgagggcatccgggtgcaggccctgaaggccatgggctacttcctgaagcacctggcccccaagaggaaggccgaggtgatgctgggccacggcctcttcagcctgctggccgagcggctgatgctgcagaccaacctgatcaccatgaccacctacaacgtgctgtttgagatcctgattgagcagatcggcacccaggtgatccacaagcagcacccagaccctgacagctctgtgaagatccagaacccccagatcctgaaggtgattgccaccctgctgaggaacagcccccagtgcccagagagcatggaggtgagaagagccttcctgagtgacatgatcaagctgttcaacaacagcagagaaaatagaagaagcctgctgcagtgcagcgtgtggcaggagtggatgctgagcctgtgctacttcaaccccaagaacagtgatgagcagaagatcacagagatggtgtatgccatcttccgcatcctgctgtaccacgctgtgaagtatgagtggggcggctggagggtgtgggtggacaccctgagcatcacccacagcaaggtgacctttgagatccacaaggagaacctggccaacatcttccgggagcagcagggcaaggtggatgaggagatcggcctgtgcagcagcacctctgtgcaggccgccagcggcatccggcgggacatcaacgtgtctgtgggcagccagcagcctgacaccaaggacagccctgtgtgcccccacttcaccaccaatggaaatgaaaacagcagcattgagaagaccagcagcctggagagcgccagcaacatcgagctgcagaccaccaacaccagctatgaggagatgaaggccgagcaggagaaccaggagctgcctgatgagggcaccctggaggagaccctgaccaatgagaccagaaatgctgatgacctggaggtgtccagtgacatcattgaagctgtggccatcagcagcaacagcttcatcaccaccgggaaggacagcatgacagtgtctgaggtgacagccagcatcagcagccccagcgaggaggatgccagcgagatgcctgagttcctggacaagagcatcgtggaggaggaggaggatgatgattatgtggagctgaaggtggagggcagccccacagaggaggccaacctgcccacagagctgcaggacaacagcctgagccctgctgccagcgaggccggggagaagctggacatgtttggaaatgatgacaagctgatcttccaggagggcaagcctgtgacagagaagcagacagacacagagacccaggacagcaaggacagcggcatccagaccatgacagccagcggcagcagcgccatgagccctgagaccaccgtgtcccagattgctgtggagagtgacctgggccagatgctggaggagggcaagaaggccaccaacctgacccgggagaccaagctgatcaatgactgccacggctctgtgtctgaggccagcagcgagcagaagatcgccaagctggatgtgtccaatgtggccacagacacagagcggctggagctgaaggccagccccaacgtggaggccccccagccccaccgccacgtgctggagatcagccggcagcacgagcagcccggccagggcatcgccccagatgctgtgaatggccagaggcgggacagccgcagcaccgtcttccgcatccctgagttcaactggagccagatgcaccagaggctgctgacagacctgctcttcagcattgaaacagacatccagatgtggaggagccacagcaccaagacagtgatggactttgtgaacagcagtgacaacgtcatctttgtgcacaacaccatccacctgatcagccaggtgatggacaacatggtgatggcctgtggcggcatcctgcccctgctgtctgctgccaccagcgccacccatgagctggagaacatcgagcccacccagggcctgagcattgaggcctctgtgaccttcctgcagaggctcatcagcctggtggatgtgctgatctttgccagcagcctgggcttcacagaaattgaggccgagaagtccatgagcagcggcggcatcctgcggcagtgcctgcggctggtgtgtgctgtggccgtgaggaactgcctggagtgccagcagcacagccagctgaagaccaggggggacaaggccctgaagcccatgcacagcctcatccccctgggcaagtctgctgccaagagccctgtggacatcgtgactggaggcatcagccctgtgcgggacctggaccggctgctgcaggacatggacatcaaccggctgcgggctgtggtgttccgggacatcgaggacagcaagcaggcccagttcctggccctggccgtggtgtacttcatctctgtgctgatggtgtccaagtacagagacatcctggagccccagaatgaaagacacagccagagctgcacagagaccggctctgaaaatgaaaatgtgtccctgtctgagatcaccccagctgccttcagcaccctgaccacagcctctgtggaggagagcgagagcaccagcagcgcccggcggcgggacagcggcattggagaggagacagccaccggcctgggcagccacgtggaggtgaccccccacacagcccctcctggggtgtctgctggcccagatgccatcagcgaggtgctgagcaccctgagcctggaggtgaacaagagccctgagaccaagaatgacagaggaaatgacctggacaccaaggccaccccatctgtgtctgtgtccaagaatgtgaatgtgaaggacatcctgcggagcctggtgaacatcccagcagatggagtgacagtggaccctgccctgctgcccccagcctgcctgggcgccctgggggacctgtctgtggagcagcctgtgcagttccgcagctttgacagatctgtgattgtggccgccaagaagtctgctgtgagccccagcaccttcaacaccagcatccccaccaatgctgtgtctgtggtgtcctctgtggacagcgcccaggccagtgacatgggcggggagagccctggcagccgcagcagcaatgccaagctgcccagcgtgcccaccgtggacagcgtgtcccaggaccctgtgagcaacatgagcatcacagagcggctggagcacgccctggagaaggccgcccccctgctgcgggagatctttgtggactttgcccccttcctgagcaggaccctgctgggcagccacggccaggagctgctgattgagggcaccagcctggtgtgcatgaagagcagcagctctgtggtggagctggtgatgctgctgtgcagccaggagtggcagaacagcatccagaagaatgccggcctggccttcatcgagctggtgaatgaaggccgcctgctgagccagaccatgaaggaccacctggtgcgggtggccaatgaagctgagttcatcctgagccggcagagagctgaggacatccacagacatgctgagtttgagagcctgtgtgcccagtacagcgctgacaagcgggaggatgagaagatgtgtgaccacctgatccgggccgccaagtacagagaccacgtgacagccacccagctgatccagaagatcatcaacatcctgacagacaagcatggagcctggggcaacagcgctgtgtcccggcccctggagttctggaggctggactactgggaggatgacctgcggaggagaagaagatttgtgaggaaccccctgggcagcacccaccctgaggccaccctgaagacagctgtggagcacgtgtgcatcttcaagctgcgggagaacagcaaggccacagatgaggacatcctggccaagggcaagcagagcatccgcagccaggccctgggcaaccagaacagtgaaaatgagatcctgctggagggagatgatgacaccctgagctctgtggatgagaaggacctggagaacctggccggccctgtgtccctgagcaccccagcccagctggtggcccccagcgtggtggtgaagggcaccctgtctgtgaccagcagcgagctgtactttgaggtggatgaggaggaccccaacttcaagaagattgaccccaagatcctggcctacacagagggcctgcacggcaagtggctgttcacagagatccgcagcatcttcagccgccgctacctgctgcagaacacagccctggagatcttcatggccaacagagtggccgtgatgttcaacttcccagaccctgccaccgtgaagaaggtggtgaactacctgccccgggtgggcgtgggcaccagctttggcctgccccagacccggcgcatcagcctggccagcccccggcagctgttcaaggccagcaacatgacccagcgctggcagcaccgggagatcagcaactttgagtacctgatgttcctgaacaccatcgccggccgcagctacaatgacctgaaccagtaccctgtgttcccctgggtgatcaccaactatgaaagtgaggagctggacctgaccctgcccaccaacttccgggacctgagcaagcccatcggggccctgaaccccaagagagctgccttctttgctgagagatatgagagctgggaggatgaccaggtgcccaagttccactacggcacccactacagcacagccagctttgtgctggcctggctgctgcgcatcgagcccttcaccacctacttcctgaacctgcagggcggcaagtttgaccacgccgacaggaccttcagcagcatcagccgggcctggaggaacagccagagggacaccagtgacatcaaggagctgatccctgagttctactacctgcctgagatgtttgtgaacttcaacaactacaacctgggcgtgatggatgatggcaccgtggtgtctgatgtggagctgcccccctgggccaagaccagcgaggagtttgtgcacatcaaccggctggccctggagagcgagtttgtgtcctgccagctgcaccagtggattgacctgatcttcggctacaagcagcagggccctgaggccgtgcgggccctgaatgtgttctactacctgacctatgaaggagctgtgaacctgaacagcatcacagatcctgtgctgcgggaggccgtggaggcccagatccgcagctttggccagacccccagccagctgctgattgagccccaccccccccggggcagcgccatgcaggtgagccccctgatgttcacagacaaggcccagcaggatgtgatcatggtgctgaagttccccagcaacagccctgtgacccacgtggccgccaacacccagcccggcctggccaccccagctgtgatcaccgtgacagccaaccggctgtttgctgtgaacaagtggcacaacctgcctgcccaccagggcgctgtgcaggaccagccctaccagctgcctgtggagattgaccccctgattgccagcaacacaggcatgcaccggcggcagatcacagacctgctggaccagagcatccaggtgcacagccagtgctttgtgatcaccagtgacaaccgctacatcctggtgtgtggcttctgggacaagagcttccgggtgtacagcacagacaccggccgcctcatccaggtggtgtttggccactgggatgtggtgacctgcctggcccggtctgagagctacatcggcggcaactgctacatcctgagcggcagcagagatgccaccctgctgctgtggtactggaatggcaagtgcagcggcatcggggacaaccctggcagcgagacagctgccccccgggccatcctgaccggccatgactatgaggtgacctgtgccgctgtgtgtgccgagctgggcctggtgctgagcggcagccaggagggcccctgcctgatccacagcatgaatggagacctgctgcggaccctggagggccctgagaactgcctgaagcccaagctgatccaggccagccgggagggccactgcgtcatcttctatgaaaatggcctcttctgcaccttctctgtgaatggcaagctgcaggccaccatggagacagatgacaacatccgggccatccagctgagcagagatggccagtacctgctgaccggcggggacagaggagtggtggtggtgcggcaggtgtctgacctgaagcagctgtttgcctacccaggctgtgatgctggcatccgggccatggccctgtcctatgaccagcgctgcatcatcagcggcatggccagcggcagcatcgtgctcttctacaatgacttcaaccgctggcaccacgagtaccagacccgctactag

SEQ ID NO: 35154 - DNA, 8559 bp, Artificial Sequence
  Description of Artificial Sequence: Synthetic coding sequence
atggccagcgaggacaacagagtgcccagccccccacccactggagatgatggcggcggcggcggccgggaggagacccccacagagggcggggccctgagcctgaagccaggcctgcccatccggggcatccgcatgaagtttgctgtgctgaccggcctggtggaggtgggggaggtgagcaacagagacatcgtggagaccgtcttcaacctgctggtgggcggccagtttgacctggagatgaacttcatcatccaggagggggagagcatcaactgcatggtggacctgctggagaagtgtgacatcacctgccaggccgaggtgtggagcatgttcaccgccatcctgaagaagagcatccggaacctgcaggtgtgcacagaggtgggcctggtggagaaggtgctgggcaagattgagaaggtggacaacatgattgctgacctgctggtggacatgctgggcgtgctggccagctacaacctgactgtgcgggagctgaagctgttcttcagcaagctgcagggcgacaagggccgctggccccctcatgctgggaagctgctgtctgtgctgaagcacatgccccagaagtatggcccagatgccttcttcaacttccctgggaagtctgctgctgccatcgccctgccccccatcgccaagtggccctaccagaatggcttcaccttccacacctggctgaggatggaccctgtgaacaacatcaacgtggacaaggacaagccctacctgtactgcttccgcaccagcaagggcctgggctacagcgcccactttgtgggcggctgcctgattgtgaccagcatcaagagcaagggcaagggcttccagcactgtgtgaagtttgacttcaagccccagaagtggtacatggtgaccatcgtgcacatctacaaccgctggaagaacagcgagctgcgctgctacgtgaatggagagctggccagctatggagagatcacctggtttgtgaacaccagtgacacctttgacaagtgcttcctgggcagcagcgagacagcagatgccaacagagtcttctgtggccagatgacagctgtgtacctgttcagcgaggccctgaatgctgcccagatctttgccatctaccagctgggcctgggctacaagggcaccttcaagttcaaggccgagagtgacctcttcctggccgagcaccacaagctgctgctgtatgatggcaagctgagcagcgccatcgccttcacctacaacccccgggccacagatgcccagctgtgcctggagagcagccccaaggacaaccccagcatctttgtgcacagcccccacgccctgatgctgcaggatgtgaaggctgtgctgacccacagcatccagagcgccatgcacagcatcggcggcgtgcaggtgctcttccccctgtttgcccagctggactaccggcagtacctgagtgatgaaattgacctgaccatctgcagcaccctgctggccttcatcatggagctgctgaagaacagcatcgccatgcaggagcagatgctggcctgcaagggcttcctggtgattggctacagcctggagaagagcagcaagagccacgtgtccagagctgtgctggagctgtgcctggccttcagcaagtacctgagcaacctgcagaatggcatgcccctgctgaagcagctgtgtgaccacgtgctgctgaacccagccatctggatccacaccccagccaaggtgcagctgatgctgtacacctacctgagcacagagttcatcggcaccgtgaacatctacaacaccatcagaagagtgggcaccgtgctgctgatcatgcacaccctgaagtactactactgggccgtgaacccccaggacaggagcggcatcacccccaagggcctggatggcccccggcccaaccagaaggagatgctgagcctgcgggccttcctgctgatgttcatcaagcagctggtgatgaaggacagcggcgtgaaggaggatgagctgcaggccatcctgaactacctgctgaccatgcatgaagatgacaacctgatggatgtgctgcagctgctggtggccctgatgtctgagcaccccaacagcatgatcccagcctttgaccagagaaatggcctgcgggtcatctacaagctgctggccagcaagtctgagggcatccgggtgcaggccctgaaggccatgggctacttcctgaagcacctggcccccaagaggaaggccgaggtgatgctgggccacggcctcttcagcctgctggccgagcggctgatgctgcagaccaacctgatcaccatgaccacctacaacgtgctgtttgagatcctgattgagcagatcggcacccaggtgatccacaagcagcacccagaccctgacagctctgtgaagatccagaacccccagatcctgaaggtgattgccaccctgctgaggaacagcccccagtgcccagagagcatggaggtgagaagagccttcctgagtgacatgatcaagctgttcaacaacagcagagaaaatagaagaagcctgctgcagtgcagcgtgtggcaggagtggatgctgagcctgtgctacttcaaccccaagaacagtgatgagcagaagatcacagagatggtgtatgccatcttccgcatcctgctgtaccacgctgtgaagtatgagtggggcggctggagggtgtgggtggacaccctgagcatcacccacagcaaggtgacctttgagatccacaaggagaacctggccaacatcttccgggagcagcagggcaaggtggatgaggagatcggcctgtgcagcagcacctctgtgcaggccgccagcggcatccggcgggacatcaacgtgtctgtgggcagccagcagcctgacaccaaggacagccctgtgtgcccccacttcaccaccaatggaaatgaaaacagcagcattgagaagaccagcagcctggagagcgccagcaacatcgagctgcagaccaccaacaccagctatgaggagatgaaggccgagcaggagaaccaggagctgcctgatgagggcaccctggaggagaccctgaccaatgagaccagaaatgctgatgacctggaggtgtccagtgacatcattgaagctgtggccatcagcagcaacagcttcatcaccaccgggaaggacagcatgacagtgtctgaggtgacagccagcatcagcagccccagcgaggaggatgccagcgagatgcctgagttcctggacaagagcatcgtggaggaggaggaggatgatgattatgtggagctgaaggtggagggcagccccacagaggaggccaacctgcccacagagctgcaggacaacagcctgagccctgctgccagcgaggccggggagaagctggacatgtttggaaatgatgacaagctgatcttccaggagggcaagcctgtgacagagaagcagacagacacagagacccaggacagcaaggacagcggcatccagaccatgacagccagcggcagcagcgccatgagccctgagaccaccgtgtcccagattgctgtggagagtgacctgggccagatgctggaggagggcaagaaggccaccaacctgacccgggagaccaagctgatcaatgactgccacggctctgtgtctgaggccagcagcgagcagaagatcgccaagctggatgtgtccaatgtggccacagacacagagcggctggagctgaaggccagccccaacgtggaggccccccagccccaccgccacgtgctggagatcagccggcagcacgagcagcccggccagggcatcgccccagatgctgtgaatggccagaggcgggacagccgcagcaccgtcttccgcatccctgagttcaactggagccagatgcaccagaggctgctgacagacctgctcttcagcattgaaacagacatccagatgtggaggagccacagcaccaagacagtgatggactttgtgaacagcagtgacaacgtcatctttgtgcacaacaccatccacctgatcagccaggtgatggacaacatggtgatggcctgtggcggcatcctgcccctgctgtctgctgccaccagcgccacccatgagctggagaacatcgagcccacccagggcctgagcattgaggcctctgtgaccttcctgcagaggctcatcagcctggtggatgtgctgatctttgccagcagcctgggcttcacagaaattgaggccgagaagtccatgagcagcggcggcatcctgcggcagtgcctgcggctggtgtgtgctgtggccgtgaggaactgcctggagtgccagcagcacagccagctgaagaccaggggggacaaggccctgaagcccatgcacagcctcatccccctgggcaagtctgctgccaagagccctgtggacatcgtgactggaggcatcagccctgtgcgggacctggaccggctgctgcaggacatggacatcaaccggctgcgggctgtggtgttccgggacatcgaggacagcaagcaggcccagttcctggccctggccgtggtgtacttcatctctgtgctgatggtgtccaagtacagagacatcctggagccccagaatgaaagacacagccagagctgcacagagaccggctctgaaaatgaaaatgtgtccctgtctgagatcaccccagctgccttcagcaccctgaccacagcctctgtggaggagagcgagagcaccagcagcgcccggcggcgggacagcggcattggagaggagacagccaccggcctgggcagccacgtggaggtgaccccccacacagcccctcctggggtgtctgctggcccagatgccatcagcgaggtgctgagcaccctgagcctggaggtgaacaagagccctgagaccaagaatgacagaggaaatgacctggacaccaaggccaccccatctgtgtctgtgtccaagaatgtgaatgtgaaggacatcctgcggagcctggtgaacatcccagcagatggagtgacagtggaccctgccctgctgcccccagcctgcctgggcgccctgggggacctgtctgtggagcagcctgtgcagttccgcagctttgacagatctgtgattgtggccgccaagaagtctgctgtgagccccagcaccttcaacaccagcatccccaccaatgctgtgtctgtggtgtcctctgtggacagcgcccaggccagtgacatgggcggggagagccctggcagccgcagcagcaatgccaagctgcccagcgtgcccaccgtggacagcgtgtcccaggaccctgtgagcaacatgagcatcacagagcggctggagcacgccctggagaaggccgcccccctgctgcgggagatctttgtggactttgcccccttcctgagcaggaccctgctgggcagccacggccaggagctgctgattgagggcaccagcctggtgtgcatgaagagcagcagctctgtggtggagctggtgatgctgctgtgcagccaggagtggcagaacagcatccagaagaatgccggcctggccttcatcgagctggtgaatgaaggccgcctgctgagccagaccatgaaggaccacctggtgcgggtggccaatgaagctgagttcatcctgagccggcagagagctgaggacatccacagacatgctgagtttgagagcctgtgtgcccagtacagcgctgacaagcgggaggatgagaagatgtgtgaccacctgatccgggccgccaagtacagagaccacgtgacagccacccagctgatccagaagatcatcaacatcctgacagacaagcatggagcctggggcaacagcgctgtgtcccggcccctggagttctggaggctggactactgggaggatgacctgcggaggagaagaagatttgtgaggaaccccctgggcagcacccaccctgaggccaccctgaagacagctgtggagcacgccacagatgaggacatcctggccaagggcaagcagagcatccgcagccaggccctgggcaaccagaacagtgaaaatgagatcctgctggagggagatgatgacaccctgagctctgtggatgagaaggacctggagaacctggccggccctgtgtccctgagcaccccagcccagctggtggcccccagcgtggtggtgaagggcaccctgtctgtgaccagcagcgagctgtactttgaggtggatgaggaggaccccaacttcaagaagattgaccccaagatcctggcctacacagagggcctgcacggcaagtggctgttcacagagatccgcagcatcttcagccgccgctacctgctgcagaacacagccctggagatcttcatggccaacagagtggccgtgatgttcaacttcccagaccctgccaccgtgaagaaggtggtgaactacctgccccgggtgggcgtgggcaccagctttggcctgccccagacccggcgcatcagcctggccagcccccggcagctgttcaaggccagcaacatgacccagcgctggcagcaccgggagatcagcaactttgagtacctgatgttcctgaacaccatcgccggccgcagctacaatgacctgaaccagtaccctgtgttcccctgggtgatcaccaactatgagagcgaggagctggacctgaccctgcccaccaacttccgggacctgagcaagcccatcggggccctgaaccccaagagagctgccttctttgctgagagatatgaatcctgggaggatgaccaggtgcccaagttccactacggcacccactacagcacagccagctttgtgctggcctggctgctgagaattgagcccttcaccacctacttcctgaacctgcagggcggcaagtttgaccatgctgacaggaccttcagcagcatcagccgggcctggaggaacagccagagggacaccagtgacatcaaggagctgatccctgagttctactacctgcctgagatgtttgtgaacttcaacaactacaacctgggcgtgatggatgatggcaccgtggtgtctgatgtggagctgcccccctgggccaagaccagcgaggagtttgtgcacatcaaccggctggccctggagagcgagtttgtgtcctgccagctgcaccagtggattgacctgatcttcggctacaagcagcagggccctgaggccgtgcgggccctgaatgtgttctactacctgacctatgagggcgctgtgaacctgaacagcatcacagatcctgtgctgcgggaggccgtggaggcccagatccgcagctttggccagacccccagccagctgctgattgagccccaccccccccggggcagcgccatgcaggtgagccccctgatgttcacagacaaggcccagcaggacgtcatcatggtgctgaagttccccagcaacagccctgtgacccacgtggccgccaacacccagcccggcctggccaccccagctgtgatcaccgtgacagccaacagactctttgctgtgaacaagtggcacaacctgcctgcccaccagggcgctgtgcaggaccagccctaccagctgcctgtggagattgaccccctcatcgccagcaacacaggcatgcaccggcggcagatcacagacctgctggaccagagcatccaggtgcacagccagtgcttcgtcatcaccagtgacaaccgctacatcctggtgtgtggcttctgggacaagagcttccgggtgtacagcacagacaccggccgcctcatccaggtggtgtttggccactgggatgtggtgacctgcctggcccggtctgagagctacatcggcggcaactgctacatcctgagcggcagcagagatgccaccctgctgctgtggtactggaatggaaaatgttctggaattggagacaaccctggcagcgagacagctgccccccgggccatcctgactggacatgactatgaggtgacctgtgccgctgtgtgtgccgagctgggcctggtgctgagcggcagccaggagggcccctgcctgatccacagcatgaatggagacctgctgcggaccctggagggccctgagaactgcctgaagcccaagctgatccaggccagccgggagggccactgtgtgatcttctatgaaaatggcctcttctgcaccttctctgtgaatggcaagctgcaggccaccatggagacagatgacaacatccgggccatccagctgagcagagatggccagtacctgctgactggaggagaccggggcgtggtggtggtgcggcaggtgtctgacctgaagcagctgtttgcctacccaggctgtgatgctggcatccgggccatggccctgtcctatgaccagcgctgcatcatcagcggcatggccagcggcagcatcgtgctcttctacaatgacttcaaccgctggcaccacgagtaccagacccgctactag

SEQ ID NO: 35155 - DNA, 717 bp, Artificial Sequence
  Description of Artificial Sequence: Synthetic coding sequence
atgctgggcagcccctgcctgctgtggctgctggccgtgaccttcctggtgccccgggcccagcccctggccccccaggactttgaggaggaggaggctgatgaaacagaaacagcctggccacccctgcctgctgtgccctgtgactatgaccactgccgccacctgcaggtgccctgcaaggagctgcagagggtgggccctgctgcctgcctgtgccccggcctgagcagccctgcccagcccccagacccccccaggatgggagaggtgagaattgctgctgaggagggccgggctgtggtgcactggtgtgcccccttcagccctgtgctgcactactggctgctgctgtgggatggcagcgaggccgcccagaagggcccccccctgaatgccaccgtgcggcgggcagagctgaagggcctgaagccaggcggcatctacgtggtgtgtgtggtggccgccaatgaagctggggccagccgggtgccccaggccggcggggagggcctggagggcgctgacatcccagccttcggcccctgcagccggctggccgtgccccccaaccccaggaccctggtgcacgccgctgtgggcgtgggcacagccctggccctgctgagctgtgccgccctggtgtggcacttctgcctgcgggaccgctggggctgcccccggcgggctgctgcccgggctgctggggccctgtag

SEQ ID NO: 35156 - DNA, 270 bp, Artificial Sequence
  Description of Artificial Sequence: Synthetic coding sequence
atgtgccagaaggaggtgatggagcagagcgctggcatcatgtacaggaagagctgtgccagcagcgctgcctgcctgattgccagcgctggctaccagagcttctgcagccctgggaagctgaacagcgtgtgcatcagctgctgcaacacccccctgtgcaatggcccccggcccaagaagaggggcagcagcgccagcgccctgcggcccggcctgcggaccaccatcctcttcctgaagctggccctcttcagcgcccactgctag

SEQ ID NO: 35157 - DNA, 426 bp, Artificial Sequence
  Description of Artificial Sequence: Synthetic coding sequence
atgtgggtgctgggcattgctgccaccttctgtggcctcttcctgctgcccggctttgccctgcagatccagtgctaccagtgtgaggagttccagctgaacaatgactgcagcagccctgagttcatcgtgaactgcaccgtgaatgtgcaggacatgtgccagaaggaggtgatggagcagagcgctggcatcatgtacaggaagagctgtgccagcagcgctgcctgcctgattgccagcgctggctaccagagcttctgcagccctgggaagctgaacagcgtgtgcatcagctgctgcaacacccccctgtgcaatggcccccggcccaagaagaggggcagcagcgccagcgccctgcggcccggcctgcggaccaccatcctcttcctgaagctggccctcttcagcgcccactgctag

SEQ ID NO: 35158 - DNA, 495 bp, Artificial Sequence
  Description of Artificial Sequence: Synthetic coding sequence
atgcaggccccccgggccgccccagctgcccccctgtcctatgaccggcggccccgggacagcggccgcatgtgggtgctgggcattgctgccaccttctgtggcctcttcctgctgcccggctttgccctgcagatccagtgctaccagtgtgaggagttccagctgaacaatgactgcagcagccctgagttcatcgtgaactgcaccgtgaatgtgcaggacatgtgccagaaggaggtgatggagcagagcgctggcatcatgtacaggaagagctgtgccagcagcgctgcctgcctgattgccagcgctggctaccagagcttctgcagccctgggaagctgaacagcgtgtgcatcagctgctgcaacacccccctgtgcaatggcccccggcccaagaagaggggcagcagcgccagcgccctgcggcccggcctgcggaccaccatcctcttcctgaagctggccctcttcagcgcccactgctag

SEQ ID NO: 35159 - DNA, 378 bp, Artificial Sequence
  Description of Artificial Sequence: Synthetic coding sequence
atgaggggcacccggctggccctgctggccctggtgctggccgcctgtggggagctggccccagccctgcgctgctacgtgtgcccagagcccaccggggtgtctgactgtgtgaccatcgccacctgcaccaccaatgagaccatgtgcaagaccaccctgtacagccgggagatcgtgtaccccttccagggcgacagcacagtgaccaagagctgtgccagcaagtgcaagcccagtgatgtggatggcatcggccagaccctgcctgtgtcctgctgcaacacagagctgtgcaatgtggatggagccccagccctgaacagcctgcactgtggggccctgaccctgctgcccctgctgagcctgcggctgtag

SEQ ID NO: 35160 - DNA, 741 bp, Artificial Sequence
  Description of Artificial Sequence: Synthetic coding sequence
atgggcccccagcacctgcggctggtgcagctgttctgcctgctgggcgccatcagcaccctgccccgggccggggccctgctgtgctatgaggccacagccagccgcttccgggctgtggccttccacaactggaagtggctgctgatgaggaacatggtgtgcaagctgcaggagggctgtgaggagaccctggtgttcatcgagaccggcacagcccggggcgtggtgggcttcaagggctgcagcagcagcagcagctacccagcccagatctcctacctggtgagccccccaggagtgtccatcgccagctacagccgggtgtgccgcagctacctgtgcaacaacctgaccaacctggagccctttgtgaagctgaaggccagcacccccaagagcatcaccagcgccagctgcagctgccccacctgtgtgggggagcacatgaaggactgcctgcccaactttgtgaccaccaacagctgccccctggccgccagcacctgctacagcagcaccctgaagttccaggccggcttcctgaacaccaccttcctgctgatgggctgtgcccgggagcacaaccagctgctggccgacttccaccacatcggcagcatcaaggtgacagaggtgctgaacatcctggagaagagccagatcgtgggcgccgccagcagccggcaggaccctgcctggggcgtggtgctgggcctgctgtttgccttccgggactag

SEQ ID NO: 35161 - DNA, 636 bp, Artificial Sequence
  Description of Artificial Sequence: Synthetic coding sequence
atgggcccccagcacctgcggctggtgcagctgttctgcctgctgggcgccatcagcaccctgcccaggatgagctgtggggccggctgctacaagacccagaagggcacagcccggggcgtggtgggcttcaagggctgcagcagcagcagcagctacccagcccagatctcctacctggtgtccccacctggggtgtccatcgccagctacagccgggtgtgccgcagctacctgtgcaacaacctgaccaacctggagccctttgtgaagctgaaggccagcacccccaagagcatcaccagcgccagctgcagctgccccacctgtgtgggggagcacatgaaggactgcctgcccaactttgtgaccaccaacagctgccccctggccgccagcacctgctacagcagcaccctgaagttccaggccggcttcctgaacaccaccttcctgctgatgggctgtgcccgggagcacaaccagctgctggccgacttccaccacatcggcagcatcaaggtgacagaggtgctgaacatcctggagaagagccagatcgtgggcgccgccagcagccggcaggaccctgcctggggcgtggtgctgggcctgctgtttgccttccgggactag

SEQ ID NO: 35162 - DNA, 756 bp, Artificial Sequence
  Description of Artificial Sequence: Synthetic coding sequence
atggccatgggcgtgcccagggtcatcctgctgtgcctgtttggagctgccctgtgcctgaccggcagccaggccctgcagtgctacagctttgagcacacctacttcggcccctttgacctgcgggccatgaagctgcccagcatcagctgcccccatgagtgctttgaggccatcctgagcctggacaccggctaccgggcccctgtgaccctggtgaggaagggctgctggacaggccccccagctggccagacccagagcaatgctgatgccctgcccccagactacagcgtggtgcggggctgcaccacagacaagtgcaatgcccacctgatgacccatgatgccctgcccaacctgagccaggccccagacccccccaccctgtctggagctgagtgctacgcctgcattggagtgcaccaggatgactgtgccatcggccgcagccggcgggtgcagtgccaccaggaccagacagcctgcttccagggcaatggaaggatgacagtgggcaacttctctgtgcctgtgtacatccgcacctgccaccggcccagctgcaccacagagggcaccaccagcccctggacagccatcgacctgcagggcagctgctgtgagggctacctgtgcaacaggaagtccatgacccagcccttcaccagcgccagcgccaccaccccaccccgggccctgcaggtgctggccctgctgctgcctgtgctgctgctggtgggcctgagcgcctag

SEQ ID NO: 35163 - DNA, 627 bp, Artificial Sequence
  Description of Artificial Sequence: Synthetic coding sequence
atgaagctgcccagcatcagctgcccccatgaatgttttgaggccatcctgagcctggacaccggctaccgggcccctgtgaccctggtgaggaagggctgctggacaggccccccagctggccagacccagagcaatgctgatgccctgcccccagactacagcgtggtgcggggctgcaccacagacaagtgcaatgcccacctgatgacccatgatgccctgcccaacctgagccaggccccagacccccccaccctgagcggggctgaatgttatgcctgcatcggcgtgcaccaggatgactgtgccatcggccgcagcagaagagtgcagtgccaccaggaccagacagcctgcttccagggcaatggccgcatgacagtgggcaacttctctgtgcctgtgtacatccgcacctgccaccggcccagctgcaccacagagggcaccaccagcccctggacagccatcgacctgcagggcagctgctgtgagggctacctgtgcaacaggaagtccatgacccagcccttcaccagcgccagcgccaccaccccaccccgggccctgcaggtgctggccctgctgctgcctgtgctgctgctggtgggcctgagcgcctag

SEQ ID NO: 35164 - DNA, 624 bp, Artificial Sequence
  Description of Artificial Sequence: Synthetic coding sequence
atgaggctcatcaccctgagcgccaacctcttcaccgtgcctgagaggagcctgaccaccaccttctccttcagccgctacaagagcagtgacaggcctgcccacaaggtgtccatgctgctgctgtgccacgccctggccatcgctgtggtgcagatcgtcatcttcagcgagagctgggcctttgccaagaacatcaacttctacaacgtgcggccccccctggaccccacccccttccccaacagcttcaagtgcttcacctgtgaaaatgctggggacaactacaactgcaaccgctgggccgaggacaagtggtgcccccagaacacccagtactgcctgactgtgcaccacttcaccagccacggccgcagcaccagcatcaccaagaagtgtgccagccgctctgagtgccactttgtgggctgccaccacagccgggacagcgagcacacagagtgccgcagctgctgtgagggcatgatctgcaatgtggagctgcccaccaaccacaccaatgctgtgtttgctgtgatgcacgcccagaggaccagcggcagcagcgcccccaccctgtacctgcctgtgctggcctgggtgtttgtgctgcccctgctgtag

SEQ ID NO: 35165 - DNA, 552 bp, Artificial Sequence
  Description of Artificial Sequence: Synthetic coding sequence
atgctgtacaagagcagtgacaggcctgcccacaaggtgtccatgctgctgctgtgccacgccctggccatcgctgtggtgcagatcgtcatcttcagcgagagctgggcctttgccaagaacatcaacttctacaacgtgcggccccccctggaccccacccccttccccaacagcttcaagtgcttcacctgtgaaaatgctggggacaactacaactgcaaccgctgggccgaggacaagtggtgcccccagaacacccagtactgcctgactgtgcaccacttcaccagccacggccgcagcaccagcatcaccaagaagtgtgccagccgctctgagtgccactttgtgggctgccaccacagccgggacagcgagcacacagagtgccgcagctgctgtgagggcatgatctgcaatgtggagctgcccaccaaccacaccaatgctgtgtttgctgtgatgcacgcccagaggaccagcggcagcagcgcccccaccctgtacctgcctgtgctggcctgggtgtttgtgctgcccctgctgtag

SEQ ID NO: 35166 - DNA, 624 bp, Artificial Sequence
  Description of Artificial Sequence: Synthetic coding sequence
atgctgctgatcaccctgagcgccaacctcttcaccgtgcctgagaggagcctgaccaccaccttctccttcagccgctacaagagcagtgacaggcctgcccacaaggtgtccatgctgctgctgtgccacgccctggccatcgctgtggtgcagatcgtcatcttcagcgagagctgggcctttgccaagaacatcaacttctacaacgtgcggccccccctggaccccacccccttccccaacagcttcaagtgcttcacctgtgaaaatgctggggacaactacaactgcaaccgctgggccgaggacaagtggtgcccccagaacacccagtactgcctgactgtgcaccacttcaccagccacggccgcagcaccagcatcaccaagaagtgtgccagccgctctgagtgccactttgtgggctgccaccacagccgggacagcgagcacacagagtgccgcagctgctgtgagggcatgatctgcaatgtggagctgcccaccaaccacaccaatgctgtgtttgctgtgatgcacgcccagaggaccagcggcagcagcgcccccaccctgtacctgcctgtgctggcctgggtgtttgtgctgcccctgctgtag

SEQ ID NO: 35167 - DNA, 552 bp, Artificial Sequence; identical to SEQ ID NO: 35165
  Description of Artificial Sequence: Synthetic coding sequence

SEQ ID NO: 35168 - DNA, 378 bp, Artificial Sequence
  Description of Artificial Sequence: Synthetic coding sequence
atgaaggccctgatgctgctgaccctgtctgtgctgctgtgctgggtgtctgctgacatccgctgccacagctgctacaaggtgcctgtgctgggctgtgtggaccggcagagctgccgcctggagcccggccagcagtgcctgaccacccacgcctacctgggcaagatgtgggtgttcagcaacctgcgctgtggcaccccagaggagccctgccaggaggccttcaaccagaccaacaggaagctgggcctgacctacaacaccacctgctgcaacaaggacaactgcaacagcgctggcccccggcccaccccagccctgggcctggtgttcctgaccagcctggccggcctgggcctgtggctgctgcactag

SEQ ID NO: 35169 - DNA, 378 bp, Artificial Sequence; identical to SEQ ID NO: 35168
  Description of Artificial Sequence: Synthetic coding sequence

SEQ ID NO: 35170 - DNA, 378 bp, Artificial Sequence; identical to SEQ ID NO: 35168
  Description of Artificial Sequence: Synthetic coding sequence

SEQ ID NO: 35171 - DNA, 378 bp, Artificial Sequence; identical to SEQ ID NO: 35168
  Description of Artificial Sequence: Synthetic coding sequence

SEQ ID NO: 35172 - DNA, 378 bp, Artificial Sequence; identical to SEQ ID NO: 35168
  Description of Artificial Sequence: Synthetic coding sequence

SEQ ID NO: 35173 - DNA, 378 bp, Artificial Sequence; identical to SEQ ID NO: 35168
  Description of Artificial Sequence: Synthetic coding sequence

SEQ ID NO: 35174 - DNA, 378 bp, Artificial Sequence; identical to SEQ ID NO: 35168
  Description of Artificial Sequence: Synthetic coding sequence

SEQ ID NO: 35175 - DNA, 210 bp, Artificial Sequence
  Description of Artificial Sequence: Synthetic coding sequence
atgtgggtgttcagcaacctgcgctgtggcaccccagaggagccctgccaggaggccttcaaccagaccaacaggaagctgggcctgacctacaacaccacctgctgcaacaaggacaactgcaacagcgctggcccccggcccaccccagccctgggcctggtgttcctgaccagcctggccggcctgggcctgtggctgctgcactag

SEQ ID NO: 35176 - DNA, 210 bp, Artificial Sequence; identical to SEQ ID NO: 35175
  Description of Artificial Sequence: Synthetic coding sequence

SEQ ID NO: 35177 - DNA, 894 bp, Artificial Sequence
  Description of Artificial Sequence: Synthetic coding sequence
atggctgtgctcttcctgctgctcttcctgtgtggcaccccccaggccgctgacaacatgcaggccatctacgtggccctgggggaggccgtggagctgccctgccccagcccccccaccctgcatggagatgagcacctgtcctggttctgcagccctgctgctggcagcttcaccaccctggtggcccaggtgcaggtgggccggcctgccccagaccccgggaagccaggccgggagagccggctgcggctgctgggcaactacagcctgtggctggagggcagcaaggaggaggatgctggccgctactggtgtgctgtgctgggccagcaccacaactaccagaactggagggtgtatgatgtgctggtgctgaagggcagccagctgagcgcccgggcagcagatggcagcccctgcaatgtgctgctgtgcagcgtggtgcccagcaggaggatggacagcgtgacctggcaggagggcaaaggacctgtgcggggccgggtgcagagcttctggggcagcgaggccgccctgctgctggtgtgccctggagagggcctgtctgagcccaggagcagaagaccccgcatcatccgctgcctgatgacccacaacaagggcgtgtccttcagcctggccgccagcattgatgccagccctgccctgtgtgcccccagcacaggctgggacatgccctggatcctgatgctgctgctgaccatgggccagggcgtggtgatcctggccctgagcatcgtgctgtggaggcagagggtgcggggggcccctggaagagatgccagcatcccccagttcaagccagagatccaggtgtatgagaacatccacctggcccggctgggccccccagcccacaagcccaggtag

SEQ ID NO: 35178 - DNA, 894 bp, Artificial Sequence; identical to SEQ ID NO: 35177
  Description of Artificial Sequence: Synthetic coding sequence

SEQ ID NO: 35179 - DNA, 894 bp, Artificial Sequence; identical to SEQ ID NO: 35177
  Description of Artificial Sequence: Synthetic coding sequence

SEQ ID NO: 35180 - DNA, 894 bp, Artificial Sequence; identical to SEQ ID NO: 35177
  Description of Artificial Sequence: Synthetic coding sequence

SEQ ID NO: 35181 - DNA, 894 bp, Artificial Sequence; identical to SEQ ID NO: 35177
  Description of Artificial Sequence: Synthetic coding sequence

SEQ ID NO: 35182 - DNA, 1149 bp, Artificial Sequence
  Description of Artificial Sequence: Synthetic coding sequence
atggctgtgctcttcctgctgctcttcctgtgtggcaccccccaggccgctgacaacatgcaggccatctacgtggccctgggggaggccgtggagctgccctgccccagcccccccaccctgcatggagatgagcacctgtcctggttctgcagccctgctgctggcagcttcaccaccctggtggcccaggtgcaggtgggccggcctgccccagaccccgggaagccaggccgggagagccggctgcggctgctgggcaactacagcctgtggctggagggcagcaaggaggaggatgctggccgctactggtgtgctgtgctgggccagcaccacaactaccagaactggagggtgtatgatgtgctggtgctgaagggcagccagctgagcgcccgggcagcagatggcagcccctgcaatgtgctgctgtgcagcgtggtgcccagcaggaggatggacagcgtgacctggcaggagggcaaaggacctgtgcggggccgggtgcagagcttctggggcagcgaggccgccctgctgctggtgtgccctggagagggcctgtctgagcccaggagcagaagaccccgcatcatccgctgcctgatgacccacaacaagggcgtgtccttcagcctggccgccagcattgatgccagccctgccctgtgtgcccccagcacaggctgggacatgccctggatcctgatgctgctgctgaccatgggccagggcgtggtgatcctggccctgagcatcgtgctgtggaggcagagggtgcggggggcccctggccggggcaacaggatgcgctgctacaactgtggcggcagccccagcagcagctgcaaggaggccgtgaccacctgtggggagggccggccccagcccggcctggagcagatcaagctgcccggcaacccccctgtgaccctcatccaccagcacccagcctgtgtggccgcccaccactgcaaccaggtggagacagaatctgtgggagatgtgacctacccagcccaccgggactgctacctgggggacctgtgcaacagcgctgtggccagccacgtggccccagctggcatcctggccgccgccgccacagccctgacctgcctgctgcccggcctgtggagcggctag

SEQ ID NO: 35183 - DNA, 1149 bp, Artificial Sequence; identical to SEQ ID NO: 35182
  Description of Artificial Sequence: Synthetic coding sequence

SEQ ID NO: 35184 - DNA, 1149 bp, Artificial Sequence; identical to SEQ ID NO: 35182
  Description of Artificial Sequence: Synthetic coding sequence

SEQ ID NO: 35185 - DNA, 5169 bp, Artificial Sequence
  Description of Artificial Sequence: Synthetic coding sequence
atgaggacaggctgggccaccccaagaagacctgctggcctgctgatgctgctcttctggttctttgacctggccgagcccagcggccgggccgccaatgaccccttcaccatcgtgcacggcaacacaggcaagtgcatcaagcctgtgtatggctggatcgtggctgatgactgtgatgaaacagaggacaagctgtggaagtgggtgtcccagcacaggctcttccacctgcacagccagaagtgcctgggcctggacatcaccaagtctgtgaatgagctgaggatgttcagctgtgacagcagcgccatgctgtggtggaagtgtgagcaccacagcctgtatggagctgcccgctaccgcctggccctgaaggatggccatggaacagccatcagcaatgccagtgatgtgtggaagaagggcggcagcgaggagagcctgtgtgaccagccctaccacgagatctacaccagagatggcaacagctatggccggccctgtgagttccccttcctgattgatggcacctggcaccacgactgcatcctggatgaggaccacagcggcccctggtgtgccaccaccctgaactatgaatatgacaggaagtggggcatctgcctgaagccagaaaatggctgtgaggacaactgggagaagaatgagcagtttggcagctgctaccagttcaacacccagacagccctgtcctggaaggaggcctacgtgtcctgccagaaccagggcgctgacctgctgagcatcaacagcgctgctgagctgacctacctgaaggagaaggagggcatcgccaagatcttctggattggcctgaaccagctgtacagcgcccggggctgggagtggagcgaccacaagcccctgaacttcctgaactgggaccctgaccggcccagcgcccccaccatcggcggcagcagctgtgccaggatggatgctgagagcggcctgtggcagagcttcagctgtgaggcccagctgccctacgtgtgcaggaagcccctgaacaacacagtggagctgacagatgtgtggacctacagcgacacccgctgtgatgctggctggctgcccaacaacggcttctgctacctgctggtgaatgaaagcaacagctgggacaaggcccacgccaagtgcaaggccttcagcagtgacctgatcagcatccacagcctggctgatgtggaggtggtggtgaccaagctgcacaatgaagacatcaaggaggaggtgtggattggcctgaagaacatcaacatccccaccctcttccagtggagcgatggaacagaggtgaccctgacctactgggatgaaaatgagcccaacgtgccctacaacaagacccccaactgtgtgtcctacctgggggagctgggccagtggaaggtgcagagctgtgaggagaagctgaagtatgtgtgcaagaggaagggggagaagctgaatgatgccagcagtgacaagatgtgccccccagatgagggctggaagagacatggagagacctgctacaagatctatgaagatgaggtgcccttcggcaccaactgcaacctgaccatcaccagcagatttgagcaggagtacctgaatgacctgatgaagaagtatgacaagagcctgaggaagtacttctggacaggcctgagagatgtggacagctgtggggagtacaactgggccaccgtgggcggcagaagaagagctgtgaccttcagcaactggaacttcctggagcccgccagccctgggggctgtgtggccatgagcacaggcaagtctgtgggcaagtgggaggtgaaggactgccgctccttcaaggccctgagcatctgcaagaagatgagcggccccctgggccctgaggaggccagccccaagccagatgacccctgcccagagggctggcagagcttccctgccagcctgagctgctacaaggtgttccacgccgagagaattgtgaggaagaggaactgggaggaggccgagcgcttctgccaggccctgggcgcccacctgagcagcttcagccacgtggatgagatcaaggagttcctgcacttcctgacagaccagttcagcggccagcactggctgtggattggcctgaacaagaggagcccagacctgcagggctcctggcagtggagcgacaggacccctgtgtccaccatcatcatgcccaatgagttccagcaggactatgacatccgggactgtgccgctgtgaaggtgttccaccggccctggaggcggggctggcacttctatgatgaccgggagttcatctacctgcggccctttgcctgtgacaccaagctggagtgggtgtgccagatccccaagggccgcacccccaagaccccagactggtacaacccagacagagctggcatccacggccccccactcatcatcgagggcagcgagtactggtttgtggccgacctgcacctgaactatgaggaggccgtgctgtactgtgccagcaaccacagcttcctggccaccatcaccagctttgtgggcctgaaggccatcaagaacaagatcgccaacatctctggagatggccagaagtggtggatccgcatcagcgagtggcccattgatgaccacttcacctacagccgctacccctggcaccgcttccctgtgaccttcggggaggagtgcctgtacatgtctgccaagacctggctgattgacctgggcaagcccacagactgcagcaccaagctgcccttcatctgtgagaagtacaacgtgagcagcctggagaagtacagcccagattctgctgccaaggtgcagtgcagcgagcagtggatccccttccagaacaagtgcttcctgaagatcaagcctgtgtccctgaccttcagccaggccagtgacacctgccacagctatggaggcaccctgcccagcgtgctgagccagatcgagcaggacttcatcaccagcctgctgcctgacatggaggccaccctgtggattggcctgcgctggacagcctatgagaagatcaacaagtggacagacaaccgggagctgacctacagcaacttccaccccctgctggtgtctggccgcctgcgcatccctgagaacttctttgaggaggagagccgctaccactgtgccctgatcctgaacctgcagaagagccccttcaccggcacctggaacttcaccagctgcagcgagcggcactttgtgtccctgtgccagaagtacagcgaggtgaagagccggcagaccctgcagaatgccagcgagaccgtgaagtacctgaacaacctgtacaagatcatccccaagaccctgacctggcacagcgccaagcgggagtgcctgaagagcaacatgcagctggtgtccatcacagacccctaccagcaggccttcctgtctgtgcaggccctgctgcacaacagcagcctgtggattggcctcttcagccaggatgatgagctgaactttggctggagcgatggcaagaggctgcacttcagccgctgggccgagaccaacggccagctggaggactgtgtggtgctggacacagatggcttctggaagacagtggactgcaatgacaaccagcccggggccatctgctactacagcggaaatgaaacagagaaggaggtgaagcctgtggacagcgtgaagtgccccagccctgtgctgaacaccccctggatccccttccagaactgctgctacaacttcatcatcaccaagaacagacacatggccaccacccaggatgaggtgcacaccaagtgccagaagctgaaccccaagagccacatcctgagcatcagagatgagaaggagaacaactttgtgctggagcagctgctgtacttcaactacatggcctcctgggtgatgctgggcatcacctacagaaacaagagcctgatgtggtttgacaagacccccctgagctacacccactggagggctggccggcccaccatcaagaatgagaagttcctggccggcctgagcacagatggcttctgggacatccagaccttcaaggtgattgaggaggccgtgtacttccaccagcacagcatcctggcctgcaagattgagatggtggactacaaggaggagtacaacaccaccctgccccagttcatgccctatgaagatggcatctacagcgtcatccagaagaaggtgacctggtatgaggccctgaacatgtgcagccagagcggcggccacctggcctctgtgcacaaccagaatggccagctgttcctggaggacatcgtgaagagagatggcttccccctgtgggtgggcctgagcagccatgatggcagcgagagcagctttgagtggagcgatggcagcacctttgactacatcccctggaagggccagaccagccctggcaactgtgtgctgctggaccccaagggcacctggaagcatgagaagtgcaacagcgtgaaggatggagccatctgctacaagcccaccaagagcaagaagctgagccggctgacctacagcagccgctgcccagctgccaaggaaaatggcagccgctggatccagtacaagggccactgctacaagagtgaccaggccctgcacagcttcagcgaggccaagaagctgtgcagcaagcatgaccacagcgccaccatcgtgtccatcaaggatgaagatgagaacaagtttgtgtcccggctgatgagggagaacaacaacatcaccatgagggtgtggctgggcctgagccagcacagcgtggaccagagctggagctggctggatggcagcgaggtgacctttgtgaagtgggagaacaagagcaagagcggcgtgggccgctgcagcatgctgattgccagcaatgagacctggaagaaggtggagtgtgagcacggcttcggccgggtggtgtgcaaggtgcccctgggccctgactacacagccatcgccatcatcgtggccaccctgagcatcctggtgctgatgggcggcctcatctggttcctgttccagaggcaccggctgcacctggccggcttcagctctgtgcgctatgcccagggcgtgaatgaagatgagatcatgctgcccagcttccatgactag

SEQ ID NO: 35186 - DNA, 5454 bp, Artificial Sequence
  Description of Artificial Sequence: Synthetic coding sequence
atgaggacaggctgggccaccccaagaagacctgctggcctgctgatgctgctcttctggttctttgacctggccgagcccagcggccgggccgccaatgaccccttcaccatcgtgcacggcaacacaggcaagtgcatcaagcctgtgtatggctggatcgtggctgatgactgtgatgaaacagaggacaagctgtggaagtgggtgtcccagcacaggctcttccacctgcacagccagaagtgcctgggcctggacatcaccaagtctgtgaatgagctgaggatgttcagctgtgacagcagcgccatgctgtggtggaagtgtgagcaccacagcctgtatggagctgcccgctaccgcctggccctgaaggatggccatggaacagccatcagcaatgccagtgatgtgtggaagaagggcggcagcgaggagagcctgtgtgaccagccctaccacgagatctacaccagagatggcaacagctatggccggccctgtgagttccccttcctgattgatggcacctggcaccacgactgcatcctggatgaggaccacagcggcccctggtgtgccaccaccctgaactatgaatatgacaggaagtggggcatctgcctgaagccagaaaatggctgtgaggacaactgggagaagaatgagcagtttggcagctgctaccagttcaacacccagacagccctgtcctggaaggaggcctacgtgtcctgccagaaccagggcgctgacctgctgagcatcaacagcgctgctgagctgacctacctgaaggagaaggagggcatcgccaagatcttctggattggcctgaaccagctgtacagcgcccggggctgggagtggagcgaccacaagcccctgaacttcctgaactgggaccctgaccggcccagcgcccccaccatcggcggcagcagctgtgccaggatggatgctgagagcggcctgtggcagagcttcagctgtgaggcccagctgccctacgtgtgcaggaagcccctgaacaacacagtggagctgacagatgtgtggacctacagcgacacccgctgtgatgctggctggctgcccaacaacggcttctgctacctgctggtgaatgaaagcaacagctgggacaaggcccacgccaagtgcaaggccttcagcagtgacctgatcagcatccacagcctggctgatgtggaggtggtggtgaccaagctgcacaatgaagacatcaaggaggaggtgtggattggcctgaagaacatcaacatccccaccctcttccagtggagcgatggaacagaggtgaccctgacctactgggatgaaaatgagcccaacgtgccctacaacaagacccccaactgtgtgtcctacctgggggagctgggccagtggaaggtgcagagctgtgaggagaagctgaagtatgtgtgcaagaggaagggggagaagctgaatgatgccagcagtgacaagatgtgccccccagatgagggctggaagagacatggagagacctgctacaagatctatgaagatgaggtgcccttcggcaccaactgcaacctgaccatcaccagcagatttgagcaggagtacctgaatgacctgatgaagaagtatgacaagagcctgaggaagtacttctggacaggcctgagagatgtggacagctgtggggagtacaactgggccaccgtgggcggcagaagaagagctgtgaccttcagcaactggaacttcctggagcccgccagccctgggggctgtgtggccatgagcacaggcaagtctgtgggcaagtgggaggtgaaggactgccgctccttcaaggccctgagcatctgcaagaagatgagcggccccctgggccctgaggaggccagccccaagccagatgacccctgcccagagggctggcagagcttccctgccagcctgagctgctacaaggtgttccacgccgagagaattgtgaggaagaggaactgggaggaggccgagcgcttctgccaggccctgggcgcccacctgagcagcttcagccacgtggatgagatcaaggagttcctgcacttcctgacagaccagttcagcggccagcactggctgtggattggcctgaacaagaggagcccagacctgcagggctcctggcagtggagcgacaggacccctgtgtccaccatcatcatgcccaatgagttccagcaggactatgacatccgggactgtgccgctgtgaaggtgttccaccggccctggaggcggggctggcacttctatgatgaccgggagttcatctacctgcggccctttgcctgtgacaccaagctggagtgggtgtgccagatccccaagggccgcacccccaagaccccagactggtacaacccagacagagctggcatccacggccccccactcatcatcgagggcagcgagtactggtttgtggccgacctgcacctgaactatgaggaggccgtgctgtactgtgccagcaaccacagcttcctggccaccatcaccagctttgtgggcctgaaggccatcaagaacaagatcgccaacatctctggagatggccagaagtggtggatccgcatcagcgagtggcccattgatgaccacttcacctacagccgctacccctggcaccgcttccctgtgaccttcggggaggagtgcctgtacatgtctgccaagacctggctgattgacctgggcaagcccacagactgcagcaccaagctgcccttcatctgtgagaagtacaacgtgagcagcctggagaagtacagcccagattctgctgccaaggtgcagtgcagcgagcagtggatccccttccagaacaagtgcttcctgaagatcaagcctgtgtccctgaccttcagccaggccagtgacacctgccacagctatggaggcaccctgcccagcgtgctgagccagatcgagcaggacttcatcaccagcctgctgcctgacatggaggccaccctgtggattggcctgcgctggacagcctatgagaagatcaacaagtggacagacaaccgggagctgacctacagcaacttccaccccctgctggtgtctggccgcctgcgcatccctgagaacttctttgaggaggagagccgctaccactgtgccctgatcctgaacctgcagaagagccccttcaccggcacctggaacttcaccagctgcagcgagcggcactttgtgtccctgtgccagaagtacagcgaggtgaagagccggcagaccctgcagaatgccagcgagaccgtgaagtacctgaacaacctgtacaagatcatccccaagaccctgacctggcacagcgccaagcgggagtgcctgaagagcaacatgcagctggtgtccatcacagacccctaccagcaggccttcctgtctgtgcaggccctgctgcacaacagcagcctgtggattggcctcttcagccaggatgatgagctgaactttggctggagcgatggcaagaggctgcacttcagccgctgggccgagaccaacggccagctggaggactgtgtggtgctggacacagatggcttctggaagacagtggactgcaatgacaaccagcccggggccatctgctactacagcggaaatgaaacagagaaggaggtgaagcctgtggacagcgtgaagtgccccagccctgtgctgaacaccccctggatccccttccagaactgctgctacaacttcatcatcaccaagaacagacacatggccaccacccaggatgaggtgcacaccaagtgccagaagctgaaccccaagagccacatcctgagcatcagagatgagaaggagaacaactttgtgctggagcagctgctgtacttcaactacatggcctcctgggtgatgctgggcatcacctacagaaacaagagcctgatgtggtttgacaagacccccctgagctacacccactggagggctggccggcccaccatcaagaatgagaagttcctggccggcctgagcacagatggcttctgggacatccagaccttcaaggtgattgaggaggccgtgtacttccaccagcacagcatcctggcctgcaagattgagatggtggactacaaggaggagtacaacaccaccctgccccagttcatgccctatgaagatggcatctacagcgtcatccagaagaaggtgacctggtatgaggccctgaacatgtgcagccagagcggcggccacctggcctctgtgcacaaccagaatggccagctgttcctggaggacatcgtgaagagagatggcttccccctgtgggtgggcctgagcagccatgatggcagcgagagcagctttgagtggagcgatggcagcacctttgactacatcccctggaagggccagaccagccctggcaactgtgtgctgctggaccccaagggcacctggaagcatgagaagtgcaacagcgtgaaggatggagccatctgctacaagcccaccaagagcaagaagctgagccggctgacctacagcagccgctgcccagctgccaaggaaaatggcagccgctggatccagtacaagggccactgctacaagagtgaccaggccctgcacagcttcagcgaggccaagaagctgtgcagcaagcatgaccacagcgccaccatcgtgtccatcaaggatgaagatgagaacaagtttgtgtcccggctgatgagggagaacaacaacatcaccatgagggtgtggctgggcctgagccagcacagcgtggactgccccagcagcacctggatccagttccaggacagctgctacatcttcctgcaggaggccatcaaggtggagagcattgaagatgtgaggaaccagtgcacagaccacggggctgacatgatcagcatccacaatgaggaggagaatgccttcatcctggacaccctgaagaagcagtggaagggcccagatgacatcctgctgggcatgttttatgacacagatgatgccagcttcaagtggtttgacaacagcaacatgacctttgacaagtggacagaccaggatgatgatgaggacctggtggacacctgtgccttcctgcacatcaagacaggagagtggaagaagggcaactgtgaggtgtcctctgtggagggcaccctgtgcaagacagccatcccctacaagaggaagtacctgagtgacaaccacatcctgatcagcgccctggtgattgccagcaccgtcatcctgactgtgctgggcgccatcatctggttcctgtacaagaagcacagcgacagccgcttcaccaccgtcttcagcacagccccccagagcccctacaatgaagactgtgtgctggtggtgggggaggagaatgagtaccctgtgcagtttgattag

SEQ ID NO: 35187 - DNA, 5622 bp, Artificial Sequence
  Description of Artificial Sequence: Synthetic coding sequence
atgaggacaggctgggccaccccaagaagacctgctggcctgctgatgctgctcttctggttctttgacctggccgagcccagcggccgggccgccaatgaccccttcaccatcgtgcacggcaacacaggcaagtgcatcaagcctgtgtatggctggatcgtggctgatgactgtgatgaaacagaggacaagctgtggaagtgggtgtcccagcacaggctcttccacctgcacagccagaagtgcctgggcctggacatcaccaagtctgtgaatgagctgaggatgttcagctgtgacagcagcgccatgctgtggtggaagtgtgagcaccacagcctgtatggagctgcccgctaccgcctggccctgaaggatggccatggaacagccatcagcaatgccagtgatgtgtggaagaagggcggcagcgaggagagcctgtgtgaccagccctaccacgagatctacaccagagatggcaacagctatggccggccctgtgagttccccttcctgattgatggcacctggcaccacgactgcatcctggatgaggaccacagcggcccctggtgtgccaccaccctgaactatgaatatgacaggaagtggggcatctgcctgaagccagaaaatggctgtgaggacaactgggagaagaatgagcagtttggcagctgctaccagttcaacacccagacagccctgtcctggaaggaggcctacgtgtcctgccagaaccagggcgctgacctgctgagcatcaacagcgctgctgagctgacctacctgaaggagaaggagggcatcgccaagatcttctggattggcctgaaccagctgtacagcgcccggggctgggagtggagcgaccacaagcccctgaacttcctgaactgggaccctgaccggcccagcgcccccaccatcggcggcagcagctgtgccaggatggatgctgagagcggcctgtggcagagcttcagctgtgaggcccagctgccctacgtgtgcaggaagcccctgaacaacacagtggagctgacagatgtgtggacctacagcgacacccgctgtgatgctggctggctgcccaacaacggcttctgctacctgctggtgaatgaaagcaacagctgggacaaggcccacgccaagtgcaaggccttcagcagtgacctgatcagcatccacagcctggctgatgtggaggtggtggtgaccaagctgcacaatgaagacatcaaggaggaggtgtggattggcctgaagaacatcaacatccccaccctcttccagtggagcgatggaacagaggtgaccctgacctactgggatgaaaatgagcccaacgtgccctacaacaagacccccaactgtgtgtcctacctgggggagctgggccagtggaaggtgcagagctgtgaggagaagctgaagtatgtgtgcaagaggaagggggagaagctgaatgatgccagcagtgacaagatgtgccccccagatgagggctggaagagacatggagagacctgctacaagatctatgaagatgaggtgcccttcggcaccaactgcaacctgaccatcaccagcagatttgagcaggagtacctgaatgacctgatgaagaagtatgacaagagcctgaggaagtacttctggacaggcctgagagatgtggacagctgtggggagtacaactgggccaccgtgggcggcagaagaagagctgtgaccttcagcaactggaacttcctggagcccgccagccctgggggctgtgtggccatgagcacaggcaagtctgtgggcaagtgggaggtgaaggactgccgctccttcaaggccctgagcatctgcaagaagatgagcggccccctgggccctgaggaggccagccccaagccagatgacccctgcccagagggctggcagagcttccctgccagcctgagctgctacaaggtgttccacgccgagagaattgtgaggaagaggaactgggaggaggccgagcgcttctgccaggccctgggcgcccacctgagcagcttcagccacgtggatgagatcaaggagttcctgcacttcctgacagaccagttcagcggccagcactggctgtggattggcctgaacaagaggagcccagacctgcagggctcctggcagtggagcgacaggacccctgtgtccaccatcatcatgcccaatgagttccagcaggactatgacatccgggactgtgccgctgtgaaggtgttccaccggccctggaggcggggctggcacttctatgatgaccgggagttcatctacctgcggccctttgcctgtgacaccaagctggagtgggtgtgccagatccccaagggccgcacccccaagaccccagactggtacaacccagacagagctggcatccacggccccccactcatcatcgagggcagcgagtactggtttgtggccgacctgcacctgaactatgaggaggccgtgctgtactgtgccagcaaccacagcttcctggccaccatcaccagctttgtgggcctgaaggccatcaagaacaagatcgccaacatctctggagatggccagaagtggtggatccgcatcagcgagtggcccattgatgaccacttcacctacagccgctacccctggcaccgcttccctgtgaccttcggggaggagtgcctgtacatgtctgccaagacctggctgattgacctgggcaagcccacagactgcagcaccaagctgcccttcatctgtgagaagtacaacgtgagcagcctggagaagtacagcccagattctgctgccaaggtgcagtgcagcgagcagtggatccccttccagaacaagtgcttcctgaagatcaagcctgtgtccctgaccttcagccaggccagtgacacctgccacagctatggaggcaccctgcccagcgtgctgagccagatcgagcaggacttcatcaccagcctgctgcctgacatggaggccaccctgtggattggcctgcgctggacagcctatgagaagatcaacaagtggacagacaaccgggagctgacctacagcaacttccaccccctgctggtgtctggccgcctgcgcatccctgagaacttctttgaggaggagagccgctaccactgtgccctgatcctgaacctgcagaagagccccttcaccggcacctggaacttcaccagctgcagcgagcggcactttgtgtccctgtgccagaagtacagcgaggtgaagagccggcagaccctgcagaatgccagcgagaccgtgaagtacctgaacaacctgtacaagatcatccccaagaccctgacctggcacagcgccaagcgggagtgcctgaagagcaacatgcagctggtgtccatcacagacccctaccagcaggccttcctgtctgtgcaggccctgctgcacaacagcagcctgtggattggcctcttcagccaggatgatgagctgaactttggctggagcgatggcaagaggctgcacttcagccgctgggccgagaccaacggccagctggaggactgtgtggtgctggacacagatggcttctggaagacagtggactgcaatgacaaccagcccggggccatctgctactacagcggaaatgaaacagagaaggaggtgaagcctgtggacagcgtgaagtgccccagccctgtgctgaacaccccctggatccccttccagaactgctgctacaacttcatcatcaccaagaacagacacatggccaccacccaggatgaggtgcacaccaagtgccagaagctgaaccccaagagccacatcctgagcatcagagatgagaaggagaacaactttgtgctggagcagctgctgtacttcaactacatggcctcctgggtgatgctgggcatcacctacagaaacaagagcctgatgtggtttgacaagacccccctgagctacacccactggagggctggccggcccaccatcaagaatgagaagttcctggccggcctgagcacagatggcttctgggacatccagaccttcaaggtgattgaggaggccgtgtacttccaccagcacagcatcctggcctgcaagattgagatggtggactacaaggaggagtacaacaccaccctgccccagttcatgccctatgaagatggcatctacagcgtcatccagaagaaggtgacctggtatgaggccctgaacatgtgcagccagagcggcggccacctggcctctgtgcacaaccagaatggccagctgttcctggaggacatcgtgaagagagatggcttccccctgtgggtgggcctgagcagccatgatggcagcgagagcagctttgagtggagcgatggcagcacctttgactacatcccctggaagggccagaccagccctggcaactgtgtgctgctggaccccaagggcacctggaagcatgagaagtgcaacagcgtgaaggatggagccatctgctacaagcccaccaagagcaagaagctgagccggctgacctacagcagccgctgcccagctgccaaggaaaatggcagccgctggatccagtacaagggccactgctacaagagtgaccaggccctgcacagcttcagcgaggccaagaagctgtgcagcaagcatgaccacagcgccaccatcgtgtccatcaaggatgaagatgagaacaagtttgtgtcccggctgatgagggagaacaacaacatcaccatgagggtgtggctgggcctgagccagcacagcgtggaccagagctggagctggctggatggcagcgaggtgacctttgtgaagtgggagaacaagagcaagagcggcgtgggccgctgcagcatgctgattgccagcaatgagacctggaagaaggtggagtgtgagcacggcttcggccgggtggtgtgcaaggtgcccctggactgccccagcagcacctggatccagttccaggacagctgctacatcttcctgcaggaggccatcaaggtggagagcattgaagatgtgaggaaccagtgcacagaccacggggctgacatgatcagcatccacaatgaggaggagaatgccttcatcctggacaccctgaagaagcagtggaagggcccagatgacatcctgctgggcatgttttatgacacagatgatgccagcttcaagtggtttgacaacagcaacatgacctttgacaagtggacagaccaggatgatgatgaggacctggtggacacctgtgccttcctgcacatcaagacaggagagtggaagaagggcaactgtgaggtgtcctctgtggagggcaccctgtgcaagacagccatcccctacaagaggaagtacctgagtgacaaccacatcctgatcagcgccctggtgattgccagcaccgtcatcctgactgtgctgggcgccatcatctggttcctgtacaagaagcacagcgacagccgcttcaccaccgtcttcagcacagccccccagagcccctacaatgaagactgtgtgctggtggtgggggaggagaatgagtaccctgtgcagtttgattag

SEQ ID NO: 35188 - DNA, 1149 bp, Artificial Sequence
  Description of Artificial Sequence: Synthetic coding sequence
atgaggagccacttcctgcagtgggccctggccaccagcaggaacaaggaccagatcaccaacatcttcagcggctttgctggcctgctggccatcctgctggtggtggccgtgttctgcatcctgtggaactggaacaagaggaagaagaggcaggtgccctacctgcgggtgacagtgatgcccctgctgaccctgccccagacccggcagagggccaagaacatctatgacatcctgccctggaggcaggaggacctgggcagacatgagagccgctccatgaggatcttcagcacagagagcctgctgagcaggaacagcgagagccctgagcacgtgcccagccaggccggaaatgccttccaggagcacacagcccacatccacgccacagaatatgctgtgggcatctatgacaatgccatggtgccccagatgtgtggcaacctgacccccagcgcccactgcatcaacgtgcgggccagccgggactgtgccagcatcagcagcgaggacagccatgactatgtgaatgtgcccacagctgaggagattgctgagaccctggccagcaccaagagccccagcaggaacctgtttgtgctgcccagcacccagaagctggagttcacagaggagagagatgagggctgtggagatgctggggactgcaccagcctgtacagccctggagctgaggacagcgacagcctgagcaatggagagggcagcagccagatcagcaatgactatgtgaacatgacaggcctggacctgagcgccatccaggagcggcagctgtgggtggccttccagtgctgccgggactatgaaaatgtgcctgctgctgaccccagcggcagccagcagcaggccgagaaggatgtgcccagcagcaacatcggccacgtggaggacaagacagatgaccccggcacccacgtgcagtgtgtgaagaggaccttcctggccagcggggactatgctgacttccagcccttcacccagagcgaggacagccagatgaagcaccgggaggagatgagcaatgaagacagcagtgactatgaaaatgtgctgacagccaagctgggcggccgggacagcgagcagggccctggcacccagctgctgcctgatgaatag

SEQ ID NO: 35189 - DNA, 1197 bp, Artificial Sequence
  Description of Artificial Sequence: Synthetic coding sequence
atggatggagtgacccccaccctgagcaccatccggggccgcaccctggagagcagcaccctgcacgtgacccccaggagcctggacaggaacaaggaccagatcaccaacatcttcagcggctttgctggcctgctggccatcctgctggtggtggccgtgttctgcatcctgtggaactggaacaagaggaagaagaggcaggtgccctacctgcgggtgacagtgatgcccctgctgaccctgccccagacccggcagagggccaagaacatctatgacatcctgccctggaggcaggaggacctgggcagacatgagagccgctccatgaggatcttcagcacagagagcctgctgagcaggaacagcgagagccctgagcacgtgcccagccaggccggaaatgccttccaggagcacacagcccacatccacgccacagaatatgctgtgggcatctatgacaatgccatggtgccccagatgtgtggcaacctgacccccagcgcccactgcatcaacgtgcgggccagccgggactgtgccagcatcagcagcgaggacagccatgactatgtgaatgtgcccacagctgaggagattgctgagaccctggccagcaccaagagccccagcaggaacctgtttgtgctgcccagcacccagaagctggagttcacagaggagagagatgagggctgtggagatgctggggactgcaccagcctgtacagccctggagctgaggacagcgacagcctgagcaatggagagggcagcagccagatcagcaatgactatgtgaacatgacaggcctggacctgagcgccatccaggagcggcagctgtgggtggccttccagtgctgccgggactatgaaaatgtgcctgctgctgaccccagcggcagccagcagcaggccgagaaggatgtgcccagcagcaacatcggccacgtggaggacaagacagatgaccccggcacccacgtgcagtgtgtgaagaggaccttcctggccagcggggactatgctgacttccagcccttcacccagagcgaggacagccagatgaagcaccgggaggagatgagcaatgaagacagcagtgactatgaaaatgtgctgacagccaagctgggcggccgggacagcgagcagggccctggcacccagctgctgcctgatgaatag

SEQ ID NO: 35190 - DNA, 189 bp, Artificial Sequence
  Description of Artificial Sequence: Synthetic coding sequence
atggaccccagagaatgtgtgtgcatgtctgggggcatctgcatgtgtggggacaactgcaagtgcaccacctgcaactgcaagacctactggaagagctgctgcccctgctgccccccaggctgtgccaagtgtgcccggggctgcatctgcaagggcggcagtgacaagtgcagctgctgcccctag

SEQ ID NO: 35191 - DNA, 369 bp, Artificial Sequence
  Description of Artificial Sequence: Synthetic coding sequence
atgaccacagccacccggcaggaggtgctgggcctgtaccgcagcatcttccggctggccaggaagtggcaggccaccagcggccagatggaggacaccatcaaggagaagcagtacatcctgaatgaggcccggaccctcttcaggaagaacaagaacctgacagacacagacctgatcaagcagtgcattgatgagtgcacagccagaattgaaattggcctgcactacaagatcccctacccccggcccatccacctgccccccatgggcctgacccccctgcggggccggggcctgcggagccaggagaagctgaggaagctgagcaagcctgtgtacctgcggagccatgatgaggtgtcctag

SEQ ID NO: 35192 - DNA, 369 bp, Artificial Sequence; identical to SEQ ID NO: 35191
  Description of Artificial Sequence: Synthetic coding sequence

SEQ ID NO: 35193 - DNA, 369 bp, Artificial Sequence; identical to SEQ ID NO: 35191
  Description of Artificial Sequence: Synthetic coding sequence

SEQ ID NO: 35194 - DNA, 267 bp, Artificial Sequence
  Description of Artificial Sequence: Synthetic coding sequence
atggccgccagccggctgcccccagccaccctgaccctgaagcagtttgtgcggcggcagcaggtgctgctgctgtaccgccgcatcctgcagaccatccggcaggtgcccaatgacagcgacaggaagtacctgaaggactgggcccgggaggagttcagaagaaacaagagcgccacagaggaggacaccatccgcatgatgatcacccagggcaacatgcagctgaaggagctggagaagaccctggccctggccaagagctag

SEQ ID NO: 35195 - DNA, 273 bp, Artificial Sequence
  Description of Artificial Sequence: Synthetic coding sequence
atgaagatggccaacagcctgcggggggaggtgctgaagctgtacaagaacctgctgtacctgggccgggactaccccaagggagctgactacttcaagaagaggctgaagaacatcttcctgaagaacaaggatgtgaagaaccctgagaagatcaaggagctgattgcccagggcgagtttgtgatgaaggagctggaggccctgtacttcctgaggaagtaccgggccatgaagcagcgctactacagcgacaccaacaagaccaactag

SEQ ID NO: 35196 - DNA, 105 bp, Artificial Sequence
  Description of Artificial Sequence: Synthetic coding sequence
atggccaacagcctgcggggggaggtgctgaagctgtacaagaacctgctgtacctgggccgggactaccccaagggagctgactacttcaagaagaggctgtag

SEQ ID NO: 35197 - DNA, 267 bp, Artificial Sequence
  Description of Artificial Sequence: Synthetic coding sequence
atggccaacagcctgcggggggaggtgctgaagctgtacaagaacctgctgtacctgggccgggactaccccaagggagctgactacttcaagaagaggctgaagaacatcttcctgaagaacaaggatgtgaagaaccctgagaagatcaaggagctgattgcccagggcgagtttgtgatgaaggagctggaggccctgtacttcctgaggaagtaccgggccatgaagcagcgctactacagcgacaccaacaagaccaactag

SEQ ID NO: 35198 - DNA, 267 bp, Artificial Sequence; identical to SEQ ID NO: 35197
  Description of Artificial Sequence: Synthetic coding sequence

SEQ ID NO: 35199 - DNA, 267 bp, Artificial Sequence; identical to SEQ ID NO: 35197
  Description of Artificial Sequence: Synthetic coding sequence

SEQ ID NO: 35200 - DNA, 267 bp, Artificial Sequence; identical to SEQ ID NO: 35197
  Description of Artificial Sequence: Synthetic coding sequence

SEQ ID NO: 35201 - DNA, 315 bp, Artificial Sequence
  Description of Artificial Sequence: Synthetic coding sequence
atgggccgggctgtgaaggtgctgcagctgttcaagaccctgcacaggacccggcagcaggtgttcaagaatgatgcccgggccctggaggccgcccgcatcaagatcaatgaggagttcaagaacaacaagtctgagaccagcagcaagaagattgaggagctgatgaagattggaagtgatgtggagctgctgctgcggaccagcgtcatccagggcatccacacagaccacaacaccctgaagctggtgcccaggaaggacctgctggtggagaatgtgccctactgtgatgcccccacccagaagcagtag

SEQ ID NO: 35202 - DNA, 921 bp, Artificial Sequence
  Description of Artificial Sequence: Synthetic coding sequence
atggccggccgccaccagaacagaagcttccccctgcccggggtgcagagcagcggccaggtgcacgccttcggcaactgcagcgacagcgacatcctggaggaggatgctgaggtgtatgagctgcggagccggggcaaggagaaggtgagaagaagcaccagccgggaccggctggatgacatcatcgtgctgaccaaggacatccaggagggggacaccctgaatgccatcgccctgcagtactgctgcaccgtggccgacatcaagagggtgaacaacctgatcagtgaccaggacttctttgccctgcggagcatcaagatccctgtgaagaagttcagcagcctgacagagaccctgtgcccccccaagggccggcagaccagccgccacagctctgtgcagtacagcagcgagcagcaggagatcctgcctgccaatgacagcctggcctacagcgacagcgctggcagcttcctgaaggaggtggaccgggacatcgagcagatcgtgaagtgcacagacaacaagcgggagaacctgaatgaggtggtgtctgccctgacagcccagcagatgagatttgagccagacaacaagaacacccagaggaaggacccctactacggggctgactggggcatcggctggtggacagctgtggtgatcatgctgattgtgggcatcatcacccctgtgttctacctgctgtactatgagatcctggccaaggtggatgtgagccaccacagcacagtggacagcagccacctgcacagcaagatcaccccacccagccagcagcgggagatggagaatggcatcgtgcccaccaagggcatccacttcagccagcaggatgaccacaagctgtacagccaggacagccagagccctgctgcccagcaggagacctag

SEQ ID NO: 35203 - DNA, 921 bp, Artificial Sequence; identical to SEQ ID NO: 35202
  Description of Artificial Sequence: Synthetic coding sequence

SEQ ID NO: 35204 - DNA, 384 bp, Artificial Sequence
  Description of Artificial Sequence: Synthetic coding sequence
atggccggccgccaccagaacagaagcttccccctgcccggggtgcagagcagcggccaggtgcacgccttcggcaactgcagcgacagcgacatcctggaggaggatgctgaggtgtatgagctgcggagccggggcaaggagaaggtgagaagaagcaccagccgggaccggctggatgacatcatcgtgctgaccaaggacatccaggagggggacaccctgaatgccatcgccctgcagtactgctgcaccgtgtaccagaacagcagcaagaaggtgcagttcctggacaggaacaccctgagcagcaagaggaagacagacttcaccagcttcatctgcagcatcctcttccgcaccaccggcaactttgccagctag

SEQ ID NO: 35205 - DNA, 891 bp, Artificial Sequence
  Description of Artificial Sequence: Synthetic coding sequence
atgagacatgaggagctgctgaccaagaccttccagggccctgctgtggtgtgtggcacccccaccagccacgtgtacatgttcaagaatggcagcggggacagcggggacagcagcgaggaggagagccaccgggtggtgctgcggccccggggcaaggagcggcacaagagcggcgtgcaccagcccccccaggccggggctggagatgtggtgctgctgcagcgggagctggcccaggaggacagcctgaacaagctggccctgcagtatggctgcaaggtggccgacatcaagaaggtgaacaacttcatccgggagcaggacctgtatgccctgaagtctgtgaagatccctgtgagaaatcatggcatcctgatggagacccacaaggagctgaagcccctgctgagccccagcagcgagaccaccgtgacagtggagctgcctgaggccgacagagctggagctggcactggagcccaggccggccagctgatgggcttcttcaagggcatcgaccaggacatcgagagagctgtgcagagcgagatcttcctgcacgagagctactgcatggacaccagccaccagcccctgctgcctgccccacccaagacccccatggatggagctgactgtggcatccagtggtggaatgctgtgttcatcatgctgctgattggcatcgtgctgcctgtgttctacctggtgtacttcaagatccaggccagcggggagacccccaacagcctgaacaccaccgtcatccccaacggctccatggccatgggcaccgtgcccggccaggccccccggctggccgtggccgtgcctgctgtgaccagcgctgacagccagttcagccagaccacccaggccggcagctag

SEQ ID NO: 35206 - DNA, 894 bp, Artificial Sequence
  Description of Artificial Sequence: Synthetic coding sequence
atggctgtgggcacccggggcaccctgctgaagaagagcctgactgtgtggttctgtggccctggggcccggagcgccaccagggctgtgtccaccagcctgccccggcgggagcaggtgacctggtgctgctgcagcggctcctggcccaggagaacagccagcacctcctggcgctgcagcatggccgccaacaccttctacttccggcccaacggggccggggacacccggcagaacctgatcccagacttctacgccttccgggtcatcaacaacgggaaggtggccgacatcaagaaggtgaacaacttcatccgggagcaggacctgtatgccctgaagtctgtgaagatccctgtgaggaaccacggcatcctgatggagacccacaaggagctgaagcccctgctgagccccagcagcgagaccaccgtgacagtggagctgcctgaggccgaccgggccggggccggcaccggggcccaggccggccagctgatgggcttcttcaagggcatcgaccaggacatcgagagagctgtgcagagcgagatcttcctgcacgagagctactgcatggacaccagccaccagcccctgctgcctgccccacccaagacccccatggatggagctgactgtggcatccagtggtggaatgctgtgttcatcatgctgctgattggaattgtgctgcccgtcttctacctggtgtacttcaagatccaggccagcggggagacccccaacagcctgaacaccaccgtcatccccaacggctccatggccatgggcaccgtgcccggccaggccccccggctggccgtggccgtgcctgctgtgaccagcgctgacagccagttcagccagaccacccaggccggcagctag

SEQ ID NO: 35207 - DNA, 891 bp, Artificial Sequence; identical to SEQ ID NO: 35205
  Description of Artificial Sequence: Synthetic coding sequence

SEQ ID NO: 35208 - DNA, 513 bp, Artificial Sequence
  Description of Artificial Sequence: Synthetic coding sequence
atggagacccacaaggagctgaagcccctgctgagccccagcagcgagaccaccgtgacagtggagctgcctgaggccgacagagctggagctggcactggagcccaggccggccagctgatgggcttcttcaagggcatcgaccaggacatcgagagagctgtgcagagcgagatcttcctgcacgagagctactgcatggacaccagccaccagcccctgctgcctgccccacccaagacccccatggatggagctgactgtggcatccagtggtggaatgctgtgttcatcatgctgctgattggcatcgtgctgcctgtgttctacctggtgtacttcaagatccaggccagcggggagacccccaacagcctgaacaccaccgtcatccccaacggctccatggccatgggcaccgtgcccggccaggccccccggctggccgtggccgtgcctgctgtgaccagcgctgacagccagttcagccagaccacccaggccggcagctag

SEQ ID NO: 35209 - DNA, 1635 bp, Artificial Sequence
  Description of Artificial Sequence: Synthetic coding sequence
atgagccgctgtgcccaggccgctgaggtggccgccaccgtgcctggagctggggtgggcaatgtgggcctgcggccccccatggtgccccggcaggccagcttcttccccccacctgtgcccaacccctttgtgcagcagacccagatcggcagcgcccggcgggtgcagatcgtgctgctgggcatcatcctgctgcccatccgggtgctgctggtggccctgatcctgctgctggcctggccctttgctgccatcagcacagtgtgctgcccagagaagctgacccaccccatcaccggctggaggaggaagatcacccagacagccctgaagttcctgggccgggccatgttcttctccatgggcttcatcgtggccgtgaagggcaagatcgccagccccctggaggcccctgtgtttgtggccgccccccacagcaccttctttgatggcatcgcctgtgtggtggccggcctgcccagcatggtgtccagaaatgaaaatgcccaggtgcccctgattggccgcctgctgcgggctgtgcagcctgtgctggtgtcccgggtggaccctgacagcaggaagaacaccatcaatgagatcatcaagaggaccaccagcggcggggagtggccccagatcctggtgtttcctgagggcacctgcaccaacagaagctgcctgatcaccttcaagccaggggccttcatccctggggtgcctgtgcagcctgtgctgctgcgctaccccaacaagctggacacagtgacctggacctggcagggctacaccttcatccagctgtgcatgctgaccttctgccagctgttcaccaaggtggaggtggagttcatgcctgtgcaggtgcccaatgatgaggagaagaatgaccctgtgctgtttgccaacaaggtgaggaacctgatggccgaggccctgggcatccctgtgacagaccacacctatgaggactgccgcctgatgatctctgctggccagctgaccctgcccatggaggccggcctggtggagttcaccaagatcagcaggaagctgaagctggactgggatggagtgaggaagcacctggatgaatatgccagcatcgccagcagcagcaaaggaggaagaattggaattgaggagtttgccaagtacctgaagctgcctgtgtctgatgtgctgcggcagctgtttgccctgtttgacagaaatcatgatggcagcattgacttccgggagtatgtgattggcctggccgtgctgtgcaaccccagcaacacagaggagatcatccaggtggccttcaagctgtttgatgtggatgaagatggctacatcacagaggaggagttcagcaccatcctgcaggccagcctgggcgtgcctgacctggatgtgtctggcctcttcaaggagatcgcccagggcgacagcatctcctatgaggagttcaagagctttgccctgaagcacccagaatatgccaagatcttcaccacctacctggacctgcagacctgccacgtgttcagcctgcccaaggaggtgcagaccacccccagcacagccagcaacaaggtgtccccagagaagcatgaggagagcaccagtgacaagaaggatgactag

SEQ ID NO: 35210 - DNA, 1113 bp, Artificial Sequence
  Description of Artificial Sequence: Synthetic coding sequence
atggccatcaccctggaggaggccccctggctgggctggctgctggtgaaggccctgatgagatttgccttcatggtggtgaacaacctggtggccatccccagctacatctgctacgtgatcatcctgcagcccctgcgggtgctggacagcaagcgcttctggtacatcgagggcatcatgtacaagtggctgctgggcatggtggcctcctggggctggtacgccggctacacagtgatggagtggggcgaggacatcaaggctgtgtccaaggatgaagctgtgatgctggtgaaccaccaggccactggagatgtgtgcaccctgatgatgtgcctgcaggacaagggcctggtggtggcccagatgatgtggctgatggaccacatcttcaagtacaccaactttggaattgtgtccctggtgcacggggacttcttcatccggcagggccgcagctacagagaccagcagctgctgctgctgaagaagcacctggagaacaactaccgcagccgggacaggaagtggatcgtgctcttccctgagggcggcttcctgaggaagagaagagagaccagccaggcctttgccaagaagaacaacctgcccttcctgaccaacgtgaccctgcccaggtctggggccaccaagatcatcctgaatgccctggtggcccagcagaagaatggcagccctgctggaggagatgccaaggagctggacagcaagagcaagggcctgcagtggatcatcgacaccaccatcgcctaccccaaggccgagcccatcgacatccagacctggatcctgggctacaggaagcccaccgtgacccacgtgcactaccgcatcttccccatcaaggatgtgcccctggagacagatgacctgaccacctggctgtaccagagatttgtggagaaggaggacctgctgagccacttctatgagaccggggccttcccccccagcaagggccacaaggaggccgtgtcccgggagatgaccctgagcaacctgtggatcttcctgatccagagctttgccttcctgagcggctacatgtggtacaacatcatccagtacttctaccactgcctcttctag

SEQ ID NO: 35211 - DNA, 1113 bp, Artificial Sequence; identical to SEQ ID NO: 35210
  Description of Artificial Sequence: Synthetic coding sequence

SEQ ID NO: 35212 - DNA, 702 bp, Artificial Sequence
  Description of Artificial Sequence: Synthetic coding sequence
atggtgtccatgtccttcaagaggaacagaagtgaccgcttctacagcacccgctgctgcggctgctgccacgtgaggacaggcaccatcatcctgggcacctggtacatggtggtgaacctgctgatggccatcctgctgactgtggaggtgacccaccccaacagcatgcctgctgtgaacatccagtatgaggtgattggcaactactacagcagcgagaggatggctgacaatgcctgtgtgctgtttgctgtgtctgtgctgatgttcatcatcagctccatgctggtgtatggagccatctcctaccaggtgggctggctgatccccttcttctgctaccgcctgtttgattttgtgctgagctgcctggtggccatcagcagcctgacctacctgccccgcatcaaggagtacctggaccagctgcctgacttcccctacaaggatgacctgctggccctggacagcagctgcctgctcttcatcgtgctggtgttctttgccctcttcatcatcttcaaggcctacctgatcaactgtgtgtggaactgctacaagtacatcaacaacagaaatgtgcctgagattgctgtgtacccagcctttgaggccccaccccagtatgtgctgcccacctatgagatggctgtgaagatgcctgagaaggagcccccaccaccctacctgcctgcctag

SEQ ID NO: 35213 - DNA, 1251 bp, Artificial Sequence
  Description of Artificial Sequence: Synthetic coding sequence
atgccccggcagctgtctgctgctgctgccctgtttgccagcctggccgtcatcctgcatgatggcagccagatgagggccaaggccttccctgagacccgggactacagccagcccacagctgctgccaccgtgcaggacatcaagaagcctgtgcagcagcctgccaagcaggccccccaccagaccctggccgcccgcttcatggatggccacatcaccttccagacagctgccaccgtgaagatccccaccaccaccccagccaccaccaagaacacagccaccaccagccccatcacctacaccctggtgaccacccaggccacccccaacaacagccacacagcccctcctgtgacagaggtgacagtgggccccagcctggccccctacagcctgccccccaccatcaccccaccagcccacaccaccggcaccagcagcagcacagtgagccacaccaccggcaacaccacccagcccagcaaccagaccaccctgcctgccaccctgagcatcgccctgcacaagagcaccaccggccagaagcctgtgcagcccacccacgcccctggcaccacagctgctgcccacaacaccaccaggacagctgccccagccagcacagtgcccggccccaccctggccccccagcccagctctgtgaagacaggcatctaccaggtgctgaatggcagccggctgtgcatcaaggccgagatgggcatccagctgattgtgcaggacaaggagagcgtcttcagcccccggcgctacttcaacatcgaccccaatgccacccaggccagcggcaactgtggcaccaggaagagcaacctgctgctgaacttccagggcggctttgtgaacctgaccttcaccaaggatgaggagagctactacatcagcgaggtgggcgcctacctgactgtgtctgaccctgagaccatctaccagggcatcaagcatgctgtggtgatgttccagacagctgtgggccacagcttcaagtgtgtgtctgagcagagcctgcagctgagcgcccacctgcaggtgaagaccacagatgtgcagctgcaggcctttgattttgaagatgaccactttggaaatgtggatgaatgttccagtgactacaccatcgtgctgcctgtgattggagccatcgtggtgggcctgtgcctgatgggcatgggcgtgtacaagatccggctgcgctgccagagcagcggctaccagaggatctag

SEQ ID NO: 35214 - DNA, 543 bp, Artificial Sequence
  Description of Artificial Sequence: Synthetic coding sequence
atgccccggcagctgtctgctgctgctgccctgtttgccagcctggccgtcatcctgcatgatggcagccagatgagggccaaggccttccctgagacccgggactacagccagcccacagctgctgccaccgtgcaggacatcaagaagcctgtgcagcagcctgccaagcaggccccccaccagaccctggccgcccgcttcatggatggccacatcaccttccagacagctgccaccgtgaagatccccaccaccaccccagccaccaccaagaacacagccaccaccagccccatcacctacaccctggtgaccacccaggccacccccaacaacagccacacagcccctcctgtgacagaggtgacagtgggccccagcctggccccctacagcctgccccccaccatcaccccaccagcccacaccaccggcaccagcagcagcacagtgagccacaccaccggcaacaccacccagcccagcaaccagaccaccctgcctgccaccctgagcatcgccctgcacaagagcacctag

SEQ ID NO: 35215 - DNA, 843 bp, Artificial Sequence
  Description of Artificial Sequence: Synthetic coding sequence
atggacctgcagggccggggcgtgcccagcattgaccggctgcgggtgctgctgatgctgttccacaccatggcccagatcatggccgagcaggaggtggagaacctgagcggcctgagcaccaaccctgagaaggacatctttgtggtgcgggagaatggcaccacctgcctgatggccgagtttgctgccaagttcatcgtgccctatgatgtgtgggccagcaactacgtggacctgatcacagagcaggccgacatcgccctgaccagaggagctgaggtgaagggccgctgtggccacagccagagcgagctgcaggtgttctgggtggaccgggcctatgccctgaagatgctgtttgtgaaggagagccacaacatgagcaagggccctgaggccacctggaggctgagcaaggtgcagtttgtgtatgacagcagcgagaagacccacttcaaggatgctgtgtctgctgggaagcacacagccaacagccaccacctgagcgccctggtgaccccagctgggaagagctatgagtgccaggcccagcagaccatcagcctggccagcagtgacccccagaagacagtgaccatgatcctgtctgctgtgcacatccagccctttgacatcatcagtgactttgtgttcagcgaggagcacaagtgccctgtggatgagcgggagcagctggaggagaccctgcccctcatcctgggcctcatcctgggcctggtgatcatggtgaccctggccatctaccacgtgcaccacaagatgacagccaaccaggtgcagatcccccgggacaggagccagtacaagcacatgggctag

SEQ ID NO: 35216 - DNA, 711 bp, Artificial Sequence
  Description of Artificial Sequence: Synthetic coding sequence
atggacctgcagggccggggcgtgcccagcattgaccggctgcgggtgctgctgatgctgttccacaccatggcccagatcatggccgagcaggaggtggagaacctgagcggcctgagcaccaaccctgagaaggacatctttgtggtgcgggagaatggcaccacctgcctgatggccgagtttgctgccaagttcatcgtgccctatgatgtgtgggccagcaactacgtggatgagagccacaacatgagcaagggccctgaggccacctggaggctgagcaaggtgcagtttgtgtatgacagcagcgagaagacccacttcaaggatgctgtgtctgctgggaagcacacagccaacagccaccacctgagcgccctggtgaccccagctgggaagagctatgagtgccaggcccagcagaccatcagcctggccagcagtgacccccagaagacagtgaccatgatcctgtctgctgtgcacatccagccctttgacatcatcagtgactttgtgttcagcgaggagcacaagtgccctgtggatgagcgggagcagctggaggagaccctgcccctcatcctgggcctcatcctgggcctggtgatcatggtgaccctggccatctaccacgtgcaccacaagatgacagccaaccaggtgcagatcccccgggacaggagccagtacaagcacatgggctag

SEQ ID NO: 35217 - DNA, 978 bp, Artificial Sequence
  Description of Artificial Sequence: Synthetic coding sequence
atgagcctgcagagccggctgagcggccgcctggcccagctgcgggctgctggccagctgctggtgcccccccggccccggcccggccacctggccggggccaccaggaccaggagcagcacctgtggccccccagccttcctgggcgtgtttggaagaagagcccggaccagcgctggggtgggcgcctggggcgctgctgctgtgggccgcacagctggggtgaggacctgggcccccctggccatggccgccaaggtggacctgagcaccagcacagactggaaggaggccaagagcttcctgaagggcctgagtgacaagcagcgggaggagcactacttctgcaaggactttgtgcggctgaagaagatccccacctggaaggagatggccaagggcgtggccgtgaaggtggaggagccccgctacaagaaggacaagcagctgaatgagaagatcagcctgctgcggagtgacatcaccaagctggaggtggatgccatcgtgaatgctgccaacagcagcctgctgggcggcggcggcgtggatggctgcatccacagagctgctggccccctgctgacagatgagtgcaggaccctgcagagctgcaagacaggcaaggccaagatcactggaggctaccgcctgcctgccaagtatgtgatccacacagtgggccccatcgcctacggggagcccagcgccagccaggccgctgagctgcggagctgctacctgagcagcctggacctgctgctggagcaccggctgcggtctgtggccttcccctgcatcagcactggagtgtttggctacccctgtgaggccgctgctgagatcgtgctggccaccctgcgggagtggctggagcagcacaaggacaaggtggacaggctcatcatctgtgtgttcctggagaaggatgaggacatctaccgcagccggctgccccactacttccctgtggcctag

SEQ ID NO: 35218 - DNA, 2151 bp, Artificial Sequence
  Description of Artificial Sequence: Synthetic coding sequence
atgaacaacttccgggccaccatcctcttctgggccgccgccgcctgggccaagagcggcaagcccagcggggagatggatgaggtgggcgtgcagaagtgcaagaatgccctgaagctgcctgtgctggaggtgctgcccggcggcggctgggacaacctgagaaatgtggacatgggccgggtgatggagctgacctacagcaactgcaggaccacagaagatggccagtacatcatcccagatgagatcttcaccatcccccagaagcagagcaacctggagatgaacagcgagatcctggagagctgggccaactaccagagcagcaccagctacagcatcaacacagagctgagcctcttcagcaaggtgaatggcaagttcagcacagagttccagaggatgaagaccctgcaggtgaaggaccaggccatcaccaccagggtgcaggtgaggaacctggtgtacacagtgaagatcaaccccaccctggagctgagcagcggcttcaggaaggagctgctggacatcagtgaccggctggagaacaaccagaccaggatggccacctacctggccgagctgctggtgctgaactacggcacccacgtgaccacctctgtggatgctggagctgccctgatccaggaggaccacctgcgggccagcttcctgcaggacagccagagcagccgctctgctgtgacagccagcgctggcctggccttccagaacacagtgaacttcaagtttgaggagaactacaccagccagaatgtgctgaccaagagctacctgagcaacagaaccaacagccgggtgcagagcatcggcggcgtgcccttctacccaggcatcaccctgcaggcctggcagcagggcatcaccaaccacctggtggccatcgacaggagcggcctgcccctgcacttcttcatcaaccccaacatgctgcctgacctgcccggccccctggtgaagaaggtgtccaagacagtggagacagctgtgaagcgctactacaccttcaacacctacccaggctgcacagacctgaacagccccaacttcaacttccaggccaacacagatgatggcagctgtgagggcaagatgaccaacttctcctttggaggagtgtaccaggagtgcacccagctgagcggcaacagagatgtgctgctgtgccagaagctggagcagaagaaccccctgactggagacttcagctgccccagcggctacagccctgtgcacctgctgagccagatccacgaggagggctacaaccacctggagtgccacaggaagtgcaccctgctggtgttctgcaagacagtgtgtgaagatgtgttccaggtggccaaggccgagttccgggccttctggtgtgtggccagcagccaggtgcctgaaaattctggcctgctgtttggaggcctcttcagcagcaagagcatcaaccccatgaccaatgcccagagctgcccagctggctacttccccctgcggctgtttgagaacctgaaggtgtgtgtgtcccaggactatgagctgggcagcagatttgctgtgccctttggaggcttcttcagctgcaccgtgggcaaccccctggtggaccctgccatcagccgggacctgggcgcccccagcctgaagaagtgccctgggggcttcagccagcacccagccctgatcagtgatggctgccaggtgtcctactgtgtgaagagcggcctcttcaccggcggcagcctgcccccagcccggctgccccccttcaccaggcctcccctgatgagccaggccgccaccaacacagtgattgtgaccaacagtgaaaatgcccgctcctggatcaaggacagccagacccaccagtggaggctgggggagcccatcgagctgcggcgggccatgaatgtcatccatggagatggcggcggcctgtctggaggagctgctgctggggtgacagtgggcgtgaccaccatcctggccgtggtgatcaccctggccatctacggcaccaggaagttcaagaagaaggcctaccaggccatcgaggagcggcagagcctggtgcccggcacagctgccactggagacaccacctaccaggagcagggccagagccctgcctag

SEQ ID NO: 35219 - DNA, 495 bp, Artificial Sequence
  Description of Artificial Sequence: Synthetic coding sequence
atgaacaacttccgggccaccatcctcttctgggccgccgccgcctgggccaagagcggcaagcccagcggggagatggatgaggtgggcgtgcagaagtgcaagaatgccctgaagctgcctgtgctggaggtgctgcccggcggcggctgggacaacctgagaaatgtggacatgggccgggtgatggagctgacctacagcaactgcaggaccacagaagatggccagtacatcatcccagatgagatcttcaccatcccccagaagcagagcaacctggagatgaacagcgagatcctggagagctgggccaactaccagagcagcaccagctacagcatcaacacagagctgagcctcttcagcaaggtgaatggcaagttcagcacagagttccagagggtgcctgccccctgccaggcccccaccttccacccagccacccctcatgaaagtggctgccaccagtactgccacagcgaccagttctag

SEQ ID NO: 35220 - DNA, 1398 bp, Artificial Sequence
  Description of Artificial Sequence: Synthetic coding sequence
atggaggaggaggatgaggaggcccgggccctgctggccggcggcccagatgaagctgacagaggagccccagctgcccctggggccctgcctgccctgtgtgaccccagccggctggcccaccggctgctggtgctgctgctgatgtgcttcctgggcttcggcagctacttctgctatgacaacccagctgccctgcagacccaggtgaagagggacatgcaggtgaacaccaccaagttcatgctgctgtatgcctggtacagctggcccaacgtggtgctgtgcttcttcggcggcttcctgattgacagagtgtttggcatccgctggggcaccatcatcttcagctgctttgtgtgcatcggccaggtggtgtttgccctgggcggcatcttcaatgccttctggctgatggagtttggccgctttgtgtttggcatcggcggggagagcctggccgtggcccagaacacctatgctgtgtcctggttcaagggcaaggagctgaacctggtgtttggcctgcagctgtccatggccagaattggcagcacagtgaacatgaacctgatgggctggctgtacagcaagattgaggccctgctgggcagcgctggccacaccaccctgggcatcaccctgatgattggaggcatcacctgcatcctgagcctcatctgtgccctggccctggcctacctggaccagagagctgagcgcatcctgcacaaggagcagggcaagacaggagaggtgatcaagctgacagatgtgaaggacttcagcctgcccctgtggctgatcttcatcatctgtgtgtgctactacgtggccgtgttccccttcatcggcctgggcaaggtgttcttcacagagaagtttggcttcagcagccaggccgccagcgccatcaacagcgtggtgtatgtgatcagcgcccccatgagccctgtgtttggcctgctggtggacaagacaggcaagaacatcatctgggtgctgtgtgctgtggccgccaccctggtgagccacatgatgctggccttcaccatgtggaacccctggatcgccatgtgcctgctgggcctgagctacagcctgctggcctgtgccctgtggcccatggtggcctttgtggtgcctgagcaccagctgggcacagcctacggcttcatgcagagcatccagaacctgggcctggccatcatcagcatcatcgccggcatgatcctggacagccggggctacctgttcctggaggtgttcttcatcgcctgtgtgtccctgagcctgctgtctgtggtgctgctgtacctggtgaacagagcccagggcggcaacctgaactacagcgcccggcagcgggaggagatcaagttcagccacacagaatag

SEQ ID NO: 35221 - DNA, 762 bp, Artificial Sequence
  Description of Artificial Sequence: Synthetic coding sequence
atggaggaggaggatgaggaggcccgggccctgctggccggcggcccagatgaagctgacagaggagccccagctgcccctggggccctgcctgccctgtgtgaccccagccggctggcccaccggctgctggtgctgctgctgatgtgcttcctgggcttcggcagctacttctgctatgacaacccagctgccctgcagacccaggtgaagagggacatgcaggtgaacaccaccaagttcatgctgctgtatgcctggtacagctggcccaacgtggtgctgtgcttcttcggcggcttcctgattgacagagtgtttggcagcacagtgaacatgaacctgatgggctggctgtacagcaagattgaggccctgctgggcagcgctggccacaccaccctgggcatcaccctgatgattggaggcatcacctgcatcctgagcctcatctgtgccctggccctggcctacctggaccagagagctgagcgcatcctgcacaaggagcagggcaagacaggagaggtgatcaagctgacagatgtgaaggacttcagcctgcccctgtggctgatcttcatcatctgtgtgtgctactacgtggccgtgttccccttcatcggcctgggcaaggtgttcttcacagagaagtttggcttcagcagccaggccgccagcgccatcaacagcgtggtgtatgtgatcagcgcccccatgagccctgtgtttggcctgctggtggacaagacaggcaagtag

SEQ ID NO: 35222 - DNA, 1428 bp, Artificial Sequence
  Description of Artificial Sequence: Synthetic coding sequence
atgggcgtggccctgcgggacctgcccggccgccacgtgagcagccgcagccacgtgacagctgtgctgaccgtcttccacggccgctgcttcctgcccggctttggagtggtgaccaccttccccagccccagccctgctggggccatggaggaggaggatgaggaggcccgggccctgctggccggcggcccagatgaggccgacagaggagccccagctgcccctggggccctgcctgccctgtgtgaccccagccggctggcccaccggctgctggtgctgctgctgatgtgcttcctgggctttgccatctttgccatgatcatcctgctgcccttccggctgaagctgaatgagtggggcaccatcatcttcagctgctttgtgtgcatcggccaggtggtgtttgccctgggcggcatcttcaatgccttctggctgatggagtttggccgctttgtgtttggcatcggcggggagagcctggccgtggcccagaacacctatgctgtgtcctggttcaagggcaaggagctgaacctggtgtttggcctgcagctgtccatggccagaattggcagcacagtgaacatgaacctgatgggctggctgtacagcaagattgaggccctgctgggcagcgctggccacaccaccctgggcatcaccctgatgattggaggcatcacctgcatcctgagcctcatctgtgccctggccctggcctacctggaccagagagctgagcgcatcctgcacaaggagcagggcaagacaggagaggtgatcaagctgacagatgtgaaggacttcagcctgcccctgtggctgatcttcatcatctgtgtgtgctactacgtggccgtgttccccttcatcggcctgggcaaggtgttcttcacagagaagtttggcttcagcagccaggccgccagcgccatcaacagcgtggtgtatgtgatcagcgcccccatgagccctgtgtttggcctgctggtggacaagacaggcaagaacatcatctgggtgctgtgtgctgtggccgccaccctggtgagccacatgatgctggccttcaccatgtggaacccctggatcgccatgtgcctgctgggcctgagctacagcctgctggcctgtgccctgtggcccatggtggcctttgtggtgcctgagcaccagctgggcacagcctacggcttcatgcagagcatccagaacctgggcctggccatcatcagcatcatcgccggcatgatcctggacagccggggctacctgttcctggaggtgttcttcatcgcctgtgtgtccctgagcctgctgtctgtggtgctgctgtacctggtgaacagagcccagggcggcaacctgaactacagcgcccggcagcgggaggagatcaagttcagccacacagaatag

SEQ ID NO: 35223 - DNA, 1545 bp, Artificial Sequence
  Description of Artificial Sequence: Synthetic coding sequence
atgggcgtggccctgcgggacctgcccggccgccacgtgagcagccgcagccacgtgacagctgtgctgaccgtcttccacggccgctgcttcctgcccggctttggagtggtgaccaccttccccagccccagccctgctggggccatggaggaggaggatgaggaggcccgggccctgctggccggcggcccagatgaggccgacagaggagccccagctgcccctggggccctgcctgccctgtgtgaccccagccggctggcccaccggctgctggtgctgctgctgatgtgcttcctgggcttcggcagctacttctgctatgacaacccagctgccctgcagacccaggtgaagagggacatgcaggtgaacaccaccaagttcatgctgctgtatgcctggtacagctggcccaacgtggtgctgtgcttctttggaggcttcctgattgacagagtgtttggcatccgctggggcaccatcatcttcagctgctttgtgtgcatcggccaggtggtgtttgccctgggcggcatcttcaatgccttctggctgatggagtttggccgctttgtgtttggaattggaggagagagcctggccgtggcccagaacacctatgctgtgtcctggttcaagggcaaggagctgaacctggtgtttggcctgcagctgtccatggcccgcatcggcagcacagtgaacatgaacctgatgggctggctgtacagcaagattgaggccctgctgggcagcgctggccacaccaccctgggcatcaccctgatgattggaggcatcacctgcatcctgagcctcatctgtgccctggccctggcctacctggaccagagagctgagcgcatcctgcacaaggagcagggcaagacaggagaggtgatcaagctgacagatgtgaaggacttcagcctgcccctgtggctgatcttcatcatctgtgtgtgctactacgtggccgtgttccccttcatcggcctgggcaaggtgttcttcacagagaagtttggcttcagcagccaggccgccagcgccatcaacagcgtggtgtatgtgatcagcgcccccatgagccctgtgtttggcctgctggtggacaagacaggcaagaacatcatctgggtgctgtgtgctgtggccgccaccctggtgagccacatgatgctggccttcaccatgtggaacccctggatcgccatgtgcctgctgggcctgagctacagcctgctggcctgtgccctgtggcccatggtggcctttgtggtgcctgagcaccagctgggcacagcctacggcttcatgcagagcatccagaacctgggcctggccatcatcagcatcatcgccggcatgatcctggacagccggggctacctgttcctggaggtgttcttcatcgcctgtgtgtccctgagcctgctgtctgtggtgctgctgtacctggtgaacagagcccagggcggcaacctgaactacagcgcccggcagcgggaggagatcaagttcagccacacagaatag

SEQ ID NO: 35224 - DNA, 1368 bp, Artificial Sequence
  Description of Artificial Sequence: Synthetic coding sequence
atgggctggggcggcggcggcggctgcacccccaggcctcccatccaccagcagcccccagagcggcgggtggtgacagtggtgttcctgggcctgctgctggacctgctggccttcaccctgctgctgcccctgctgcccggcctgctggagagccacggccgggcccatgaccccctgtatggctcctggcagggcggcgtggactggtttgccacagccatcggcatgcctgtggagaagcgctacaacagcgtgctgtttggaggcctcatcggcagcgccttctctgtgctgcagttcctgtgtgcccccctgactggagccaccagtgactgcctgggccggcggcctgtgatgctgctgtgcctgatgggcgtggccaccagctatgctgtgtgggccaccagccgcagctttgctgccttcctggccagccggctgattggaggcatcagcaaaggaaatgtgtccctgagcacagccatcgtggccgacctgggcagccccctggcccggagccagggcatggccgtcatcggcgtggccttcagcctgggcttcaccctgggccccatgctgggcgccagcctgcccctggagatggccccctggtttgccctgctgtttgctgccagtgacctgctcttcatcttctgcttcctgcctgagaccctgcccctggagaagagggcccccagcatcgccctgggcttcagagatgctgctgacctgctgagccccctggccctgctgcgcttctctgctgtggcccggggccaggaccccccatctggggaccggctgagcagcctgcggcggctgggcctggtgtacttcctgtacctgttcctgttcagcggcctggagtacaccctgtccttcctgacccaccagcgcttccagttcagcagcctgcagcagggcaagatgttcttcctgattggcctgaccatggccaccatccagggcgcctatgcccggcgcatccaccctggaggagaggtggccgctgtgaagagggccctgctgctgctggtgcctgccttcctgctgattggctggggccgcagcctgcctgtgctgggcctgggcctgctgctgtacagctttgctgctgctgtggtggtgccctgcctgagctctgtggtggccggctacggcagccctggccagaagggcaccgtgatgggcaccctgcggagcctgggcgccctggcccgggccgccggccccctggtggccgcctctgtgtactggctggccggggcccaggcctgcttcaccacctggagcggcctcttcctgctgcccttcttcctgctgcagaagctgagctacccagcccagaccctgaaggccgagtag

SEQ ID NO: 35225 - DNA, 1368 bp, Artificial Sequence; identical to SEQ ID NO: 35224
  Description of Artificial Sequence: Synthetic coding sequence

SEQ ID NO: 35226 - DNA, 1350 bp, Artificial Sequence
  Description of Artificial Sequence: Synthetic coding sequence
atgagccctgagagcaagaagctgttcaacatcatcatcctgggcgtggccttcatgttcatgttcaccgccttccagacctgtggaaatgtggcccagaccgtcatccgcagcctgaacagaacagacttccacggcagcggctacacctccatggccatcatctacggcgtcttcagcgccagcaacctgatcacccccagcgtggtggccatcgtgggcccccagctgtccatgtttgccagcggcctcttctacagcatgtacatcgctgtgttcatccagcccttcccctggagcttctacacagcctctgtgttcatcggcattgctgctgctgtgctgtggacagcccagggcaactgcctgaccatcaacagtgatgagcacagcatcggcaggaacagcggcatcttctgggccctgctgcagagcagcctcttctttggaaacctgtacatctactttgcctggcagggcaagacccagatcagcgagagtgacagaagaacagtgttcatcgccctgaccgtcatcagcctggtgggcaccgtgctcttcttcctgatcaggaagccagattctgaaaatgtgctgggagaagatgagagcagtgatgaccaggacatggaggtgaatgaaagtgcccagaacaacctgaccaaggctgtggatgccttcaagaagagcttcaagctgtgtgtgaccaaggagatgctgctgctgagcatcaccacagcctacacaggcctggagctgaccttcttctctggagtgtatggcacctgcatcggggccaccaacaagtttggagctgaggagaagagcctcatcggcctgagcggcatcttcatcggcattggagagatcctgggcggcagcctgtttggcctgctgagcaagaacaacagatttggaagaaatcctgtggtgctgctgggcatcctggtgcacttcatcgccttctacctgatcttcctgaacatgcctggagatgcccccatcgcccctgtgaagggcacagacagcagcgcctacatcaagagcagcaaggaggtggccatcctgtgcagcttcctgctgggcctgggggacagctgcttcaacacccagctgctgagcatcctgggcttcctgtacagcgaggacagcgccccagcctttgccatcttcaagtttgtgcagagcatctgtgccgctgtggccttcttctacagcaactacctgctgctgcactggcagctgctggtgatggtgatcttcggcttcttcggcaccatctccttcttcaccgtggagtgggaggccgccgcctttgtggcccggggcagtgactaccgcagcatctag

SEQ ID NO: 35227 - DNA, 1194 bp, Artificial Sequence
  Description of Artificial Sequence: Synthetic coding sequence
atgagccctgagagcaagaagctgttcaacatcatcatcctgggcgtggccttcatgttcatgttcaccgccttccagacctgtggaaatgtggcccagaccgtcatccgcagcctgaacagaacagacttccacggcagcggctacacctccatggccatcatctacggcgtcttcagcgccagcaacctgatcacccccagcgtggtggccatcgtgggcccccagctgtccatgtttgccagcggcctcttctacagcatgtacatcgctgtgttcatccagcccttcccctggagcttctacacagcctctgtgttcatcggcattgctgctgctgagagtgacagaagaacagtgttcatcgccctgaccgtcatcagcctggtgggcaccgtgctcttcttcctgatcaggaagccagattctgaaaatgtgctgggagaagatgagagcagtgatgaccaggacatggaggtgaatgaaagtgcccagaacaacctgaccaaggctgtggatgccttcaagaagagcttcaagctgtgtgtgaccaaggagatgctgctgctgagcatcaccacagcctacacaggcctggagctgaccttcttctctggagtgtatggcacctgcatcggggccaccaacaagtttggagctgaggagaagagcctcatcggcctgagcggcatcttcatcggcattggagagatcctgggcggcagcctgtttggcctgctgagcaagaacaacagatttggaagaaatcctgtggtgctgctgggcatcctggtgcacttcatcgccttctacctgatcttcctgaacatgcctggagatgcccccatcgcccctgtgaagggcacagacagcagcgcctacatcaagagcagcaaggaggtggccatcctgtgcagcttcctgctgggcctgggggacagctgcttcaacacccagctgctgagcatcctgggcttcctgtacagcgaggacagcgccccagcctttgccatcttcaagtttgtgcagagcatctgtgccgctgtggccttcttctacagcaactacctgctgctgcactggcagctgctggtgatggtgatcttcggcttcttcggcaccatctccttcttcaccgtggagtgggaggccgccgcctttgtggcccggggcagtgactaccgcagcatctag

SEQ ID NO: 35228 - DNA, 1443 bp, Artificial Sequence
  Description of Artificial Sequence: Synthetic coding sequence
atgggccctggccccccagctgctggggccgcccccagcccccggcccctgagcctggtggcccggctgtcctatgctgtgggccacttcctgaatgacctgtgtgcctccatgtggttcacctacctgctgctgtacctgcacagcgtgcgggcctacagcagcagaggagctggcctgctgctgctgctgggccaggtggctgatggcctgtgcacccccctggtgggctatgaggccgacagagctgccagctgctgtgcccgctatggccccaggaaggcctggcacctggtgggcaccgtgtgtgtgctgctgtccttccccttcatcttcagcccctgcctgggctgtggggccgccaccccagagtgggccgccctgctgtactacggccccttcatcgtcatcttccagtttggctgggccagcacccagatcagccacctgagcctcatccctgagctggtgaccaatgaccacgagaaggtggagctgacagccctgcgctatgccttcaccgtggtggccaacatcaccgtgtatggagctgcctggctgctgctgcacctgcagggcagcagccgggtggagcccacccaggacatcagcatcagtgaccagctgggcggccaggatgtgcctgtgttcaggaacctgagcctgctggtggtgggcgtgggcgctgtgttcagcctgctcttccacctgggcacccgggagaggagaagacctcatgctgaggagcccggggagcacacccccctgctggccccagccacagcccagcccctgctgctgtggaagcactggctgcgggagcccgccttctaccaggtgggcatcctgtacatgaccaccaggctcatcgtgaacctgagccagacctacatggccatgtacctgacctacagcctgcacctgcccaagaagttcatcgccaccatccccctggtgatgtacctgagcggcttcctgagcagcttcctgatgaagcccatcaacaagtgcatcggcaggaacatgacctacttcagcggcctgctggtgatcctggcctttgctgcctgggtggccctggccgagggcctgggcgtggccgtgtatgctgctgctgtgctgctgggcgccggctgtgccaccatcctggtgaccagcctggccatgacagctgacctgattggcccccacaccaacagcggggcctttgtgtatggctccatgtccttcctggacaaggtggccaacggcctggccgtgatggccatccagagcctgcacccctgccccagcgagctgtgctgccgggcctgtgtgtccttctaccactgggccatggtggccgtgactggaggagtgggcgtggccgccgccctgtgcctgtgcagcctgctgctgtggcccacccggctgcggcgctgggacagagatgcccggccctag

SEQ ID NO: 35229 - DNA, 1422 bp, Artificial Sequence
  Description of Artificial Sequence: Synthetic coding sequence
atgggccctggccccccagctgctggggccgcccccagcccccggcccctgagcctggtggcccggctgtcctatgctgtgggccacttcctgaatgacctgtgtgcctccatgtggttcacctacctgctgctgtacctgcacagcgtgcgggcctacagcagcagaggagctggcctgctgctgctgctgggccaggtggctgatggcctgtgcacccccctggtgggctatgaggccgacagagctgccagctgctgtgcccgctatggccccaggaaggcctggcacctggtgggcaccgtgtgtgtgctgctgtccttccccttcatcttcagcccctgcctgggctgtggggccgccaccccagagtgggccgccctgctgtactacggccccttcatcgtcatcttccagtttggctgggccagcacccagatcagccacctgagcctcatccctgagctggtgaccaatgaccacgagaaggtggagctgacagccctgcgctatgccttcaccgtggtggccaacatcaccgtgtatggagctgcctggctgctgctgcacctgcagggcagcagccgggtggagcccacccaggacatcagcatcagtgaccagctgggcggccaggatgtgcctgtgttcaggaacctgagcctgctggtggtgggcgtgggcgctgtgttcagcctgctcttccacctgggcacccgggagaggagaagacctcatgctgaggagcccggggagcacacccccctgctggccccagccacagcccagcccctgctgctgtggaagcactggctgcgggagcccgccttctaccaggtgggcatcctgtacatgaccaccaggctcatcgtgaacctgagccagacctacatggccatgtacctgacctacagcctgcacctgcccaagaagttcatcgccaccatccccctggtgatgtacctgagcggcttcctgagcagcttcctgatgaagcccatcaacaagtgcatcggcaggaacatgacctacttcagcggcctgctggtgatcctggcctttgctgcctgggtggccctggccgagggcctgggcgtggccgtgtatgctgctgctgtgctgctgggcgccggctgtgccaccatcctggtgaccagcctggccatgacagctgacctgattggcccccacaccaacagcggggcctttgtgtatggctccatgtccttcctggacaaggtggccaacggcctggccgtgatggccatccagagcctgcacccctgccccagcgagctgtgctgccgggcctgtgtgtccttctaccactgggccatggtggccgtgactggaggagtgggcgtggccgccgccctgtgcctgtgcagcctgctgctgtggcccacccggctgcggaggtag

SEQ ID NO: 35230 - DNA, 1617 bp, Artificial Sequence
  Description of Artificial Sequence: Synthetic coding sequence
atgggccctggccccccagctgctggggccgcccccagcccccggcccctgagcctggtggcccggctgtcctatgctgtgggccacttcctgaatgacctgtgtgcctccatgtggttcacctacctgctgctgtacctgcacagcgtgcgggcctacagcagcagaggagctggcctgctgctgctgctgggccaggtggctgatggcctgtgcacccccctggtgggctatgaggccgacagagctgccagctgctgtgcccgctatggccccaggaaggcctggcacctggtgggcaccgtgtgtgtgctgctgtccttccccttcatcttcagcccctgcctgggctgtggggccgccaccccagagtgggccgccctgctgtactacggccccttcatcgtcatcttccagtttggctgggccagcacccagatcagccacctgagcctcatccctgagctggtgaccaatgaccacgagaaggtggagctgacagccctgcgctatgccttcaccgtggtggccaacatcaccgtgtatggagctgcctggctgctgctgcacctgcagggcagcagccgggtggagcccacccaggacatcagcatcagtgaccagctgggcggccaggatgtgcctgtgttcaggaacctgagcctgctggtggtgggcgtgggcgctgtgttcagcctgctcttccacctgggcacccgggagaggagaagacctcatgctgaggagcccggggagcacacccccctgctggccccagccacagcccagcccctgctgctgtggaagcactggctgcgggagcccgccttctaccaggtgggcatcctgtacatgaccaccaggctcatcgtgaacctgagccagacctacatggccatgtacctgacctacagcctgcacctgcccaagaagttcatcgccaccatccccctggtgatgtacctgagcggcttcctgagcagcttcctgatgaagcccatcaacaagtgcatcggcaggaacatgacctacttcagcggcctgctggtgatcctggcctttgctgcctgggtggccctggccgagggcctgggcgtggccgtgtatgctgctgctgtgctgctgggcgccggctgtgccaccatcctggtgaccagcctggccatgacagctgacctgattggcccccacaccaacagcggggcctttgtgtatggctccatgtccttcctggacaaggtggccaacggcctggccgtgatggccatccagagcctgcacccctgccccagcgagctgtgctgccgggcctgtgtgtccttctaccactgggccatggtggccgtgactggaggagtgggcgtggccgccgccctgtgcctgtgcagcctgctgctgtggcccacccggctgcggcgctccttcctggcctggaggcggggccgcggggaggacaagggccctggctacagctggatccccaccgtgctggtgcagcccccccggcccaccagccccttcctgtgggaggcccccctggcctggcgctgcaccaggaagaagtggagcggggccggcaccaagccctggccccgggaggactggggcacccactag

SEQ ID NO: 35231 - DNA, 1239 bp, Artificial Sequence
  Description of Artificial Sequence: Synthetic coding sequence
atgaggggcaagctgctgcccctggccggcctgtacctggtgcagggcctgccctacggcctgcagagcggcctgctgcctgtgctgctgcgggccggcggcctgagcctgaccagggtgggcctggccaaggtgctgtatgccccctggctgctgaagctggcctgggcccccctggtggatgcccagggcagcgcccgggcctgggtgaccaggagcacagctggcctgggcctggtgtgtggcctgctggccggcctgcccccacctggggccggccaggccggcctgcctgctgctgtggccggcctgctgctgctgctgaacctgggcgccgccatgcaggatgtggccctggatgccctggccgtgcagctgctggagcctgctgagctgggccctggcaacacagtgcaggtggtggcctacaagctgggcgccgccctggccggcggggccctgctggccctgctgcccaccttctcctggccccagctgttcctgctgctggccgccacctactggctggccgccgccctggcctgggccgccccagccctgcggcggctgccccagcagccccccagcgagcagaggccccacacagcccacctgctgagagatgtgctggccgtgcccggcaccgtgtggacagctggctttgtgctgacctacaagctgggggagcagggcgccagcagcctcttccccctgctgctgctggaccatggagtgtctgcccctgagctgggcctgtggaatggagtgggcgctgtggtgtgcagcattgctggcagcagcctgggcggcaccctgctggccaagcactggaagctgctgcccctgctgcggtctgtgctgcgcttccggctgggcggcctggcctgccagacagccctggtgttccacctggacaccctgggcgcctccatggatgctggcaccatcctgcggggcagcgccctgctgagcctgtgcctgcagcacttcctgggcggcctggtgaccaccgtgaccttcaccggcatgatgcgctgcagccagctggccccccgggccctgcaggccacccactacagcctgctggccaccctggagctgctgggcaagctgctgctgggcaccctggccggcggcctggctgatggcctgggcccccacccctgcttcctgctgctgctgatcctgagcgccttccctgtgctgtacctggacctggcccccagcaccttcctgtag

SEQ ID NO: 35232 - DNA, 1545 bp, Artificial Sequence
  Description of Artificial Sequence: Synthetic coding sequence
atgggctgtgatggccgggtgtctggcctgctgcggaggaacctgcagcccaccctgacctactggagcgtcttcttctcctttggcctgtgcatcgccttcctgggccccaccctgctggacctgcgctgccagacccacagcagcctgccccagatctcctgggtgttcttcagccagcagctgtgcctgctgctgggcagcgccctgggcggcgtcttcaagaggaccctggcccagagcctgtgggccctcttcaccagcagcctggccatcagcctggtgtttgctgtgatccccttctgcagagatgtgaaggtgctggcctctgtgatggccctggccggcctggccatgggctgcatcgacacagtggccaacatgcagctggtgaggatgtaccagaaggacagcgctgtgttcctgcaggtgctgcacttctttgtgggctttggagccctgctgagccccctgattgctgaccccttcctgtctgaggccaactgcctgcctgccaacagcacagccaacaccaccagccggggccacctgttccacgtgtcccgggtgctgggccagcaccacgtggatgccaagccctggagcaaccagaccttccctggcctgacccccaaggatggagctggcaccagggtgtcctatgccttctggatcatggccctgatcaacctgcctgtgcccatggctgtgctgatgctgctgagcaaggagcggctgctgacctgctgcccccagaggcggcccctgctgctgtctgcagatgagctggccctggagacccagcccccagagaaggaggatgccagcagcctgccccccaagttccagagccacctgggccatgaagatctcttcagctgctgccagaggaagaacctgcggggggccccctacagcttctttgccatccacatcactggagccctggtgctcttcatgacagatggcctgactggagcctacagcgcctttgtgtacagctatgctgtggagaagcccctgtctgtgggccacaaggtggccggctacctgcccagcctcttctggggcttcatcaccctgggccgcctgctgagcatccccatcagcagcaggatgaagccagccaccatggtgttcatcaacgtggtgggcgtggtggtgaccttcctggtgctgctgatcttctcctacaacgtggtgttcctgtttgtgggcacagccagcctgggcctcttcctgagcagcaccttccccagcatgctggcctacacagaggacagcctgcagtacaagggctgtgccaccaccgtgctggtgactggagctggggtgggggagatggtgctgcagatgctggtgggcagcatcttccaggcccagggcagctacagcttcctggtgtgtggggtcatcttcggctgcctggccttcaccttctacatcctgctgctcttcttccacaggatgcaccctggcctgcccagcgtgcccacccaggacaggagcatcggcatggagaacagcgagtgctaccagaggtag

SEQ ID NO: 35233 - DNA, 1284 bp, Artificial Sequence
  Description of Artificial Sequence: Synthetic coding sequence
atgggctgtgatggccgggtgtctggcctgctgcggaggaacctgcagcccaccctgacctactggagcgtcttcttctcctttggcctgtgcatcgccttcctgggccccaccctgctggacctgcgctgccagacccacagcagcctgccccagatctcctgggtgttcttcagccagcagctgtgcctgctgctgggcagcgccctgggcggcgtcttcaagaggaccctggcccagagcctgtgggccctcttcaccagcagcctggccatcagcctggtgtttgctgtgatccccttctgcagagatgtgaaggtgctggcctctgtgatggccctggccggcctggccatgggctgcatcgacacagtggccaacatgcagctggtgaggatgtaccagaaggacagcgctgtgttcctgcagctgcctgtgcccatggctgtgctgatgctgctgagcaaggagcggctgctgacctgctgcccccagaggcggcccctgctgctgtctgcagatgagctggccctggagacccagcccccagagaaggaggatgccagcagcctgccccccaagttccagagccacctgggccacgaggacctcttcagctgctgccagaggaagaacctgcggggggccccctacagcttctttgccatccacatcaccggggccctggtgctcttcatgacagatggcctgaccggggcctacagcgcctttgtgtacagctatgctgtggagaagcccctgtctgtgggccacaaggtggccggctacctgcccagcctcttctggggcttcatcaccctgggccgcctgctgagcatccccatcagcagcaggatgaagccagccaccatggtgttcatcaacgtggtgggcgtggtggtgaccttcctggtgctgctgatcttctcctacaacgtggtgttcctgtttgtgggcacagccagcctgggcctcttcctgagcagcaccttccccagcatgctggcctacacagaggacagcctgcagtacaagggctgtgccaccaccgtgctggtgactggagctggggtgggggagatggtgctgcagatgctggtgggcagcatcttccaggcccagggcagctacagcttcctggtgtgtggggtcatcttcggctgcctggccttcaccttctacatcctgctgctcttcttccacaggatgcaccctggcctgcccagcgtgcccacccaggacaggagcatcggcatggagaacagcgagtgctaccagaggtag

SEQ ID NO: 35234 - DNA, 1323 bp, Artificial Sequence
  Description of Artificial Sequence: Synthetic coding sequence
atgggctgtgatggccgggtgtctggcctgctgcggaggaacctgcagcccaccctgacctactggagcgtcttcttctcctttggcctgtgcatcgccttcctgggccccaccctgctggacctgcgctgccagacccacagcagcctgccccagatctcctgggtgttcttcagccagcagctgtgcctgctgctgggcagcgccctgggcggcgtcttcaagaggaccctggcccagagcctgtgggccctcttcaccagcagcctggccatcagcctggtgtttgctgtgatccccttctgcagagatgtgaaggtgctggcctctgtgatggccctggccggcctggccatgggctgcatcgacacagtggccaacatgcagctggtgaggatgtaccagaaggacagcgctgtgttcctgcaggtgctgcacttctttgtgggctttggagccctgctgagccccctgattgctgaccccttcctgtctgaggccaactgcctgcctgccaacagcacagccaacaccaccagccggggccacctgttccacgtgtcccgggtgctgggccagcaccacgtggatgccaagccctggagcaaccagaccttccctggcctgacccccaaggatggagctggcaccagggtgtcctatgccttctggatcatggccctgatcaacctgcctgtgcccatggctgtgctgatgctgctgagcaaggagcggctgctgacctgctgcccccagaggcggcccctgctgctgtctgcagatgagctggccctggagacccagcccccagagaaggaggatgccagcagcctgccccccaagttccagagccacctgggccatgaagatctcttcagctgctgccagaggaagaacctgcggggggccccctacagcttctttgccatccacatcactggagccctggtgctcttcatgacagatggcctgactggagcctacagcgcctttgtgtacagctatgctgtggagaagcccctgtctgtgggccacaaggtggccggctacctgcccagcctcttctggggcttcatcaccctgggccgcctgctgagcatccccatcagcagcaggatgaagccagccaccatggtgttcatcaacgtggtgggcgtggtggtgaccttcctggtgctgctgatcttctcctacaacgtggtgttcctgtttgtgggcacagccagcctgggcctcttcctgagcagcaccttccccagcatgctggcctacacagaggacagcctgcagtacaaggacatccctggcagcggccagctgtag

SEQ ID NO: 35235 - DNA, 1299 bp, Artificial Sequence
  Description of Artificial Sequence: Synthetic coding sequence
atggaggtgacagctgtgggggaggaggccaaccagggcgacctgctgggcttcggccagcgctgctgcagcctgggcagcagcaacccctggctgtacagaacagctggcatcttccctgagcactgcacagaggagaagaagattggcacctacttccgggtggccccccaggccagcaagagccagaggagccgctgccacggcatggccgccagcgaggcccggcctggagaggccacagctgccagctatggccggcccttccccacccacccccggcggcaggagttccgggcccgggtggtgcggggccccaccatgctggtgacagcctacctggcctttgtgggcctgctggccagctgcctgggcctggagctgagccgctgccgggccaagcccccaggccgggcctgcagcaaccccagcttcctgcgcttccagctggacttctaccaggtgtacttcctggccctggccgctgactggctgcaggccccctacctgtacaagctgtaccagcactactacttcctggagggccagatcgccatcctgtatgtgtgtggcctggccagcacagtgctgtttggcctggtggccagcagcctggtggactggctgggcaggaagaacagctgtgtgctcttcagcctgacctacagcctgtgctgcctgaccaagctgagccaggactactttgtgctgctggtgggccgggccctgggcggcctgagcacagccctgctcttcagcgcctttgaggcctggtacatccatgaacatgtggagagacatgacttccctgctgagtggatcccagccacctttgcccgggccgccttctggaaccacgtgctggccgtggtggccggcgtggccgctgaggccgtggcctcctggattggcctgggccctgtggccccctttgtggccgccatccccctgctggccctggccggggccctggccctgaggaactggggagaaaattatgaccggcagagggccttcagcaggacctgtgccggcggcctgcgctgcctgctgagtgaccggcgggtgctgctgctgggcaccatccaggccctgtttgagagcgtcatcttcatctttgtgttcctgtggacccctgtgctggacccccacggggcccccctgggcatcatcttcagcagcttcatggccgccagcctgctgggcagcagcctgtaccgcatcgccaccagcaagaggacagtcatcgagaagcaggccctgggcatctgcagcgcctttgccctgctgtcctggtag

SEQ ID NO: 35236 - DNA, 1353 bp, Artificial Sequence
  Description of Artificial Sequence: Synthetic coding sequence
atgctggtgacagcctacctggcctttgtgggcctgctggccagctgcctgggcctggagctgagccgctgccgggccaagcccccaggccgggcctgcagcaaccccagcttcctgcgcttccagctggacttctaccaggtgtacttcctggccctggccgctgactggctgcaggccccctacctgtacaagctgtaccagcactactacttcctggagggccagatcgccatcctgtatgtgtgtggcctggccagcacagtgctgtttggcctggtggccagcagcctggtggactggctgggcaggaagaacagctgtgtgctcttcagcctgacctacagcctgtgctgcctgaccaagctgagccaggactactttgtgctgctggtgggccgggccctgggcggcctgagcacagccctgctcttcagcgcctttgaggcctggtacatccacgagcacgtggagagacatgacttccctgctgagtggatcccagccacctttgcccgggccgccttctggaaccacgtgctggccgtggtggccggcgtggccgctgaggccgtggcctcctggattggcctgggccctgtggccccctttgtggccgccatccccctgctggccctggccggggccctggccctgaggaactggggcgagaactatgaccggcagagggccttcagcaggacctgtgccggcggcctgcgctgcctgctgagtgacagaagagtgctgctgctgggcaccatccaggccctgtttgaatctgtcatcttcatctttgtgttcctgtggacccctgtgctggacccccatggagcccccctgggcatcatcttcagcagcttcatggccgccagcctgctgggcagcagcctgtacagaattgccaccagcaagcgctaccacctgcagcccatgcacctgctgagcctggccgtgctgattgtggtgttcagcctcttcatgctgaccttcagcaccagccctggccaggagagccctgtggagagcttcatcgccttcctgctgattgagctggcctgtggcctgtacttccccagcatgtccttcctgcggaggaaggtgattcctgagacagagcaggccggcgtgctgaactggttccgggtgcccctgcacagcctggcctgcctgggcctgctggtgctgcatgacagcgacaggaagacaggcaccaggaacatgttcagcatctgcagcgctgtgatggtgatggccctgctggccgtggtgggcctcttcaccgtggtgagacatgatgctgagctgcgggtgcccagccccacagaggagccctatgcccctgagctgtag

SEQ ID NO: 35237 - DNA, 1674 bp, Artificial Sequence
  Description of Artificial Sequence: Synthetic coding sequence
atggaggtgacagctgtgggggaggaggccaaccagggcgacctgctgggcttcggccagcgctgctgcagcctgggcagcagcaacccctggctgtacagaacagctggcatcttccctgagcactgcacagaggagaagaagattggcacctacttccgggtggccccccaggccagcaagagccagaggagccgctgccacggcatggccgccagcgaggcccggcctggagaggccacagctgccagctatggccggcccttccccacccacccccggcggcaggagttccgggcccgggtggtgcggggccccaccatgctggtgacagcctacctggcctttgtgggcctgctggccagctgcctgggcctggagctgagccgctgccgggccaagcccccaggccgggcctgcagcaaccccagcttcctgcgcttccagctggacttctaccaggtgtacttcctggccctggccgctgactggctgcaggccccctacctgtacaagctgtaccagcactactacttcctggagggccagatcgccatcctgtatgtgtgtggcctggccagcacagtgctgtttggcctggtggccagcagcctggtggactggctgggcaggaagaacagctgtgtgctcttcagcctgacctacagcctgtgctgcctgaccaagctgagccaggactactttgtgctgctggtgggccgggccctgggcggcctgagcacagccctgctcttcagcgcctttgaggcctggtacatccatgaacatgtggagagacatgacttccctgctgagtggatcccagccacctttgcccgggccgccttctggaaccacgtgctggccgtggtggccggcgtggccgctgaggccgtggcctcctggattggcctgggccctgtggccccctttgtggccgccatccccctgctggccctggccggggccctggccctgaggaactggggagaaaattatgaccggcagagggccttcagcaggacctgtgccggcggcctgcgctgcctgctgagtgaccggcgggtgctgctgctgggcaccatccaggccctgtttgagagcgtcatcttcatctttgtgttcctgtggacccctgtgctggacccccacggggcccccctgggcatcatcttcagcagcttcatggccgccagcctgctgggcagcagcctgtaccgcatcgccaccagcaagcgctaccacctgcagcccatgcacctgctgagcctggccgtgctgattgtggtgttcagcctcttcatgctgaccttcagcaccagccctggccaggagagccctgtggagagcttcatcgccttcctgctgattgagctggcctgtggcctgtacttccccagcatgtccttcctgcggaggaaggtgattcctgagacagagcaggccggcgtgctgaactggttccgggtgcccctgcacagcctggcctgcctgggcctgctggtgctgcatgacagcgacaggaagacaggcaccaggaacatgttcagcatctgcagcgctgtgatggtgatggccctgctggccgtggtgggcctcttcaccgtggtgagacatgatgctgagctgcgggtgcccagccccacagaggagccctatgcccctgagctgtag

SEQ ID NO: 35238 - DNA, 1395 bp, Artificial Sequence
  Description of Artificial Sequence: Synthetic coding sequence
atggaggtgacagctgtgggggaggaggccaaccagggcgacctgctgggcttcggccagcgctgctgcagcctgggcagcagcaacccctggctgtacagaacagctggcatcttccctgagcactgcacagaggagaagaagattggcacctacttccgggtggccccccaggccagcaagagccagaggagccgctgccacggcatggccgccagcgaggcccggcctggagaggccacagctgccagctatggccggcccttccccacccacccccggcggcaggagttccgggcccgggtggtgcggggccccaccatgctggtgacagcctacctggcctttgtgggcctgctggccagctgcctgggcctggagctgagccgctgccgggccaagcccccaggccgggcctgcagcaaccccagcttcctgcgcttccagctggacttctaccaggtgtacttcctggccctggccgctgactggctgcaggccccctacctgtacaagctgtaccagcactactacttcctggagggccagatcgccatcctgtatgtgtgtggcctggccagcacagtgctgtttggcctggtggccagcagcctggtggactggctgggcaggaagaacagctgtgtgctcttcagcctgacctacagcctgtgctgcctgaccaagctgagccaggactactttgtgctgctggtgggccgggccctgggcggcctgagcacagccctgctcttcagcgcctttgaggcctggtacatccatgaacatgtggagagacatgacttccctgctgagtggatcccagccacctttgcccgggccgccttctggaaccacgtgctggccgtggtggccggcgtggccgctgaggccgtggcctcctggattggcctgggccctgtggccccctttgtggccgccatccccctgctggccctggccggggccctggccctgaggaactggggagaaaattatgaccggcagagggccttcagcaggacctgtgccggcggcctgcgctgcctgctgagtgaccggcgggtgctgctgctgggcaccatccaggccctgtttgagagcgtcatcttcatctttgtgttcctgtggacccctgtgctggacccccacggggcccccctgggcatcatcttcagcagcttcatggccgccagcctgctgggcagcagcctgtaccgcatcgccaccagcaagagtgacaggaagacaggcaccaggaacatgttcagcatctgcagcgctgtgatggtgatggccctgctggccgtggtgggcctcttcaccgtggtgagacatgatgctgagctgcgggtgcccagccccacagaggagccctatgcccctgagctgtag

SEQ ID NO: 35239 - DNA, 1761 bp, Artificial Sequence
  Description of Artificial Sequence: Synthetic coding sequence
atgtctgccaacccccgctgggacatcagccgggccctgggcgtggccaagctgttccacctggtgtgtggggtgcgggaggcctgtgtgacccccttcctgaccctgtacctgcggcagctgggcctggccgccccctgggtgggcaccctgatgggcaccaagcacctgattgctgccttctgggcccctgtgtgtgccttcctggccaagagctacaggaagaggcgggccctgctgattggcagcctgctgggctctgtgggcgccagcctgctgatggtgctggtgccccctgtggacaagaacagagtgcacttcccctgcaatggcagcagcggcctgaccagcacagatgccctgcccggggtgaccctgcctgtgaacatcaccagcgcccaggagagcgccagcagccacccagccaagaggacagctgaggtggagatgcctggcttcaggaaccccccaggagagagtgaccgggagaccttccgggacctgcacgtgtacctggcccccagcgtggagggcgcccggaccaccagccaggccctgctgcaccctgtgaccagcggcctgaaggaccacccctgggaggtgacctttgaggtggtgaagacagccctgcccctgctgcccggcggcaaaggacctggcaacccagccaacctgagcggcaccaagggcaaggcctgggcctttgacctgagcctggaggccctgcggaggaccttcatcctgagcctgggctctgtggccttctgggagctgctgacagcccccctggagcaggtggctgatgacagcctgtatgagttcctggactttgtggatgccacagaccgctaccgcagcctgtgggtgtggaggctgctgggcatgtctgctggggtgtgtggcatcacagccctggtgggccagctggactgcttcctgatgaccagcggcccccggggcgtggtgcacttctacggctacagcgtggtgtccaccctggccctgctggtgtccatcgccttccccatccccatctgccagcagtgggagcccagctacaagagggtgaaggccctgagcatcgtgggcggggacccccacctgatcctgctggccagcaccaccgtgctggtgggcgccatcgtgtccacagtgcagaacttcctgttctggcacatgaaggaccacggcagcggggagctggtgatgggcttctctgtggccctgagcctgctgggggagatcctgctgcaccccttcaaggccaccctgctgaggaagctgagcaggacaggcctggtgggcctgggcctgagctgcctggccggccagctgctgtactacagcttcctgtggagctggtggagcgtgctgcccatccagatcctgagcgccatcagcaacagagccctgtggtgggccgtgggcgcctctgtggaggacctggccacccccaggatggagcgggccctgagcgccctcttccggggccacttctacggcagcggctgcagcctgggcagctttgtgggcggctttgtggtgatgaggttcagcctggccgtgctgtaccaggcctgctgcgtggccctgctgctgtggctggccctgctgctgagcatccagaggcggctgccccgggagaggaagatcaagtacagcaagctgctgtccatggaggtgtctgacaccagtgacagcgagcagggcacagagcaggactggctggtgaaggccatgagggaggagcacagcgactag

SEQ ID NO: 35240 - DNA, 1680 bp, Artificial Sequence
  Description of Artificial Sequence: Synthetic coding sequence
atggccggccccacagaagctgagaccggcctggccgagccccgggccctgtgtgcccagaggggccacaggacctacgcccggcgctgggtgttcctgctggccatcagcctgctgaactgcagcaatgccaccctgtggctgagctttgcccctgtggctgatgtgattgctgaggacctggtgctgtccatggagcagatcaactggctgagcctggtgtacctggtggtgtccacccccttcggcgtggccgccatctggatcctggacagcgtgggcctgcgggccgccaccatcctgggcgcctggctgaactttgctggctctgtgctgaggatggtgccctgcatggtggtgggcacccagaacccctttgccttcctgatgggcggccagagcctgtgtgccctggcccagagcctggtgatcttctccccagccaagctggccgccctgtggttccctgagcaccagagggccacagccaacatgctggccaccatgagcaaccccctgggcgtgctggtggccaacgtgctgagccctgtgctggtgaagaagggggaggacatccccctgatgctgggcgtgtacaccatcccagctggggtggtgtgcctgctgagcaccatctgcctgtgggagagcgtgccccccaccccacccagcgctggagctgccagcagcaccagcgagaagttcctggatggcctgaagctgctgatgtggaacaaggcctacgtgatcctggccgtgtgcctgggcggcatgattggcatcagcgccagcttcagcgccctgctggagcagatcctgtgtgccagcggccacagcagcggcttcagcggcctgtgtggggccctcttcatcaccttcggcatcctgggcgccctggccctgggcccctacgtggacaggaccaagcacttcacagaggccaccaagattggcctgtgcctcttcagcctggcctgtgtgccctttgccctggtgtcccagctgcagggccagaccctggccctggccgccacctgcagcctgctgggcctgtttggcttctctgtgggccctgtggccatggagctggccgtggagtgcagcttccctgtgggggagggcgccgccaccggcatgatctttgtgctgggccaggccgagggcatcctgatcatgctggccatgacagccctgactgtgagaagaagtgagcccagcctgagcacctgccagcagggcgaggaccccctggactggacagtgtccctgctgctgatggccggcctgtgcaccttcttcagctgcatcctggccgtgttcttccacaccccctaccgccgcctgcaggccgagagcggggagccccccagcaccagaaatgctgtgggcggcgctgacagcggccctggggtggaccggggcggggccggccgggccggcgtgctgggccccagcacagccaccccagagtgcacagcccggggggccagcctggaggacccccggggccctggcagcccccacccagcctgccaccgggccaccccccgggcccagggccctgctgccacagatgcccccagccggcccggccgcctggccggccgggtgcaggccagccgcttcattgatcctgctggcagccacagcagcttcagcagcccctgggtgatcacctag

SEQ ID NO: 35241 - DNA, 1326 bp, Artificial Sequence
  Description of Artificial Sequence: Synthetic coding sequence
atggccggccccacagaagctgagaccggcctggccgagccccgggccctgtgtgcccagaggggccacaggacctacgcccggcgctgggtgttcctgctggccatcagcctgctgaactgcagcaatgccaccatcaactggctgagcctggtgtacctggtggtgtccacccccttcggcgtggccgccatctggatcctggacagcgtgggcctgcgggccgccctgggcgtgtacaccatcccagctggggtggtgtgcctgctgagcaccatctgcctgtgggagagcgtgccccccaccccaccttctgctggggccgccagcagcaccagcgagaagttcctggatggcctgaagctgcagctgatgtggaacaaggcctacgtgatcctggccgtgtgcctgggcggcatgattggcatcagcgccagcttcagcgccctgctggagcagatcctgtgtgccagcggccacagcagcggcttcagcggcctgtgtggggccctcttcatcaccttcggcatcctgggcgccctggccctgggcccctacgtggacaggaccaagcacttcacagaggccaccaagattggcctgtgcctcttcagcctggcctgtgtgccctttgccctggtgtcccagctgcagggccagaccctggccctggccgccacctgcagcctgctgggcctgtttggcttctctgtgggccctgtggccatggagctggccgtggagtgcagcttccctgtgggggagggcgccgccaccggcatgatctttgtgctgggccaggccgagggcatcctgatcatgctggccatgacagccctgactgtgagaagaagtgagcccagcctgagcacctgccagcagggcgaggaccccctggactggacagtgtccctgctgctgatggccggcctgtgcaccttcttcagctgcatcctggccgtgttcttccacaccccctaccgccgcctgcaggccgagagcggggagccccccagcaccagaaatgctgtgggcggcgctgacagcggccctggggtggaccggggcggggccggccgggccggcgtgctgggccccagcacagccaccccagagtgcacagcccggggggccagcctggaggacccccggggccctggcagcccccacccagcctgccaccgggccaccccccgggcccagggccctgctgccacagatgcccccagccggcccggccgcctggccggccgggtgcaggccagccgcttcattgatcctgctggcagccacagcagcttcagcagcccctgggtgatcacctag

SEQ ID NO: 35242 - DNA, 1683 bp, Artificial Sequence
  Description of Artificial Sequence: Synthetic coding sequence
atggccggccccacagaagctgagaccggcctggccgagccccgggccctgtgtgcccagaggggccacaggacctacgcccggcgctgggtgttcctgctggccatcagcctgctgaactgcagcaatgccaccctgtggctgagctttgcccctgtggctgatgtgattgctgaggacctggtgctgtccatggagcagatcaactggctgagcctggtgtacctggtggtgtccacccccttcggcgtggccgccatctggatcctggacagcgtgggcctgcgggccgccaccatcctgggcgcctggctgaactttgctggctctgtgctgaggatggtgccctgcatggtggtgggcacccagaacccctttgccttcctgatgggcggccagagcctgtgtgccctggcccagagcctggtgatcttctccccagccaagctggccgccctgtggttccctgagcaccagagggccacagccaacatgctggccaccatgagcaaccccctgggcgtgctggtggccaacgtgctgagccctgtgctggtgaagaagggggaggacatccccctgatgctgggcgtgtacaccatcccagctggggtggtgtgcctgctgagcaccatctgcctgtgggagagcgtgccccccaccccacccagcgctggagctgccagcagcaccagcgagaagttcctggatggcctgaagctgcagctgatgtggaacaaggcctacgtgatcctggccgtgtgcctgggcggcatgattggcatcagcgccagcttcagcgccctgctggagcagatcctgtgtgccagcggccacagcagcggcttcagcggcctgtgtggggccctcttcatcaccttcggcatcctgggcgccctggccctgggcccctacgtggacaggaccaagcacttcacagaggccaccaagattggcctgtgcctcttcagcctggcctgtgtgccctttgccctggtgtcccagctgcagggccagaccctggccctggccgccacctgcagcctgctgggcctgtttggcttctctgtgggccctgtggccatggagctggccgtggagtgcagcttccctgtgggggagggcgccgccaccggcatgatctttgtgctgggccaggccgagggcatcctgatcatgctggccatgacagccctgactgtgcggcgctctgagcccagcctgagcacctgccagcagggcgaggaccccctggactggacagtgtccctgctgctgatggccggcctgtgcaccttcttcagctgcatcctggccgtgttcttccacaccccctacagaaggctgcaggccgagagcggggagccccccagcaccagaaatgctgtgggcggcgctgacagcggccctggggtggacagaggaggagctggccgggccggcgtgctgggccccagcacagccaccccagaatgtacagcccggggggccagcctggaggacccccggggccctggcagcccccacccagcctgccaccgggccaccccccgggcccagggccctgctgccacagatgcccccagcaggcctggccgcctggccggccgggtgcaggccagccgcttcatcgaccctgctggcagccacagcagcttcagcagcccctgggtgatcacctag

SEQ ID NO: 35243 - DNA, 1425 bp, Artificial Sequence
  Description of Artificial Sequence: Synthetic coding sequence
atggagctgggcggccactgggacatgaacagcgccccccggctggtgtctgaaacagctgagaggaagcaggagcagaagacaggaacagaggccgaggccgctgacagcggggctgtgggcgcccggcgcttcctgctgtgcctgtacctggtgggcttcctggacctgtttggagtgtccatggtggtgcccctgctgagcctgcacgtgaagagcctgggcgccagccccaccgtggccggcatcgtgggcagcagctatggcatcctgcagctgttcagcagcaccctggtgggctgctggagcgatgtggtgggccgccgcagcagcctgctggcctgcatcctgctgagcgccctgggctacctgctgctgggcgccgccaccaacgtgttcctgtttgtgctggcccgggtgcctgctggcatcttcaagcacaccctgagcatcagccgggccctgctgagtgatgtggtgcctgagaaggagcggcccctggtgattggccacttcaacacagccagcggcgtgggcttcatcctgggccctgtggtgggcggctacctgacagagctggaggatggcttctacctgacagccttcatctgcttcctggtgttcatcctgaatgccggcctggtgtggttcttcccctggagggaggccaagccaggcagcacagagaagggcctgcccctgaggaagacccacgtgctgctgggccgcagccatgacacagtgcaggaggccgccaccagcagaagagcccgggccagcaagaagacagcccagccctgggtggaggtggtgctggccctgaggaacatgaagaacctgctcttcagcgagatgtgggacatcttcctggtgcggctgctgatggccatggctgtgatgctgtactacagcaactttgtgctggccctggaggagcgcttcggcgtgcggcccaaggtgacaggctacctgatctcctacagctccatgctgggcgctgtggccggcctggccctgggccccatcctgcggctgtacaagcacaacagccaggccctgctgctgcacagcagcatcctgacctgcaccctgctgctgctgtacagcctggcccccaccatgggcgctgtggtgctgagcagcaccctgctgtccttcagcacagccatcggccgcacctgcatcacagacctgcagctgactgtgggcggggcccaggccagcggcaccctcatcggcgtgggccagagcgtgacagctgtgggccgcatcatcgcccccctgctgagcggcgtggcccaggaggtgagcccctgtggcccccccagcctgggcgctgtgctggccctggtggccatcttcatcatgagcctgaacaagaggcacagcagtggagatggcaacagcaagctgaagtctgagtag

SEQ ID NO: 35244 - DNA, 465 bp, Artificial Sequence
  Description of Artificial Sequence: Synthetic coding sequence
atggctgtgatggcccccaggaccctgctgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggaccaggagaccagaaatgtgaaggcccagagccagacagacagagtggacctgggcaccctgcggggctactacaaccagagcgaggccggcagccacaccatccagatcatgtatggctgtgatgtgggcagtgatggccgcttcctgcggggctaccgcctgcggagccccagcgccagcggcagaagacccatgagaagaagcagctag

SEQ ID NO: 35245 - DNA, 900 bp, Artificial Sequence
  Description of Artificial Sequence: Synthetic coding sequence
atggctgtgatggcccccaggaccctgctgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggaccaggagaccagaaatgtgaaggcccagagccagacagacagagtggacctgggcaccctgcggggctactacaaccagagcgaggccggcagccacaccatccagatcatgtatggctgtgatgtgggcagtgatggccgcttcctgcggggctaccggcaggatgcctatgatggcaaggactacatcgccctgaatgaagacctgcgctcctggacagctgctgacatggccgcccagatcaccaagaggaagtgggaggccgcccatgaagctgagcagctgcgggcctacctggatggcacctgtgtggagtggctgcggcgctacctggagaatggcaaggagaccctgcagaggacagacccccccaagacccacatgacccaccaccccatcagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcccaagcccctgaccctgcgctgggtgtag

SEQ ID NO: 35246 - DNA, 1116 bp, Artificial Sequence
  Description of Artificial Sequence: Synthetic coding sequence
atggctgtgatggcccccaggaccctgctgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggaccaggagaccagaaatgtgaaggcccagagccagacagacagagtggacctgggcaccctgcggggctactacaaccagagcgaggccggcagccacaccatccagatcatgtatggctgtgatgtgggcagtgatggccgcttcctgcggggctaccggcaggatgcctatgatggcaaggactacatcgccctgaatgaagacctgcgctcctggacagctgctgacatggccgcccagatcaccaagaggaagtgggaggccgcccatgaagctgagcagctgcgggcctacctggatggcacctgtgtggagtggctgcggcgctacctggagaatggcaaggagaccctgcagaggacagacccccccaagacccacatgacccaccaccccatcagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcccaagcccctgaccctgcgctgggagctgagcagccagcccaccatccccatcgtgggcatcatcgccggcctggtgctgctgggcgccgtcatcactggagctgtggtggccgctgtgatgtggaggaggaagagcagtggaggagaaggagtgaaggacaggaagggcggcagctacacccaggccgccagcagtgacagcgcccagggcagtgatgtgtccctgacagcctgcaaggtgtag

SEQ ID NO: 35247 - DNA, 1098 bp, Artificial Sequence
  Description of Artificial Sequence: Synthetic coding sequence
atggctgtgatggcccccaggaccctgctgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggaccaggagaccagaaatgtgaaggcccagagccagacagacagagtggacctgggcaccctgcggggctactacaaccagagcgaggccggcagccacaccatccagatcatgtatggctgtgatgtgggcagtgatggccgcttcctgcggggctaccggcaggatgcctatgatggcaaggactacatcgccctgaatgaagacctgcgctcctggacagctgctgacatggccgcccagatcaccaagaggaagtgggaggccgcccatgaagctgagcagctgcgggcctacctggatggcacctgtgtggagtggctgcggcgctacctggagaatggcaaggagaccctgcagaggacagacccccccaagacccacatgacccaccaccccatcagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcccaagcccctgaccctgcgctgggagctgagcagccagcccaccatccccatcgtgggcatcatcgccggcctggtgctgctgggcgccgtcatcactggagctgtggtggccgctgtgatgtggaggaggaagagcagtgacaggaagggcggcagctacacccaggccgccagcagtgacagcgcccagggcagtgatgtgtccctgacagcctgcaaggtgtag

SEQ ID NO: 35248 - DNA, 900 bp, Artificial Sequence
  Description of Artificial Sequence: Synthetic coding sequence
atggctgtgatggcccccaggaccctggtgctgctgctgagcggggccctggccctgacccagacctgggccggcagccacagcatgagatacttctacacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggacaggaacaccagaaatgtgaaggcccacagccagacagaccgggccaacctgggcaccctgcggggctactacaaccagagtgaagatggcagccacaccatccagaggatgtatggctgtgatgtgggcccagatggccgcttcctgcggggctaccagcaggatgcctatgatggcaaggactacatcgccctgaatgaagacctgcgctcctggacagctgctgacatggccgcccagatcacccagaggaagtgggagacagcccatgaagctgagcagtggagggcctacctggagggccgctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggtgtag

SEQ ID NO: 35249 - DNA, 1098 bp, Artificial Sequence
  Description of Artificial Sequence: Synthetic coding sequence
atggctgtgatggcccccaggaccctggtgctgctgctgagcggggccctggccctgacccagacctgggccggcagccacagcatgagatacttctacacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggacaggaacaccagaaatgtgaaggcccacagccagacagaccgggccaacctgggcaccctgcggggctactacaaccagagtgaagatggcagccacaccatccagaggatgtatggctgtgatgtgggcccagatggccgcttcctgcggggctaccagcaggatgcctatgatggcaaggactacatcgccctgaatgaagacctgcgctcctggacagctgctgacatggccgcccagatcacccagaggaagtgggagacagcccatgaagctgagcagtggagggcctacctggagggccgctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgattgctggagctgtggtggccgctgtgatgtggaggaggaagagcagtgacaggaagggcggcagctacagccaggccgccagcagtgacagcgcccagggcagtgacatgagcctgacagcctgcaaggtgtag

SEQ ID NO: 35250 - DNA, 1116 bp, Artificial Sequence
  Description of Artificial Sequence: Synthetic coding sequence
atggctgtgatggcccccaggaccctggtgctgctgctgagcggggccctggccctgacccagacctgggccggcagccacagcatgagatacttctacacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggacaggaacaccagaaatgtgaaggcccacagccagacagaccgggccaacctgggcaccctgcggggctactacaaccagagtgaagatggcagccacaccatccagaggatgtatggctgtgatgtgggcccagatggccgcttcctgcggggctaccagcaggatgcctatgatggcaaggactacatcgccctgaatgaagacctgcgctcctggacagctgctgacatggccgcccagatcacccagaggaagtgggagacagcccatgaagctgagcagtggagggcctacctggagggccgctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgattgctggagctgtggtggccgctgtgatgtggaggaggaagagcagtggaggagagggcatgaaggacaggaagggcggcagctacagccaggccgccagcagtgacagcgcccagggcagtgacatgagcctgacagcctgcaaggtgtag

SEQ ID NO: 35251 - DNA, 1098 bp, Artificial Sequence; identical to SEQ ID NO: 35247
  Description of Artificial Sequence: Synthetic coding sequence

SEQ ID NO: 35252 - DNA, 900 bp, Artificial Sequence
  Description of Artificial Sequence: Synthetic coding sequence
tgagctgtgatggcccccaggaccctggtgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggatggagagaccaggaaggtgaaggcccacagccagacccaccgggtggacctgggcaccctgcggggctactacaaccagagcgaggccggcagccacacagtgcagaggatgtatggctgtgatgtgggcagtgactggaggttcctgcggggctaccaccagtatgcctatgatggcaaggactacatcgccctgaaggaggacctgcgctcctggacagctgctgacatggccgcccagaccaccaagcacaagtgggaggccgcccacgtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacgtgcagcacgagggcctgcccaagcccctgaccctgcgctgggtgtag

SEQ ID NO: 35253 - DNA, 900 bp, Artificial Sequence
  Description of Artificial Sequence: Synthetic coding sequence
atggctgtgatggcccccaggaccctgctgctgctgctgctgggcgccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggaccaggagaccagaaatgtgaaggcccacagccagacagaccgggagagcctgcgcatcgccctgcgctactacaaccagagcgaggccggcagccacaccatccagatgatgtatggctgtgatgtgggcccagatggccgcctgctgcggggctaccagcaggatgcctatgatggcaaggactacatcgccctgaatgaagacctgcgctcctggacagctgctgacatggccgcccagatcacccagaggaagtgggaggccgcccgggtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggtgtag

SEQ ID NO: 35254 - DNA, 900 bp, Artificial Sequence
  Description of Artificial Sequence: Synthetic coding sequence
atggctgtgatggcccccaggaccctgctgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaagatggagccccgggccccctggattgagcaggagggccctgagtactgggaccaggagaccaggaacatgaaggcccacagccagacagaccgggccaacctgggcaccctgcggggctactacaaccagagtgaagatggcagccacaccatccagatcatgtatggctgtgatgtgggcccagatggccgcttcctgcggggctaccggcaggatgcctatgatggcaaggactacatcgccctgaatgaagacctgcgctcctggacagctgctgacatggccgcccagatcaccaagaggaagtgggaggccgtgcacgccgctgagcagaggagagtgtacctggagggccgctgtgtggatggcctgcggcgctacctggagaatggcaaggagaccctgcagaggacagacccccccaagacccacatgacccaccaccccatcagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcccaagcccctgaccctgcgctgggtgtag

SEQ ID NO: 35255 - DNA, 1116 bp, Artificial Sequence
  Description of Artificial Sequence: Synthetic coding sequence
atggctgtgatggcccccaggaccctgctgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaagatggagccccgggccccctggattgagcaggagggccctgagtactgggaccaggagaccaggaacatgaaggcccacagccagacagaccgggccaacctgggcaccctgcggggctactacaaccagagtgaagatggcagccacaccatccagatcatgtatggctgtgatgtgggcccagatggccgcttcctgcggggctaccggcaggatgcctatgatggcaaggactacatcgccctgaatgaagacctgcgctcctggacagctgctgacatggccgcccagatcaccaagaggaagtgggaggccgtgcacgccgctgagcagaggagagtgtacctggagggccgctgtgtggatggcctgcggcgctacctggagaatggcaaggagaccctgcagaggacagacccccccaagacccacatgacccaccaccccatcagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcccaagcccctgaccctgcgctgggagctgagcagccagcccaccatccccatcgtgggcatcatcgccggcctggtgctgctgggcgccgtcatcactggagctgtggtggccgctgtgatgtggaggaggaagagcagtggaggagaaggagtgaaggacaggaagggcggcagctacacccaggccgccagcagtgacagcgcccagggcagtgatgtgtccctgacagcctgcaaggtgtag

SEQ ID NO: 35256 - DNA, 1098 bp, Artificial Sequence
  Description of Artificial Sequence: Synthetic coding sequence
atggctgtgatggcccccaggaccctgctgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaagatggagccccgggccccctggattgagcaggagggccctgagtactgggaccaggagaccaggaacatgaaggcccacagccagacagaccgggccaacctgggcaccctgcggggctactacaaccagagtgaagatggcagccacaccatccagatcatgtatggctgtgatgtgggcccagatggccgcttcctgcggggctaccggcaggatgcctatgatggcaaggactacatcgccctgaatgaagacctgcgctcctggacagctgctgacatggccgcccagatcaccaagaggaagtgggaggccgtgcacgccgctgagcagaggagagtgtacctggagggccgctgtgtggatggcctgcggcgctacctggagaatggcaaggagaccctgcagaggacagacccccccaagacccacatgacccaccaccccatcagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcccaagcccctgaccctgcgctgggagctgagcagccagcccaccatccccatcgtgggcatcatcgccggcctggtgctgctgggcgccgtcatcactggagctgtggtggccgctgtgatgtggaggaggaagagcagtgacaggaagggcggcagctacacccaggccgccagcagtgacagcgcccagggcagtgatgtgtccctgacagcctgcaaggtgtag

SEQ ID NO: 35257 - DNA, 1116 bp, Artificial Sequence
  Description of Artificial Sequence: Synthetic coding sequence
atggctgtgatggcccccaggaccctggtgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggatggagagaccaggaaggtgaaggcccacagccagacccaccgggtggacctgggcaccctgcggggctactacaaccagagcgaggccggcagccacacagtgcagaggatgtatggctgtgatgtgggcagtgactggaggttcctgcggggctaccaccagtatgcctatgatggcaaggactacatcgccctgaaggaggacctgcgctcctggacagctgctgacatggccgcccagaccaccaagcacaagtgggaggccgcccacgtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgatcactggagctgtggtggccgctgtgatgtggaggaggaagagcagtggaggagaaggagtgaaggacaggaagggcggcagctacagccaggccgccagcagtgacagcgcccagggcagtgatgtgtccctgacagcctgcaaggtgtag

SEQ ID NO: 35258 - DNA, 900 bp, Artificial Sequence; identical to SEQ ID NO: 35254
  Description of Artificial Sequence: Synthetic coding sequence

SEQ ID NO: 35259 - DNA, 1098 bp, Artificial Sequence; identical to SEQ ID NO: 35256
  Description of Artificial Sequence: Synthetic coding sequence

SEQ ID NO: 35260 - DNA, 1116 bp, Artificial Sequence; identical to SEQ ID NO: 35255
  Description of Artificial Sequence: Synthetic coding sequence

SEQ ID NO: 35261 - DNA, 900 bp, Artificial Sequence
  Description of Artificial Sequence: Synthetic coding sequence
atggctgtgatggcccccaggaccctgctgctgctgctgctgggcgccctggccctgacccagacctgggccggcagccacagcatgagatacttcaccacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggacctgcagaccagaaatgtgaaggcccagagccagacagaccgggccaacctgggcaccctgcggggctactacaaccagagcgaggccggcagccacaccatccagatgatgtatggctgtgatgtgggcagtgatggccgcttcctgcggggctaccggcaggatgcctatgatggcaaggactacatcgccctgaatgaagacctgcgctcctggacagctgctgacatggccgcccagatcacccagaggaagtgggaggccgcccgggtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggtgtag

SEQ ID NO: 35262 - DNA, 1098 bp, Artificial Sequence
  Description of Artificial Sequence: Synthetic coding sequence
tgagctgtgatggcccccaggaccctggtgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggatggagagaccaggaaggtgaaggcccacagccagacccaccgggtggacctgggcaccctgcggggctactacaaccagagcgaggccggcagccacacagtgcagaggatgtatggctgtgatgtgggcagtgactggaggttcctgcggggctaccaccagtatgcctatgatggcaaggactacatcgccctgaaggaggacctgcgctcctggacagctgctgacatggccgcccagaccaccaagcacaagtgggaggccgcccacgtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgatcactggagctgtggtggccgctgtgatgtggaggaggaagagcagtgacaggaagggcggcagctacagccaggccgccagcagtgacagcgcccagggcagtgatgtgtccctgacagcctgcaaggtgtag

SEQ ID NO: 35263 - DNA, 900 bp, Artificial Sequence
  Description of Artificial Sequence: Synthetic coding sequence
atggctgtgatggcccccaggaccctggtgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggatggagagaccaggaaggtgaaggcccacagccagacccaccgggtggacctgggcaccctgcggggctactacaaccagagcgaggccggcagccacacagtgcagaggatgtatggctgtgatgtgggcagtgactggaggttcctgcggggctaccaccagtatgcctatgatggcaaggactacatcgccctgaaggaggacctgcgctcctggacagctgctgacatggccgcccagaccaccaagcacaagtgggaggccgcccacgtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacgtgcagcacgagggcctgcccaagcccctgaccctgcgctgggtgtag

SEQ ID NO: 35264 - DNA, 1098 bp, Artificial Sequence
  Description of Artificial Sequence: Synthetic coding sequence
atggctgtgatggcccccaggaccctgctgctgctgctgctgggcgccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggaccaggagaccagaaatgtgaaggcccacagccagacagaccgggagagcctgcgcatcgccctgcgctactacaaccagagcgaggccggcagccacaccatccagatgatgtatggctgtgatgtgggcccagatggccgcctgctgcggggctaccagcaggatgcctatgatggcaaggactacatcgccctgaatgaagacctgcgctcctggacagctgctgacatggccgcccagatcacccagaggaagtgggaggccgcccgggtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagccatgtttgctggagctgtggtggccgctgtgcgctggaggaggaagagcagtgacaggaagggcggcagctacagccaggccgccagcagtgacagcgcccagggcagtgacatgagcctgacagcctgcaaggtgtag

SEQ ID NO: 35265 - DNA, 1116 bp, Artificial Sequence
  Description of Artificial Sequence: Synthetic coding sequence
tgagctgtgatggcccccaggaccctggtgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggatggagagaccaggaaggtgaaggcccacagccagacccaccgggtggacctgggcaccctgcggggctactacaaccagagcgaggccggcagccacacagtgcagaggatgtatggctgtgatgtgggcagtgactggaggttcctgcggggctaccaccagtatgcctatgatggcaaggactacatcgccctgaaggaggacctgcgctcctggacagctgctgacatggccgcccagaccaccaagcacaagtgggaggccgcccacgtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgatcactggagctgtggtggccgctgtgatgtggaggaggaagagcagtggaggagaaggagtgaaggacaggaagggcggcagctacagccaggccgccagcagtgacagcgcccagggcagtgatgtgtccctgacagcctgcaaggtgtag

SEQ ID NO: 35266 - DNA, 1098 bp, Artificial Sequence
  Description of Artificial Sequence: Synthetic coding sequence
atggctgtgatggcccccaggaccctgctgctgctgctgctgggcgccctggccctgacccagacctgggccggcagccacagcatgagatacttcaccacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggacctgcagaccagaaatgtgaaggcccagagccagacagaccgggccaacctgggcaccctgcggggctactacaaccagagcgaggccggcagccacaccatccagatgatgtatggctgtgatgtgggcagtgatggccgcttcctgcggggctaccggcaggatgcctatgatggcaaggactacatcgccctgaatgaagacctgcgctcctggacagctgctgacatggccgcccagatcacccagaggaagtgggaggccgcccgggtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgtttgctggagctgtggtggccgctgtgcgctggaggaggaagagcagtgacaggaagggcggcagctacagccaggccgccagcagtgacagcgcccagggcagtgacatgagcctgacagcctgcaaggtgtag

SEQ ID NO: 35267 - DNA, 1098 bp, Artificial Sequence
  Description of Artificial Sequence: Synthetic coding sequence
atggctgtgatggcccccaggaccctggtgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggatggagagaccaggaaggtgaaggcccacagccagacccaccgggtggacctgggcaccctgcggggctactacaaccagagcgaggccggcagccacacagtgcagaggatgtatggctgtgatgtgggcagtgactggaggttcctgcggggctaccaccagtatgcctatgatggcaaggactacatcgccctgaaggaggacctgcgctcctggacagctgctgacatggccgcccagaccaccaagcacaagtgggaggccgcccacgtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgatcactggagctgtggtggccgctgtgatgtggaggaggaagagcagtgacaggaagggcggcagctacagccaggccgccagcagtgacagcgcccagggcagtgatgtgtccctgacagcctgcaaggtgtag

SEQ ID NO: 35268 - DNA, 1029 bp, Artificial Sequence
  Description of Artificial Sequence: Synthetic coding sequence
atggctgtgatggcccccaggaccctgctgctgctgctgctgggcgccctggccctgacccagacctgggccggcagccacagcatgagatacttcaccacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggacctgcagaccagaaatgtgaaggcccagagccagacagaccgggccaacctgggcaccctgcggggctactacaaccagagcgaggccggcagccacaccatccagatgatgtatggctgtgatgtgggcagtgatggccgcttcctgcggggctaccggcaggatgcctatgatggcaaggactacatcgccctgaatgaagacctgcgctcctggacagctgctgacatggccgcccagatcacccagaggaagtgggaggccgcccgggtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgtttgctggagctgtggtggccgctgtgcgctggaggaggaagagcagtggaggagtgaagggctag

SEQ ID NO: 35269 - DNA, 345 bp, Artificial Sequence
  Description of Artificial Sequence: Synthetic coding sequence
atgacccaccaccccatcagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcccaagcccctgaccctgcgctgggacagaaaaggaggcagctacacccaggccgccagcagtgacagcgcccagggcagtgatgtgtccctgacagcctgcaaggtgtag

SEQ ID NO: 35270 - DNA, 465 bp, Artificial Sequence
  Description of Artificial Sequence: Synthetic coding sequence
atggctgtgatggcccccaggaccctgctgctgctgctgagcggggccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaagatggagccccgggccccctggattgagcaggagggccctgagtactgggaccaggagaccaggaacatgaaggcccacagccagacagaccgggccaacctgggcaccctgcggggctactacaaccagagtgaagatggcagccacaccatccagatcatgtatggctgtgatgtgggcccagatggccgcttcctgcggggctaccgcctgcggagccccagcgccagcggcagaagatccatgagaagaagcagctag

SEQ ID NO: 35271 - DNA, 1098 bp, Artificial Sequence; identical to SEQ ID NO: 35267
  Description of Artificial Sequence: Synthetic coding sequence

SEQ ID NO: 35272 - DNA, 1089 bp, Artificial Sequence
  Description of Artificial Sequence: Synthetic coding sequence
atggcccccaggaccctgctgctgctgctgagcggggccctggccctgacccagacctgggccggcagccacagcatgagatacttcttcacctctgtgtcccggcccggccgcggggagccccgcttcatcgctgtgggctacgtggatgacacccagtttgtgcgctttgacagtgatgctgccagccagaggatggagccccgggccccctggattgagcaggagggccctgagtactgggatggagagaccaggaaggtgaaggcccacagccagacccaccgggtggacctgggcaccctgcggggctactacaaccagagcgaggccggcagccacacagtgcagaggatgtatggctgtgatgtgggcagtgactggaggttcctgcggggctaccaccagtatgcctatgatggcaaggactacatcgccctgaaggaggacctgcgctcctggacagctgctgacatggccgcccagaccaccaagcacaagtgggaggccgcccacgtggccgagcagctgcgggcctacctggagggcacctgtgtggagtggctgcggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgatcaccggggctgtggtggccgctgtgatgtggaggaggaagagcagtgacagaaaaggaggcagctacagccaggccgccagcagtgacagcgcccagggcagtgatgtgtccctgacagcctgcaaggtgtag

SEQ ID NO: 35273 - DNA, 1098 bp, Artificial Sequence; identical to SEQ ID NO: 35249
  Description of Artificial Sequence: Synthetic coding sequence

SEQ ID NO: 35274 - DNA, 888 bp, Artificial Sequence
  Description of Artificial Sequence: Synthetic coding sequence
atggctgtgatggcccccaggaccctgctgctgctgctgctgggcgccctggccctgacccagacctgggccggcagccacagcatgagatacttcaccacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggacctgcagaccagaaatgtgaaggcccagagccagacagaccgggcctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgtttgctggagctgtggtggccgctgtgcgctggaggaggaagagcagtggaggagagggcatgaagggcggcagcgagatcagctgcctgacagagggcagcaagacccaggtggaggtgtgcccagccagcctgctgggcagcaccatccacaactacggccccacccagcccggcccctgtgtgcctgccctgaccctgctgtag

SEQ ID NO: 35275 - DNA, 1098 bp, Artificial Sequence; identical to SEQ ID NO: 35256
  Description of Artificial Sequence: Synthetic coding sequence

SEQ ID NO: 35276 - DNA, 888 bp, Artificial Sequence
  Description of Artificial Sequence: Synthetic coding sequence
atggctgtgatggcccccaggaccctgctgctgctgctgctgggcgccctggccctgacccagacctgggccggcagccacagcatgagatacttcttcacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggaccaggagaccagaaatgtgaaggcccacagccagacagaccggcgctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagccatgtttgctggagctgtggtggccgctgtgcgctggaggaggaagagcagtggaggagagggcatgaagggcggcagcgagatcagctgcctgacagagggcagcaagacccaggtggaggtgtgcccagccagcctgctgggcagcaccatccacaactacggccccacccagcccggcccctgtgtgcctgccctgaccctgctgtag

SEQ ID NO: 35277 - DNA, 1098 bp, Artificial Sequence; identical to SEQ ID NO: 35266
  Description of Artificial Sequence: Synthetic coding sequence

SEQ ID NO: 35278 - DNA, 345 bp, Artificial Sequence; identical to SEQ ID NO: 35269
  Description of Artificial Sequence: Synthetic coding sequence

SEQ ID NO: 35279 - DNA, 888 bp, Artificial Sequence
  Description of Artificial Sequence: Synthetic coding sequence
atggctgtgatggcccccaggaccctggtgctgctgctgagcggggccctggccctgacccagacctgggccggcagccacagcatgagatacttctacacctctgtgtccaggcctggccgcggggagccccgcttcatcgctgtgggctacgtggatgacacccagtttgtgcgctttgacagtgatgctgccagccagaggatggagccccgggccccctggattgagcaggagggccctgagtactgggacaggaacaccagaaatgtgaaggcccacagccagacagaccgggcctacctggagaatggcaaggagaccctgcagaggacagatgcccccaagacccacatgacccaccacgctgtgtctgaccacgaggccaccctgcgctgctgggccctgtccttctacccagctgagatcaccctgacctggcagagagatggagaggaccagacccaggacacagagctggtggagaccaggcctgctggagatggcaccttccagaagtgggcctctgtggtggtgcccagcggccaggagcagcgctacacctgccacgtgcagcacgagggcctgcccaagcccctgaccctgcgctgggagcccagcagccagcccaccatccccatcgtgggcatcatcgccggcctggtgctgtttggagctgtgattgctggagctgtggtggccgctgtgatgtggaggaggaagagcagtggaggagagggcatgaagggcggcagcgagatcagctgcctgacagagggcagcaagacccaggtggaggtgtgcccagccagcctgctgggcagcaccatccacaactatgagcccacccagcccggcccctgtgtgcctgccctgaccctgctgtag

SEQ ID NO: 35280 - DNA, 465 bp, Artificial Sequence; identical to SEQ ID NO: 35270
  Description of Artificial Sequence: Synthetic coding sequence

SEQ ID NO: 35281 - DNA, 1098 bp, Artificial Sequence; identical to SEQ ID NO: 35256
  Description of Artificial Sequence: Synthetic coding sequence

SEQ ID NO: 35282 - DNA, 1098 bp, Artificial Sequence; identical to SEQ ID NO: 35264
  Description of Artificial Sequence: Synthetic coding sequence

SEQ ID NO: 35283 - DNA, 345 bp, Artificial Sequence; identical to SEQ ID NO: 35269
  Description of Artificial Sequence: Synthetic coding sequence

SEQ ID NO: 35284 - DNA, 1089 bp, Artificial Sequence
  Description of Artificial Sequence: Synthetic coding sequence
atgagggtgacagcccccaggaccctgctgctgctgctgtggggcgctgtggccctgacagagacctgggccggcagccacagcatgagatacttccacacctctgtgtccaggcctggccgcggggagccccgcttcatctctgtgggctacgtggatggcacccagtttgtgcgctttgacagtgatgctgccagccccaggacagagccccgggccccctggattgagcaggagggccctgagtactgggacaggaacacccagatcagcaagaccaacacccagacctaccgggagagcctgaggaacctgcggggctactacaaccagagcgaggccggcagccacaccctgcagaggatgtatggctgtgatgtgggcccagatggccgcctgctgcggggccatgaccagagcgcctatgatggcaaggactacatcgccctgaatgaagacctgagctcctggacagctgctgacacagctgcccagatcacccagaggaagtgggaggccgcccgggtggccgagcagctgcgggcctacctggagggcacctgtgtggagtggctgcggcggcacctggagaatggcaaggagaccctgcagagagctgacccccccaagacccacgtgacccaccaccccatcagtgaccacgaggccaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcaccatccccatcgtgggcatcgtggccggcctggccgtgctggccgtggtggtgattggagctgtggtggccaccgtgatgtgcaggaggaagagcagcggcggcaagggcggcagctacagccaggccgccagcagtgacagcgcccagggcagtgatgtgtccctgacagcctag

SEQ ID NO: 35285 - DNA, 1089 bp, Artificial Sequence
  Description of Artificial Sequence: Synthetic coding sequence
atgctggtgatggcccccaggacagtgctgctgctgctgtctgctgccctggccctgacagagacctgggccggcagccacagcatgagatacttctacacctctgtgtccaggcctggccgcggggagccccgcttcatctctgtgggctacgtggatgacacccagtttgtgcgctttgacagtgatgctgccagcccccgggaggagccccgggccccctggattgagcaggagggccctgagtactgggacaggaacacccagatctacaaggcccaggcccagacagaccgggagagcctgaggaacctgcggggctactacaaccagagcgaggccggcagccacaccctgcagagcatgtatggctgtgatgtgggcccagatggccgcctgctgcggggccatgaccagtatgcctatgatggcaaggactacatcgccctgaatgaagacctgcgctcctggacagctgctgacacagctgcccagatcacccagaggaagtgggaggccgcccgggaggccgagcagaggcgggcctacctggagggagaatgtgtggagtggctgcggcgctacctggagaatggcaaggacaagctggagagagctgacccccccaagacccacgtgacccaccaccccatcagtgaccacgaggccaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggcggcaagggcggcagctacagccaggccgcctgcagcgacagcgcccagggcagtgatgtgtccctgacagcctag

SEQ ID NO: 35286 - DNA, 726 bp, Artificial Sequence
  Description of Artificial Sequence: Synthetic coding sequence
tgaccagatggccgcctgctgcggggccacaaccagtatgcctatgatggcaaggactacatcgccctgaatgaagacctgcgctcctggacagctgctgacacagctgcccagatcacccagaggaagtgggaggccgcccgggtggccgagcaggaccgggcctacctggagggcacctgtgtggagtggctgcggcgctacctggagaatggcaaggacaccctggagagagctgacccccccaagacccacgtgacccaccaccccatcagtgaccacgaggccaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggccacttcctgcccaccggcggcaaaggaggcagctacagccaggccgcctgcagcgacagcgcccagggcagtgatgtgtccctgacagcctag

SEQ ID NO: 35287 - DNA, 726 bp, Artificial Sequence
  Description of Artificial Sequence: Synthetic coding sequence
tgaccagatggccgcctgctgcggggccatgaccagagcgcctatgatggcaaggactacatcgccctgaatgaagacctgagctcctggacagctgctgacacagctgcccagatcacccagaggaagtgggaggccgcccgggtggccgagcagctgcgggcctacctggagggcacctgtgtggagtggctgcggcggcacctggagaatggcaaggagaccctgcagagagctgacccccccaagacccacgtgacccaccaccccatcagtgaccacgaggccaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcaccatccccatcgtgggcatcgtggccggcctggccgtgctggccgtggtggtgattggagctgtggtggccaccgtgatgtgcaggaggaagagcagcggccacttcctgcccaccggcggcaaaggaggcagctacagccaggccgccagcagtgacagcgcccagggcagtgatgtgtccctgacagcctag

SEQ ID NO: 35288 - DNA, 1089 bp, Artificial Sequence
  Description of Artificial Sequence: Synthetic coding sequence
atgagggtgacagcccccaggaccctgctgctgctgctgtggggcgctgtggccctgacagagacctgggccggcagccacagcatgagatacttctacacagccatgagcaggcctggccgcggggagccccgcttcatcaccgtgggctacgtggatgacaccctgtttgtgcgctttgacagtgatgccaccagccccaggaaggagccccgggccccctggattgagcaggagggccctgagtactgggaccgggagacccagatcagcaagaccaacacccagacctaccgggagaacctgaggacagccctgcgctactacaaccagagcgaggccggcagccacatcatccagaggatgtatggctgtgatgtgggcccagatggccgcctgctgcggggctatgaccaggatgcctatgatggcaaggactacatcgccctgaatgaagacctgagctcctggacagctgctgacacagctgcccagatcacccagaggaagtgggaggccgcccgggtggccgagcaggaccgggcctacctggagggcctgtgtgtggagagcctgcggcgctacctggagaatggcaaggagaccctgcagagagctgacccccccaagacccacgtgacccaccaccccatcagtgaccacgaggtgaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggcggcaagggcggcagctacagccaggccgcctgcagcgacagcgcccagggcagtgatgtgtccctgacagcctag

SEQ ID NO: 35289 - DNA, 726 bp, Artificial Sequence
  Description of Artificial Sequence: Synthetic coding sequence
tgaccagatggccgcctgctgcggggccatgaccagagcgcctatgatggcaaggactacatcgccctgaatgaagacctgagctcctggacagctgctgacacagctgcccagatcacccagaggaagtgggaggccgcccgggaggccgagcagtggagggcctacctggagggcctgtgtgtggagtggctgcggcgctacctggagaatggcaaggagaccctgcagagagctgacccccccaagacccacgtgacccaccaccccatcagtgaccacgaggccaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcaccatccccatcgtgggcatcgtggccggcctggccgtgctggccgtggtggtgattggagctgtggtggccaccgtgatgtgcaggaggaagagcagcggccacttcctgcccaccggcggcaaaggaggcagctacagccaggccgccagcagtgacagcgcccagggcagtgatgtgtccctgacagcctag

SEQ ID NO: 35290 - DNA, 1089 bp, Artificial Sequence
  Description of Artificial Sequence: Synthetic coding sequence
atgctggtgatggcccccaggacagtgctgctgctgctgtctgctgccctggccctgacagagacctgggccggcagccacagcatgagatactttgacacagccatgagcaggcctggccgcggggagccccgcttcatctctgtgggctacgtggatgacacccagtttgtgcgctttgacagtgatgctgccagcccccgggaggagccccgggccccctggattgagcaggagggccctgagtactgggacaggaacacccagatcttcaagaccaacacccagacagaccgggagagcctgaggaacctgcggggctactacaaccagagcgaggccggcagccacaccctgcagagcatgtatggctgtgatgtgggcccagatggccgcctgctgcggggccacaaccagtatgcctatgatggcaaggactacatcgccctgaatgaagacctgcgctcctggacagctgctgacacagctgcccagatcacccagaggaagtgggaggccgcccgggtggccgagcaggaccgggcctacctggagggcacctgtgtggagtggctgcggcgctacctggagaatggcaaggacaccctggagagagctgacccccccaagacccacgtgacccaccaccccatcagtgaccacgaggccaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggcggcaagggcggcagctacagccaggccgcctgcagcgacagcgcccagggcagtgatgtgtccctgacagcctag

SEQ ID NO: 35291 - DNA, 678 bp, Artificial Sequence
  Description of Artificial Sequence: Synthetic coding sequence
tgaatgctggtgatggcccccaggacagtgctgctgctgctgtctgctgccctggccctgacagagacctgggccggcagccacagcatgagatacttctacacctctgtgtcccggcccggccgcggggagccccgcttcatctctgtgggctacgtggatgacacccagtttgtgcgctttgacagtgatgctgccagcccccgggaggagccccgggccccctggattgagcaggagggccctgagtactgggacaggaacacccagatctacaaggcccaggcccagacagaccgggagagcctgaggaacctgcggggctactacaaccagagcgaggccggcagccacaccctgcagagcatgtatggctgtgatgtgggcccagatggccgcctgctgcggggccatgaccagtatgcctatgatggcaaggactacatcgccctgaatgaagacctgcgctcctggacagctgctgacacagctgcccagatcacccagaggaagtgggaggccgcccgggaggccgagcagaggcgggcctacctggagggggagtgtgtggagtggctgcggcgctacctggagaatggcaaggacaagctggagagagctgaccaggagcagaagagcctcttccctgcccagaggctggagctgagcaatgaatag

SEQ ID NO: 35292 - DNA, 726 bp, Artificial Sequence
  Description of Artificial Sequence: Synthetic coding sequence
atgtatggctgtgatgtgggcccagatggccgcctgctgcggggccatgaccagtatgcctatgatggcaaggactacatcgccctgaatgaagacctgcgctcctggacagctgctgacacagctgcccagatcacccagaggaagtgggaggccgcccgggaggccgagcagaggcgggcctacctggagggggagtgtgtggagtggctgcggcgctacctggagaatggcaaggacaagctggagagagctgacccccccaagacccacgtgacccaccaccccatcagtgaccacgaggccaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggcggcaaaggaggcagctacagccaggccgcctgcagcgacagcgcccagggcagtgatgtgtccctgacagcctag

SEQ ID NO: 35293 - DNA, 741 bp, Artificial Sequence
  Description of Artificial Sequence: Synthetic coding sequence
atggcctctgtgggccggcgggagggcacagctgggggcggggccggccctggagagccccggcgggaggagggccgggccggcctgagccccagcagccccccaggcagccacagcatgagatacttctacacagccatgagccggcccggccgcggggagccccgcttcatcaccgtgggctacgtggatgacaccctgtttgtgcgctttgacagtgatgccaccagccccaggaaggagccccgggccccctggattgagcaggagggccctgagtactgggaccgggagacccagatcagcaagaccaacacccagacctaccgggagaacctgaggacagccctgcgctactacaaccagagcgaggccggcagccacatcatccagaggatgtatggctgtgatgtgggcccagatggccgcctgctgcggggctatgaccaggatgcctatgatggcaaggactacatcgccctgaatgaagacctgagctcctggacagctgctgacacagctgcccagatcacccagaggaagtgggaggccgcccgggtggccgagcagctgcgggcctacctggagggcctgtgtgtggagagcctgcggcgctacctggagaatggcaaggagaccctgcagagagctgacccccccaagacccacgtgacccaccaccccatcagtgaccacgaggtgaccctgcgctgctgggccctgggcttctacccagcctag

SEQ ID NO: 35294 - DNA, 741 bp, Artificial Sequence
  Description of Artificial Sequence: Synthetic coding sequence
atggccagcgctggccgctctgagggcacagctgggggcggggccggccctgaggagccccggcgggaggagggccgggccggcctgagccccagcagccccccaggcagccacagcatgagatacttctacacctctgtgtcccggcccggccgcggggagccccgcttcatctctgtgggctacgtggatgacacccagtttgtgcgctttgacagtgatgctgccagcccccgggaggagccccgggccccctggattgagcaggagggccctgagtactgggacaggaacacccagatctacaaggcccaggcccagacagaccgggagagcctgaggaacctgcggggctactacaaccagagcgaggccggcagccacaccctgcagagcatgtatggctgtgatgtgggcccagatggccgcctgctgcggggccatgaccagtatgcctatgatggcaaggactacatcgccctgaatgaagacctgcgctcctggacagctgctgacacagctgcccagatcacccagaggaagtgggaggccgcccgggaggccgagcagaggcgggcctacctggagggggagtgtgtggagtggctgcggcgctacctggagaatggcaaggacaagctggagagagctgacccccccaagacccacgtgacccaccaccccatcagtgaccacgaggccaccctgcgctgctgggccctgggcttctacccagcctag

SEQ ID NO: 35295 - DNA, 1089 bp, Artificial Sequence
  Description of Artificial Sequence: Synthetic coding sequence
atgagggtgacagcccccaggaccctgctgctgctgctgtggggcgctgtggccctgacagagacctgggccggcagccacagcatgagatacttctacacagccatgagcaggcctggccgcggggagccccgcttcatcaccgtgggctacgtggatgacaccctgtttgtgcgctttgacagtgatgccaccagccccaggaaggagccccgggccccctggattgagcaggagggccctgagtactgggaccgggagacccagatcagcaagaccaacacccagacctaccgggagaacctgaggacagccctgcgctactacaaccagagcgaggccggcagccacatcatccagaggatgtatggctgtgatgtgggcccagatggccgcctgctgcggggctatgaccaggatgcctatgatggcaaggactacatcgccctgaatgaagacctgagctcctggacagctgctgacacagctgcccagatcacccagaggaagtgggaggccgcccgggtggccgagcagctgcgggcctacctggagggcctgtgtgtggagagcctgcggcgctacctggagaatggcaaggagaccctgcagagagctgacccccccaagacccacgtgacccaccaccccatcagtgaccacgaggtgaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggcggcaagggcggcagctacagccaggccgcctgcagcgacagcgcccagggcagtgatgtgtccctgacagcctag

SEQ ID NO: 35296 - DNA, 726 bp, Artificial Sequence
  Description of Artificial Sequence: Synthetic coding sequence
tgaccagatggccgcctgctgcggggctatgaccaggatgcctatgatggcaaggactacatcgccctgaatgaagacctgagctcctggacagctgctgacacagctgcccagatcacccagaggaagtgggaggccgcccgggtggccgagcagctgcgggcctacctggagggcctgtgtgtggagagcctgcggcgctacctggagaatggcaaggagaccctgcagagagctgacccccccaagacccacgtgacccaccaccccatcagtgaccacgaggtgaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggccacttcctgcccaccggcggcaaaggaggcagctacagccaggccgcctgcagcgacagcgcccagggcagtgatgtgtccctgacagcctag

SEQ ID NO: 35297 - DNA, 726 bp, Artificial Sequence
  Description of Artificial Sequence: Synthetic coding sequence
tgaccagatggccgcctgctgcggggctatgaccaggatgcctatgatggcaaggactacatcgccctgaatgaagacctgagctcctggacagctgctgacacagctgcccagatcacccagaggaagtgggaggccgcccgggtggccgagcaggaccgggcctacctggagggcctgtgtgtggagagcctgcggcgctacctggagaatggcaaggagaccctgcagagagctgacccccccaagacccacgtgacccaccaccccatcagtgaccacgaggtgaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggccacttcctgcccaccggcggcaaaggaggcagctacagccaggccgcctgcagcgacagcgcccagggcagtgatgtgtccctgacagcctag

SEQ ID NO: 35298 - DNA, 741 bp, Artificial Sequence
  Description of Artificial Sequence: Synthetic coding sequence
atggcctctgtgggccgctctgagggcacagctgggggcggggccggccctggagagccccggcgggaggagggccgggccggcctgagccccagcagccccccaggcagccacagcatgagatacttctacacagccatgagccggcccggccgcggggagccccgcttcatcgctgtgggctacgtggatgacacccagtttgtgcgctttgacagtgatgctgccagccccaggatggccccccgggccccctggattgagcaggagggccctgagtactgggaccgggagacccagatcagcaagaccaacacccagacctaccgggagagcctgaggaacctgcggggctactacaaccagagcgaggccggcagccacaccctgcagaggatgtatggctgtgatgtgggcccagatggccgcctgctgcggggccatgaccagagcgcctatgatggcaaggactacatcgccctgaatgaagacctgagctcctggacagctgctgacacagctgcccagatcacccagaggaagtgggaggccgcccgggaggccgagcagtggagggcctacctggagggcctgtgtgtggagtggctgcggcgctacctggagaatggcaaggagaccctgcagagagctgacccccccaagacccacgtgacccaccaccccatcagtgaccacgaggccaccctgcgctgctgggccctgggcttctacccagcctag

SEQ ID NO: 35299 - DNA, 741 bp, Artificial Sequence
  Description of Artificial Sequence: Synthetic coding sequence
atggccagcgctggccgctctgagggcacagctgggggcggggccggccctgaggagccccggcgggaggagggccgggccggcctgagccccagcagccccccaggcagccacagcatgagatactttgacacagccatgagccggcccggccgcggggagccccgcttcatctctgtgggctacgtggatgacacccagtttgtgcgctttgacagtgatgctgccagcccccgggaggagccccgggccccctggattgagcaggagggccctgagtactgggacaggaacacccagatcttcaagaccaacacccagacagaccgggagagcctgaggaacctgcggggctactacaaccagagcgaggccggcagccacaccctgcagagcatgtatggctgtgatgtgggcccagatggccgcctgctgcggggccacaaccagtatgcctatgatggcaaggactacatcgccctgaatgaagacctgcgctcctggacagctgctgacacagctgcccagatcacccagaggaagtgggaggccgcccgggtggccgagcaggaccgggcctacctggagggcacctgtgtggagtggctgcggcgctacctggagaatggcaaggacaccctggagagagctgacccccccaagacccacgtgacccaccaccccatcagtgaccacgaggccaccctgcgctgctgggccctgggcttctacccagcctag

SEQ ID NO: 35300 - DNA, 741 bp, Artificial Sequence
  Description of Artificial Sequence: Synthetic coding sequence
atggcctctgtgggccggcgggagggcacagctgggggcggggccggccctggagagccccggcgggaggagggccgggccggcctgagccccagcagccccccaggcagccacagcatgagatacttctacacagccatgagccggcccggccgcggggagccccgcttcatcaccgtgggctacgtggatgacaccctgtttgtgcgctttgacagtgatgccaccagccccaggaaggagccccgggccccctggattgagcaggagggccctgagtactgggaccgggagacccagatcagcaagaccaacacccagacctaccgggagaacctgaggacagccctgcgctactacaaccagagcgaggccggcagccacatcatccagaggatgtatggctgtgatgtgggcccagatggccgcctgctgcggggctatgaccaggatgcctatgatggcaaggactacatcgccctgaatgaagacctgagctcctggacagctgctgacacagctgcccagatcacccagaggaagtgggaggccgcccgggtggccgagcaggaccgggcctacctggagggcctgtgtgtggagagcctgcggcgctacctggagaatggcaaggagaccctgcagagagctgacccccccaagacccacgtgacccaccaccccatcagtgaccacgaggtgaccctgcgctgctgggccctgggcttctacccagcctag

SEQ ID NO: 35301 - DNA, 1089 bp, Artificial Sequence
  Description of Artificial Sequence: Synthetic coding sequence
atgagggtgacagcccccaggacagtgctgctgctgctgagcggggccctggccctgacagagacctgggccggcagccacagcatgagatacttctacacagccatgagcaggcctggccgcggggagccccgcttcatcgctgtgggctacgtggatgacacccagtttgtgcgctttgacagtgatgctgccagccccaggatggccccccgggccccctggattgagcaggagggccctgagtactgggaccgggagacccagatcagcaagaccaacacccagacctaccgggagagcctgaggaacctgcggggctactacaaccagagcgaggccggcagccacaccctgcagaggatgtatggctgtgatgtgggcccagatggccgcctgctgcggggccatgaccagagcgcctatgatggcaaggactacatcgccctgaatgaagacctgagctcctggacagctgctgacacagctgcccagatcacccagaggaagtgggaggccgcccgggaggccgagcagtggagggcctacctggagggcctgtgtgtggagtggctgcggcgctacctggagaatggcaaggagaccctgcagagagctgacccccccaagacccacgtgacccaccaccccatcagtgaccacgaggccaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcaccatccccatcgtgggcatcgtggccggcctggccgtgctggccgtggtggtgattggagctgtggtggccaccgtgatgtgcaggaggaagagcagcggcggcaagggcggcagctacagccaggccgccagcagtgacagcgcccagggcagtgatgtgtccctgacagcctag

SEQ ID NO: 35302 - DNA, 609 bp, Artificial Sequence
  Description of Artificial Sequence: Synthetic coding sequence
atgtatggctgtgatgtgggcccagatggccgcctgctgcggggccatgaccagtatgcctatgatggcaaggactacatcgccctgaatgaagacctgcgctcctggacagctgctgacacagctgcccagatcacccagaggaagtgggaggccgcccgggaggccgagcagaggcgggcctacctggagggggagtgtgtggagtggctgcggcgctacctggagaatggcaaggacaagctggagagagctgacccccccaagacccacgtgacccaccaccccatcagtgaccacgaggccaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctggggcggcaagggcggcagctacagccaggccgcctgcagcgacagcgcccagggcagtgatgtgtccctgacagcctag

SEQ ID NO: 35303 - DNA, 675 bp, Artificial Sequence
  Description of Artificial Sequence: Synthetic coding sequence
atgctggtgatggcccccaggacagtgctgctgctgctgtctgctgccctggccctgacagagacctgggccggcagccacagcatgagatactttgacacagccatgagcaggcctggccgcggggagccccgcttcatctctgtgggctacgtggatgacacccagtttgtgcgctttgacagtgatgctgccagcccccgggaggagccccgggccccctggattgagcaggagggccctgagtactgggacaggaacacccagatcttcaagaccaacacccagacagaccgggagagcctgaggaacctgcggggctactacaaccagagcgaggccggcagccacaccctgcagagcatgtatggctgtgatgtgggcccagatggccgcctgctgcggggccacaaccagtatgcctatgatggcaaggactacatcgccctgaatgaagacctgcgctcctggacagctgctgacacagctgcccagatcacccagaggaagtgggaggccgcccgggtggccgagcaggaccgggcctacctggagggcacctgtgtggagtggctgcggcgctacctggagaatggcaaggacaccctggagagagctgaccaggagcagaagagcctcttccctgcccagaggctggagctgagcaatgaatag

SEQ ID NO: 35304 - DNA, 675 bp, Artificial Sequence
  Description of Artificial Sequence: Synthetic coding sequence
atgagggtgacagcccccaggacagtgctgctgctgctgagcggggccctggccctgacagagacctgggccggcagccacagcatgagatacttctacacagccatgagcaggcctggccgcggggagccccgcttcatcgctgtgggctacgtggatgacacccagtttgtgcgctttgacagtgatgctgccagccccaggatggccccccgggccccctggattgagcaggagggccctgagtactgggaccgggagacccagatcagcaagaccaacacccagacctaccgggagagcctgaggaacctgcggggctactacaaccagagcgaggccggcagccacaccctgcagaggatgtatggctgtgatgtgggcccagatggccgcctgctgcggggccatgaccagagcgcctatgatggcaaggactacatcgccctgaatgaagacctgagctcctggacagctgctgacacagctgcccagatcacccagaggaagtgggaggccgcccgggaggccgagcagtggagggcctacctggagggcctgtgtgtggagtggctgcggcgctacctggagaatggcaaggagaccctgcagagagctgaccaggagcagaagagcctcttccctgcccagaggctggagctgagcaatgaatag

SEQ ID NO: 35305 - DNA, 675 bp, Artificial Sequence
  Description of Artificial Sequence: Synthetic coding sequence
atgagggtgacagcccccaggaccctgctgctgctgctgtggggcgctgtggccctgacagagacctgggccggcagccacagcatgagatacttccacacctctgtgtccaggcctggccgcggggagccccgcttcatctctgtgggctacgtggatggcacccagtttgtgcgctttgacagtgatgctgccagccccaggacagagccccgggccccctggattgagcaggagggccctgagtactgggacaggaacacccagatcagcaagaccaacacccagacctaccgggagagcctgaggaacctgcggggctactacaaccagagcgaggccggcagccacaccctgcagaggatgtatggctgtgatgtgggcccagatggccgcctgctgcggggccatgaccagagcgcctatgatggcaaggactacatcgccctgaatgaagacctgagctcctggacagctgctgacacagctgcccagatcacccagaggaagtgggaggccgcccgggtggccgagcagctgcgggcctacctggagggcacctgtgtggagtggctgcggcggcacctggagaatggcaaggagaccctgcagagagctgaccaggagcagaagagcctcttccctgcccagaggctggagctgagcaatgaatag

SEQ ID NO: 35306 - DNA, 675 bp, Artificial Sequence
  Description of Artificial Sequence: Synthetic coding sequence
atgagggtgacagcccccaggaccctgctgctgctgctgtggggcgctgtggccctgacagagacctgggccggcagccacagcatgagatacttctacacagccatgagcaggcctggccgcggggagccccgcttcatcaccgtgggctacgtggatgacaccctgtttgtgcgctttgacagtgatgccaccagccccaggaaggagccccgggccccctggattgagcaggagggccctgagtactgggaccgggagacccagatcagcaagaccaacacccagacctaccgggagaacctgaggacagccctgcgctactacaaccagagcgaggccggcagccacatcatccagaggatgtatggctgtgatgtgggcccagatggccgcctgctgcggggctatgaccaggatgcctatgatggcaaggactacatcgccctgaatgaagacctgagctcctggacagctgctgacacagctgcccagatcacccagaggaagtgggaggccgcccgggtggccgagcagctgcgggcctacctggagggcctgtgtgtggagagcctgcggcgctacctggagaatggcaaggagaccctgcagagagctgaccaggagcagaagagcctcttccctgcccagaggctggagctgagcaatgaatag

SEQ ID NO: 35307 - DNA, 675 bp, Artificial Sequence
  Description of Artificial Sequence: Synthetic coding sequence
atgagggtgacagcccccaggaccctgctgctgctgctgtggggcgctgtggccctgacagagacctgggccggcagccacagcatgagatacttctacacagccatgagcaggcctggccgcggggagccccgcttcatcaccgtgggctacgtggatgacaccctgtttgtgcgctttgacagtgatgccaccagccccaggaaggagccccgggccccctggattgagcaggagggccctgagtactgggaccgggagacccagatcagcaagaccaacacccagacctaccgggagaacctgaggacagccctgcgctactacaaccagagcgaggccggcagccacatcatccagaggatgtatggctgtgatgtgggcccagatggccgcctgctgcggggctatgaccaggatgcctatgatggcaaggactacatcgccctgaatgaagacctgagctcctggacagctgctgacacagctgcccagatcacccagaggaagtgggaggccgcccgggtggccgagcaggaccgggcctacctggagggcctgtgtgtggagagcctgcggcgctacctggagaatggcaaggagaccctgcagagagctgaccaggagcagaagagcctcttccctgcccagaggctggagctgagcaatgaatag

SEQ ID NO: 35308 - DNA, 1302 bp, Artificial Sequence
  Description of Artificial Sequence: Synthetic coding sequence
atgagggtgacagcccccaggaccctgctgctgctgctgtggggcgctgtggccctgacagagacctgggccggcagccacagcatgagatacttctacacagccatgagcaggcctggccgcggggagccccgcttcatcaccgtgggctacgtggatgacaccctgtttgtgcgctttgacagtgatgccaccagccccaggaaggagccccgggccccctggattgagcaggagggccctgagtactgggaccgggagacccagatcagcaagaccaacacccagacctaccgggagaacctgaggacagccctgcgctactacaaccctggaagaagaagccggctgcccatcccccacgtgcggcccggcagcccccgggtgtctggcagcgagatccggccccggggccggggcaccaggccagaccccaggcctgcccgggcccctggggccttcacccgcttccacttccagctgcggcccaagagcccccgggtgggccggggcggggccggcctgggcaccggcctgacagctggccctggccctggcagccacatcatccagaggatgtatggctgtgatgtgggcccagatggccgcctgctgcggggctatgaccaggatgcctatgatggcaaggactacatcgccctgaatgaagacctgagctcctggacagctgctgacacagctgcccagatcacccagaggaagtgggaggccgcccgggtggccgagcagctgcgggcctacctggagggcctgtgtgtggagagcctgcggcgctacctggagaatggcaaggagaccctgcagagagctgacccccccaagacccacgtgacccaccaccccatcagtgaccacgaggtgaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggcggcaaaggaggcagctacagccaggccgcctgcagcgacagcgcccagggcagtgatgtgtccctgacagcctag

SEQ ID NO: 35309 - DNA, 726 bp, Artificial Sequence
  Description of Artificial Sequence: Synthetic coding sequence
atgtatggctgtgatgtgggcccagatggccgcctgctgcggggccacaaccagtatgcctatgatggcaaggactacatcgccctgaatgaagacctgcgctcctggacagctgctgacacagctgcccagatcacccagaggaagtgggaggccgcccgggtggccgagcaggaccgggcctacctggagggcacctgtgtggagtggctgcggcgctacctggagaatggcaaggacaccctggagagagctgacccccccaagacccacgtgacccaccaccccatcagtgaccacgaggccaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggcggcaaaggaggcagctacagccaggccgcctgcagcgacagcgcccagggcagtgatgtgtccctgacagcctag

SEQ ID NO: 35310 - DNA, 1302 bp, Artificial Sequence
  Description of Artificial Sequence: Synthetic coding sequence
atgagggtgacagcccccaggaccctgctgctgctgctgtggggcgctgtggccctgacagagacctgggccggcagccacagcatgagatacttctacacagccatgagcaggcctggccgcggggagccccgcttcatcaccgtgggctacgtggatgacaccctgtttgtgcgctttgacagtgatgccaccagccccaggaaggagccccgggccccctggattgagcaggagggccctgagtactgggaccgggagacccagatcagcaagaccaacacccagacctaccgggagaacctgaggacagccctgcgctactacaaccctggaagaagaagccggctgcccatcccccacgtgcggcccggcagcccccgggtgtctggcagcgagatccggccccggggccggggcaccaggccagaccccaggcctgcccgggcccctggggccttcacccgcttccacttccagctgcggcccaagagcccccgggtgggccggggcggggccggcctgggcaccggcctgacagctggccctggccctggcagccacatcatccagaggatgtatggctgtgatgtgggcccagatggccgcctgctgcggggctatgaccaggatgcctatgatggcaaggactacatcgccctgaatgaagacctgagctcctggacagctgctgacacagctgcccagatcacccagaggaagtgggaggccgcccgggtggccgagcaggaccgggcctacctggagggcctgtgtgtggagagcctgcggcgctacctggagaatggcaaggagaccctgcagagagctgacccccccaagacccacgtgacccaccaccccatcagtgaccacgaggtgaccctgcgctgctgggccctgggcttctacccagctgagatcaccctgacctggcagagagatggagaggaccagacccaggacacagagctggtggagaccaggcctgctggggacaggaccttccagaagtgggccgctgtggtggtgcccagcggggaggagcagcgctacacctgccacgtgcagcacgagggcctgcccaagcccctgaccctgcgctgggagcccagcagccagagcacagtgcccatcgtgggcatcgtggccggcctggccgtgctggccgtggtggtgattggagctgtggtggccgctgtgatgtgcaggaggaagagcagcggcggcaaaggaggcagctacagccaggccgcctgcagcgacagcgcccagggcagtgatgtgtccctgacagcctag

SEQ ID NO: 35311 - DNA, 1077 bp, Artificial Sequence
  Description of Artificial Sequence: Synthetic coding sequence
atggtggatggcaccctgctgctgctgctgtctgaggccctggccctgacccagacctgggccggcagccacagcctgaagtacttccacacctctgtgtcccggcccggccgcggggagccccgcttcatctctgtgggctacgtggatgacacccagtttgtgcgctttgacaatgatgctgccagccccaggatggtgccccgggccccctggatggagcaggagggcagcgagtactgggaccgggagaccaggtctgcccgggacacagcccagatcttccgggtgaacctgcggaccctgcggggctactacaaccagagcgaggccggcagccacaccctgcagtggatgcacggctgtgagctgggcccagatggccgcttcctgcggggctatgagcagtttgcctatgatggcaaggactacctgaccctgaatgaagacctgcgctcctggacagctgtggacacagctgcccagatcagcgagcagaagagcaatgatgccagcgaggccgagcaccagagggcctacctggaggacacctgtgtggagtggctgcacaagtacctggagaagggcaaggagaccctgctgcacctggagccccccaagacccacgtgacccaccaccccatcagtgaccacgaggccaccctgcgctgctgggccctgggcttctacccagctgagatcaccctgacctggcagcaggatggagagggccacacccaggacacagagctggtggagaccaggcctgctggagatggcaccttccagaagtgggccgctgtggtggtgcccagcggggaggagcagcgctacacctgccacgtgcagcacgagggcctgcctgagcctgtgaccctgcgctggaagccagccagccagcccaccatccccatcgtgggcatcatcgccggcctggtgctgctgggctctgtggtgtctggagctgtggtggccgccgtcatctggaggaagaagagcagcggcggcaaaggaggcagctacagcaaggccgagtggagcgacagcgcccagggcagcgagagccacagcctgtag

SEQ ID NO: 35312 - DNA, 1077 bp, Artificial Sequence
  Description of Artificial Sequence: Synthetic coding sequence
atggtggatggcaccctgctgctgctgctgtctgaggccctggccctgacccagacctgggccggcagccacagcctgaagtacttccacacctctgtgtcccggcccggccgcggggagccccgcttcatctctgtgggctacgtggatgacacccagtttgtgcgctttgacaatgatgctgccagccccaggatggtgccccgggccccctggatggagcaggagggcagcgagtactgggaccgggagaccaggtctgcccgggacacagcccagatcttccgggtgaacctgcggaccctgcggggctactacaaccagagcgaggccggcagccacaccctgcagtggatgcacggctgtgagctgggccctgaccggcgcttcctgcggggctatgagcagtttgcctatgatggcaaggactacctgaccctgaatgaagacctgcgctcctggacagctgtggacacagctgcccagatcagcgagcagaagagcaatgatgccagcgaggccgagcaccagagggcctacctggaggacacctgtgtggagtggctgcacaagtacctggagaagggcaaggagaccctgctgcacctggagccccccaagacccacgtgacccaccaccccatcagtgaccacgaggccaccctgcgctgctgggccctgggcttctacccagctgagatcaccctgacctggcagcaggatggagagggccacacccaggacacagagctggtggagaccaggcctgctggagatggcaccttccagaagtgggccgctgtggtggtgcccagcggggaggagcagcgctacacctgccacgtgcagcacgagggcctgcctgagcctgtgaccctgcgctggaagccagccagccagcccaccatccccatcgtgggcatcatcgccggcctggtgctgctgggctctgtggtgtctggagctgtggtggccgccgtcatctggaggaagaagagcagcggcggcaaaggaggcagctacagcaaggccgagtggagcgacagcgcccagggcagcgagagccacagcctgtag

SEQ ID NO: 35313 - DNA, 1077 bp, Artificial Sequence; identical to SEQ ID NO: 35312
  Description of Artificial Sequence: Synthetic coding sequence

SEQ ID NO: 35314 - DNA, 1077 bp, Artificial Sequence; identical to SEQ ID NO: 35312
  Description of Artificial Sequence: Synthetic coding sequence

SEQ ID NO: 35315 - DNA, 1077 bp, Artificial Sequence; identical to SEQ ID NO: 35311
  Description of Artificial Sequence: Synthetic coding sequence

SEQ ID NO: 35316 - DNA, 1077 bp, Artificial Sequence; identical to SEQ ID NO: 35312
  Description of Artificial Sequence: Synthetic coding sequence

SEQ ID NO: 35317 - DNA, 1077 bp, Artificial Sequence; identical to SEQ ID NO: 35311
  Description of Artificial Sequence: Synthetic coding sequence

SEQ ID NO: 35318 - DNA, 1200 bp, Artificial Sequence
  Description of Artificial Sequence: Synthetic coding sequence
atggagcccagcttctacagcagcagaagaccctggcccctgcccaggcctggccgggtgtctgctggcagcggctggaagaggcccctgcccggggtggagcggggccggcctgggggcggggagggcctgggggagccccggcgggaggagggccgggctgacctgagccccagcagccccccaggcagccacagcctgaagtacttccacacctctgtgtccaggcctggccgcggggagccccgcttcatctctgtgggctacgtggatgacacccagtttgtgcgctttgacaatgatgctgccagccccaggatggtgccccgggccccctggatggagcaggagggcagcgagtactgggaccgggagaccaggtctgcccgggacacagcccagatcttccgggtgaacctgcggaccctgcggggctactacaaccagagcgaggccggcagccacaccctgcagtggatgcacggctgtgagctgggccctgaccggcgcttcctgcggggctatgagcagtttgcctatgatggcaaggactacctgaccctgaatgaagacctgcgctcctggacagctgtggacacagctgcccagatcagcgagcagaagagcaatgatgccagcgaggccgagcaccagagggcctacctggaggacacctgtgtggagtggctgcacaagtacctggagaagggcaaggagaccctgctgcacctggagccccccaagacccacgtgacccaccaccccatcagtgaccacgaggccaccctgcgctgctgggccctgggcttctacccagctgagatcaccctgacctggcagcaggatggagagggccacacccaggacacagagctggtggagaccaggcctgctggagatggcaccttccagaagtgggccgctgtggtggtgcccagcggggaggagcagcgctacacctgccacgtgcagcacgagggcctgcctgagcctgtgaccctgcgctggaagccagccagccagcccaccatccccatcgtgggcatcatcgccggcctggtgctgctgggctctgtggtgtctggagctgtggtggccgctgtgatctggaggaagaagagcagcggcggcaagggcggcagctacagcaaggccgagtggagcgacagcgcccagggcagcgagagccacagcctgtag

SEQ ID NO: 35319 - DNA, 1329 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccccaggagaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgccgcctacagcgtggtgtctggcaacctgatgatcacctggtggagcagcctcttcctgctgggcgtgctcttccagggctacctgggctgcctgcggagccacagcgtgctgggccgcaggaaggtgggggacatgtggatcctcttcttcctgtggctgtggaccagcttcaacacagccttcctggccctgcagagcctgcgcttcggcttcggcttcagaagaggccgctccttcctgctgcgctcctggcaccacctgatgaagagggtgcagatcaagatctttgattag

SEQ ID NO: 35320 - DNA, 1041 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccccaggagaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgctgtgtag

SEQ ID NO: 35321 - DNA, 1041 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgctgtgtag

SEQ ID NO: 35322 - DNA, 765 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgctgtgtag

SEQ ID NO: 35323 - DNA, 1005 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagctag

SEQ ID NO: 35324 - DNA, 765 bp, Artificial Sequence; identical to SEQ ID NO: 35322
  Description of Artificial Sequence: Synthetic coding sequence

SEQ ID NO: 35325 - DNA, 1041 bp, Artificial Sequence; identical to SEQ ID NO: 35320
  Description of Artificial Sequence: Synthetic coding sequence

SEQ ID NO: 35326 - DNA, 765 bp, Artificial Sequence; identical to SEQ ID NO: 35322
  Description of Artificial Sequence: Synthetic coding sequence

SEQ ID NO: 35327 - DNA, 1329 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgccgcctacagcgtggtgtctggcaacctgatgatcacctggtggagcagcctcttcctgctgggcgtgctcttccagggctacctgggctgcctgcggagccacagcgtgctgggccgcaggaaggtgggggacatgtggatcctcttcttcctgtggctgtggaccagcttcaacacagccttcctggccctgcagagcctgcgcttcggcttcggcttcagaagaggccgctccttcctgctgcgctcctggcaccacctgatgaagagggtgcagatcaagatctttgattag

SEQ ID NO: 35328 - DNA, 1041 bp, Artificial Sequence; identical to SEQ ID NO: 35321
  Description of Artificial Sequence: Synthetic coding sequence

SEQ ID NO: 35329 - DNA, 1329 bp, Artificial Sequence; identical to SEQ ID NO: 35327
  Description of Artificial Sequence: Synthetic coding sequence

SEQ ID NO: 35330 - DNA, 1050 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccccaggagaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgccgcctacagcgtggtgtctggcaacctgatgatcacctggtggagcagcctcttcctgctgggcgtgctcttccagggctacctgggctgcctgcggagccacagcgtgctgggccgcaggaaggcccagctgctgtctgtgtccaccagccagaccagcatcctgatccaggagcagttcagccaccagaggaccctggccatgtctgggaagatgttctgctgccacgactggagcgaggaggaggtgctgcctgccagctgtggggagtag

SEQ ID NO: 35331 - DNA, 396 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgtag

SEQ ID NO: 35332 - DNA, 396 bp, Artificial Sequence; identical to SEQ ID NO: 35331
  Description of Artificial Sequence: Synthetic coding sequence

SEQ ID NO: 35333 - DNA, 396 bp, Artificial Sequence; identical to SEQ ID NO: 35331
  Description of Artificial Sequence: Synthetic coding sequence

SEQ ID NO: 35334 - DNA, 642 bp, Artificial Sequence
  Description of Artificial Sequence: Synthetic coding sequence
tgaccagaccccccacctggccgggtgcctggggccttcacagagcacgcctatgatggcaaggactacatcagcctgaatgaagacctgcgctcctggacagctgctgacacagtggcccagatcacccagcgcttctatgaagctgaggagtatgcagaggagttccgcacctacctggagggagaatgtctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagctag

SEQ ID NO: 35335 - DNA, 765 bp, Artificial Sequence; identical to SEQ ID NO: 35322
  Description of Artificial Sequence: Synthetic coding sequence

SEQ ID NO: 35336 - DNA, 396 bp, Artificial Sequence; identical to SEQ ID NO: 35331
  Description of Artificial Sequence: Synthetic coding sequence

SEQ ID NO: 35337 - DNA, 678 bp, Artificial Sequence
  Description of Artificial Sequence: Synthetic coding sequence
tgaccagaccccccacctggccgggtgcctggggccttcacagagcacgcctatgatggcaaggactacatcagcctgaatgaagacctgcgctcctggacagctgctgacacagtggcccagatcacccagcgcttctatgaagctgaggagtatgcagaggagttccgcacctacctggagggagaatgtctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgctgtgtag

SEQ ID NO: 35338 - DNA, 1005 bp, Artificial Sequence; identical to SEQ ID NO: 35323
  Description of Artificial Sequence: Synthetic coding sequence

SEQ ID NO: 35339 - DNA, 1041 bp, Artificial Sequence; identical to SEQ ID NO: 35321
  Description of Artificial Sequence: Synthetic coding sequence

SEQ ID NO: 35340 - DNA, 375 bp, Artificial Sequence
  Description of Artificial Sequence: Synthetic coding sequence
tgagctgtgatgtggaggaagaagagcagcggccacttcctgcccatcgacaggaacagaggcagctacagccaggccgccgcctacagcgtggtgtctggcaacctgatgatcacctggtggagcagcctcttcctgctgggcgtgctcttccagggctacctgggctgcctgcggagccacagcgtgctgggccgcaggaaggtgggggacatgtggatcctcttcttcctgtggctgtggaccagcttcaacacagccttcctggccctgcagagcctgcgcttcggcttcggcttcagaagaggccgctccttcctgctgcgctcctggcaccacctgatgaagagggtgcagatcaagatctttgattag

SEQ ID NO: 35341 - DNA, 375 bp, Artificial Sequence; identical to SEQ ID NO: 35340
  Description of Artificial Sequence: Synthetic coding sequence

SEQ ID NO: 35342 - DNA, 678 bp, Artificial Sequence; identical to SEQ ID NO: 35337
  Description of Artificial Sequence: Synthetic coding sequence

SEQ ID NO: 35343 - DNA, 1329 bp, Artificial Sequence; identical to SEQ ID NO: 35327
  Description of Artificial Sequence: Synthetic coding sequence

SEQ ID NO: 35344 - DNA, 678 bp, Artificial Sequence
  Description of Artificial Sequence: Synthetic coding sequence
tgaccagaccccccacctggccgggtgcctggggccttcacccagcacgcctatgatggcaaggactacatcagcctgaatgaagacctgcgctcctggacagctgctgacacagtggcccagatcacccagcgcttctatgaagctgaggagtatgcagaggagttccgcacctacctggagggagaatgtctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccccaggagaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgctgtgtag

SEQ ID NO: 35345 - DNA, 1329 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgccgcctacagcgtggtgtctggcctgctgatgatcacctggtggagcagcctcttcctgctgggcgtgctcttccagggctacctgggctgcctgcggagccacagcgtgctgggccgcaggaaggtgggggacatgtggatcctcttcttcctgtggctgtggaccagcttcaacacagccttcctggccctgcagagcctgcgcttcggcttcggcttcagaagaggccgctccttcctgctgcgctcctggcaccacctgatgaagagggtgcagatcaagatctttgattag

SEQ ID NO: 35346 - DNA, 678 bp, Artificial Sequence; identical to SEQ ID NO: 35337
  Description of Artificial Sequence: Synthetic coding sequence

SEQ ID NO: 35347 - DNA, 765 bp, Artificial Sequence; identical to SEQ ID NO: 35322
  Description of Artificial Sequence: Synthetic coding sequence

SEQ ID NO: 35348 - DNA, 1041 bp, Artificial Sequence; identical to SEQ ID NO: 35321
  Description of Artificial Sequence: Synthetic coding sequence

SEQ ID NO: 35349 - DNA, 396 bp, Artificial Sequence; identical to SEQ ID NO: 35331
  Description of Artificial Sequence: Synthetic coding sequence

SEQ ID NO: 35350 - DNA, 33 bp, Artificial Sequence
  Description of Artificial Sequence: Synthetic coding sequence
tgagctgtgatgtggaggaagaagagcagctag

SEQ ID NO: 35351 - DNA, 780 bp, Artificial Sequence
  Description of Artificial Sequence: Synthetic coding sequence
atgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccccaggagaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagcgcctacagcgtggtgtctggcaacctgatgatcacctggtggagcagcctcttcctgctgggcgtgctcttccagggctacctgggctgcctgcggagccacagcgtgctgggccgcaggaagcacttctag

SEQ ID NO: 35352 - DNA, 765 bp, Artificial Sequence; identical to SEQ ID NO: 35322
  Description of Artificial Sequence: Synthetic coding sequence

SEQ ID NO: 35353 - DNA, 729 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgagcagagcccccagcccaccatccccatcgtgggcatcgtggccggcctggtggtgctgggcgctgtggtgactggagctgtggtggccgctgtgatgtggaggaagaagagcagctag

SEQ ID NO: 35354 - DNA, 396 bp, Artificial Sequence; identical to SEQ ID NO: 35331
  Description of Artificial Sequence: Synthetic coding sequence

SEQ ID NO: 35355 - DNA, 375 bp, Artificial Sequence; identical to SEQ ID NO: 35340
  Description of Artificial Sequence: Synthetic coding sequence

SEQ ID NO: 35356 - DNA, 1041 bp, Artificial Sequence; identical to SEQ ID NO: 35321
  Description of Artificial Sequence: Synthetic coding sequence

SEQ ID NO: 35357 - DNA, 1329 bp, Artificial Sequence; identical to SEQ ID NO: 35327
  Description of Artificial Sequence: Synthetic coding sequence

SEQ ID NO: 35358 - DNA, 396 bp, Artificial Sequence; identical to SEQ ID NO: 35331
  Description of Artificial Sequence: Synthetic coding sequence

SEQ ID NO: 35359 - DNA, 375 bp, Artificial Sequence
  Description of Artificial Sequence: Synthetic coding sequence
tgagctgtgatgtggaggaagaagagcagcggccacttcctgcccatcgacaggaacagaggcagctacagccaggccgccgcctacagcgtggtgtctggcctgctgatgatcacctggtggagcagcctcttcctgctgggcgtgctcttccagggctacctgggctgcctgcggagccacagcgtgctgggccgcaggaaggtgggggacatgtggatcctcttcttcctgtggctgtggaccagcttcaacacagccttcctggccctgcagagcctgcgcttcggcttcggcttcagaagaggccgctccttcctgctgcgctcctggcaccacctgatgaagagggtgcagatcaagatctttgattag

SEQ ID NO: 35360 - DNA, 1260 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaagctgaggagtatgcagaggagttccgcacctacctggagggagaatgtctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccccaggagaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgccgcctacagcgtggtgtctggcaacctgatgatcacctggtggagcagcctcttcctgctgggcgtgctcttccagggctacctgggctgcctgcggagccacagcgtgctgggccgcaggaaggtgggggacatgtggatcctcttcttcctgtggctgtggaccagcttcaacacagccttcctggccctgcagagcctgcgctttggatttggcttccggcggggccgctccttcctgctgcgctcctggcaccacctgatgaagagggtgcagatcaagatctttgattag

SEQ ID NO: 35361 - DNA, 375 bp, Artificial Sequence; identical to SEQ ID NO: 35340
  Description of Artificial Sequence: Synthetic coding sequence

SEQ ID NO: 35362 - DNA, 678 bp, Artificial Sequence
  Description of Artificial Sequence: Synthetic coding sequence
tgaccagaccccccacctggccgggtgcctggggccttcacccagcacgcctatgatggcaaggactacatcagcctgaatgaagacctgcgctcctggacagctgctgacacagtggcccagatcacccagcgcttctatgaagctgaggagtatgcagaggagttccgcacctacctggagggagaatgtctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgctgtgtag

SEQ ID NO: 35363 - DNA, 678 bp, Artificial Sequence; identical to SEQ ID NO: 35362
  Description of Artificial Sequence: Synthetic coding sequence

SEQ ID NO: 35364 - DNA, 375 bp, Artificial Sequence; identical to SEQ ID NO: 35340
  Description of Artificial Sequence: Synthetic coding sequence

SEQ ID NO: 35365 - DNA, 780 bp, Artificial Sequence
  Description of Artificial Sequence: Synthetic coding sequence
atgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagcgcctacagcgtggtgtctggcctgctgatgatcacctggtggagcagcctcttcctgctgggcgtgctcttccagggctacctgggctgcctgcggagccacagcgtgctgggccgcaggaagcacttctag

SEQ ID NO: 35366 - DNA, 1050 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgccgcctacagcgtggtgtctggcaacctgatgatcacctggtggagcagcctcttcctgctgggcgtgctcttccagggctacctgggctgcctgcggagccacagcgtgctgggccgcaggaaggcccagctgctgtctgtgtccaccagccagaccagcatcctgatccaggagcagttcagccaccagaggaccctggccatgtctgggaagatgttctgctgccacgactggagcgaggagaaggtgctgcctgccagctgtggggagtag

SEQ ID NO: 35367 - DNA, 1260 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaagctgaggagtatgcagaggagttccgcacctacctggagggagaatgtctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgccgcctacagcgtggtgtctggcaacctgatgatcacctggtggagcagcctcttcctgctgggcgtgctcttccagggctacctgggctgcctgcggagccacagcgtgctgggccgcaggaaggtgggggacatgtggatcctcttcttcctgtggctgtggaccagcttcaacacagccttcctggccctgcagagcctgcgctttggatttggcttccggcggggccgctccttcctgctgcgctcctggcaccacctgatgaagagggtgcagatcaagatctttgattag

SEQ ID NO: 35368 - DNA, 1050 bp, Artificial Sequence; identical to SEQ ID NO: 35366
  Description of Artificial Sequence: Synthetic coding sequence

SEQ ID NO: 35369 - DNA, 780 bp, Artificial Sequence
  Description of Artificial Sequence: Synthetic coding sequence
atgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagcgcctacagcgtggtgtctggcaacctgatgatcacctggtggagcagcctcttcctgctgggcgtgctcttccagggctacctgggctgcctgcggagccacagcgtgctgggccgcaggaagcacttctag

SEQ ID NO: 35370 - DNA, 780 bp, Artificial Sequence; identical to SEQ ID NO: 35369
  Description of Artificial Sequence: Synthetic coding sequence

SEQ ID NO: 35371 - DNA, 1260 bp, Artificial Sequence; identical to SEQ ID NO: 35367
  Description of Artificial Sequence: Synthetic coding sequence

SEQ ID NO: 35372 - DNA, 1050 bp, Artificial Sequence; identical to SEQ ID NO: 35366
  Description of Artificial Sequence: Synthetic coding sequence

SEQ ID NO: 35373 - DNA, 1308 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgccgcctacagcgtggtgtctggcctgctgatgatcacctggtggagcagcctcttcctgctgggcgtgctcttccagggctacctgggctgcctgcggagccacagcgtgctgggccgcaggaaggcccagctgctgtctgtgtccaccagccagaccagcatcctgatccaggagcagttcagccaccagaggaccctggccatgtctgggaagatgttctgctgccacgactggagcgaggaggaggtgctgcctgccagctgtggggagtag

SEQ ID NO: 35374 - DNA, 1041 bp, Artificial Sequence; identical to SEQ ID NO: 35321
  Description of Artificial Sequence: Synthetic coding sequence

SEQ ID NO: 35375 - DNA, 780 bp, Artificial Sequence; identical to SEQ ID NO: 35369
  Description of Artificial Sequence: Synthetic coding sequence

SEQ ID NO: 35376 - DNA, 1041 bp, Artificial Sequence; identical to SEQ ID NO: 35321
  Description of Artificial Sequence: Synthetic coding sequence

SEQ ID NO: 35377 - DNA, 1050 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgccgcctacagcgtggtgtctggcaacctgatgatcacctggtggagcagcctcttcctgctgggcgtgctcttccagggctacctgggctgcctgcggagccacagcgtgctgggccgcaggaaggcccagctgctgtctgtgtccaccagccagaccagcatcctgatccaggagcagttcagccaccagaggaccctggccatgtctgggaagatgttctgctgccacgactggagcgaggaggaggtgctgcctgccagctgtggggagtag

SEQ ID NO: 35378 - DNA, 1260 bp, Artificial Sequence; identical to SEQ ID NO: 35367
  Description of Artificial Sequence: Synthetic coding sequence

SEQ ID NO: 35379 - DNA, 780 bp, Artificial Sequence; identical to SEQ ID NO: 35369
  Description of Artificial Sequence: Synthetic coding sequence

SEQ ID NO: 35380 - DNA, 1260 bp, Artificial Sequence; identical to SEQ ID NO: 35367
  Description of Artificial Sequence: Synthetic coding sequence

SEQ ID NO: 35381 - DNA, 1041 bp, Artificial Sequence; identical to SEQ ID NO: 35321
  Description of Artificial Sequence: Synthetic coding sequence

SEQ ID NO: 35382 - DNA, 1041 bp, Artificial Sequence; identical to SEQ ID NO: 35321
  Description of Artificial Sequence: Synthetic coding sequence

SEQ ID NO: 35383 - DNA, 1017 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagtatgtggatgacacccagttcctgcgctttgacagtgatgctgccatccccaggatggagccccgggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaggccgaggagtatgcagaggagttccgcacctacctggagggggagtgcctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagcggcaggaaaggatag

SEQ ID NO: 35384 - DNA, 1260 bp, Artificial Sequence
  Description of Artificial Sequence: Synthetic coding sequence
atggcccccaggagcctgctgctgctgctgagcggggccctggccctgacagacacctgggccggcagccacagcctgcgctacttcagcacagctgtgtcccggcccggccgcggggagccccgctacatcgctgtggagccctgggtggagcaggagggcccccagtactgggagtggaccaccggctacgccaaggccaatgcccagacagacagagtggccctgaggaacctgctgcggcgctacaaccagagcgaggccggcagccacaccctgcagggcatgaatggctgtgacatgggcccagatggccgcctgctgcggggctaccaccagcacgcctatgatggcaaggactacatcagcctgaatgaagacctgcgctcctggacagctgctgacacagtggcccagatcacccagcgcttctatgaagctgaggagtatgcagaggagttccgcacctacctggagggagaatgtctggagctgctgcggcgctacctggagaatggcaaggagaccctgcagagagctgacccccccaaggcccacgtggcccaccaccccatcagtgaccacgaggccaccctgcgctgctgggccctgggcttctacccagctgagatcaccctgacctggcagagagatggagaggagcagacccaggacacagagctggtggagaccaggcctgctggagatggcaccttccagaagtgggccgctgtggtggtgcccagcggggaggagcagcgctacacctgccacgtgcagcacgagggcctgccccagcccctcatcctgcgctgggagcagagcccccagcccaccatccccatcgtgggcatcgtggccggcctggtggtgctgggcgctgtggtgactggagctgtggtggccgctgtgatgtggaggaagaagagcagtgacaggaacagaggcagctacagccaggccgccgcctacagcgtggtgtctggcctgctgatgatcacctggtggagcagcctcttcctgctgggcgtgctcttccagggctacctgggctgcctgcggagccacagcgtgctgggccgcaggaaggtgggggacatgtggatcctcttcttcctgtggctgtggaccagcttcaacacagccttcctggccctgcagagcctgcgctttggatttggcttccggcggggccgctccttcctgctgcgctcctggcaccacctgatgaagagggtgcagatcaagatctttgattag

SEQ ID NO: 35385 - DNA, 1017 bp, Artificial Sequence
  Description of Artificial Sequence: Synthetic coding sequence
atggtggtgatggcccccaggaccctcttcctgctgctgagcggggccctgaccctgacagagacctgggccggcagccacagcatgagatacttctctgctgctgtgtccaggcctggccgcggggagccccgcttcatcgccatgggctacgtggatgacacccagtttgtgcgctttgacagcgacagcgcctgccccaggatggagccccgggccccctgggtggagcaggagggccctgagtactgggaggaggagaccaggaacaccaaggcccacgcccagacagacaggatgaacctgcagaccctgcggggctactacaaccagagcgaggccagcagccacaccctgcagtggatgattggctgtgacctgggcagtgatggccgcctgctgcggggctatgagcagtatgcctatgatggcaaggactacctggccctgaatgaagacctgcgctcctggacagctgctgacacagctgcccagatcagcaagaggaaatgtgaggccgccaacgtggccgagcagaggcgggcctacctggagggcacctgtgtggagtggctgcaccgctacctggagaatggcaaggagatgctgcagagagctgacccccccaagacccacgtgacccaccaccctgtgtttgattatgaggccaccctgcgctgctgggccctgggcttctacccagctgagatcatcctgacctggcagagagatggagaggaccagacccaggatgtggagctggtggagaccaggcctgctggagatggcaccttccagaagtgggccgctgtggtggtgcccagcggggaggagcagcgctacacctgccacgtgcagcacgagggcctgcctgagcccctgatgctgcgctggaagcagagcagcctgcccaccatccccatcatgggcatcgtggccggcctggtggtgctggccgctgtggtgactggagctgctgtggccgctgtgctgtggaggaagaagagcagtgactag

SEQ ID NO: 35386 - DNA, 465 bp, Artificial Sequence
  Description of Artificial Sequence: Synthetic coding sequence
atggtggtgatggcccccaggaccctcttcctgctgctgagcggggccctgaccctgacagagacctgggccggcagccacagcatgagatacttctctgctgctgtgtccaggcctggccgcggggagccccgcttcatcgccatgggctacgtggatgacacccagtttgtgcgctttgacagcgacagcgcctgccccaggatggagccccgggccccctgggtggagcaggagggccctgagtactgggaggaggagaccaggaacaccaaggcccacgcccagacagacaggatgaacctgcagaccctgcggggctactacaaccagagcgaggccaagcagagcagcctgcccaccatccccatcatgggcatcgtggccggcctggtggtgctggccgctgtggtgactggagctgctgtggccgctgtgctgtggaggaagaagagcagtgactag

SEQ ID NO: 35387 - DNA, 741 bp, Artificial Sequence
  Description of Artificial Sequence: Synthetic coding sequence
atggtggtgatggcccccaggaccctcttcctgctgctgagcggggccctgaccctgacagagacctgggccggcagccacagcatgagatacttctctgctgctgtgtccaggcctggccgcggggagccccgcttcatcgccatgggctacgtggatgacacccagtttgtgcgctttgacagcgacagcgcctgccccaggatggagccccgggccccctgggtggagcaggagggccctgagtactgggaggaggagaccaggaacaccaaggcccacgcccagacagacaggatgaacctgcagaccctgcggggctactacaaccagagcgaggccaacccccccaagacccacgtgacccaccaccctgtgtttgattatgaggccaccctgcgctgctgggccctgggcttctacccagctgagatcatcctgacctggcagagagatggagaggaccagacccaggatgtggagctggtggagaccaggcctgctggagatggcaccttccagaagtgggccgctgtggtggtgcccagcggggaggagcagcgctacacctgccacgtgcagcacgagggcctgcctgagcccctgatgctgcgctggaagcagagcagcctgcccaccatccccatcatgggcatcgtggccggcctggtggtgctggccgctgtggtgactggagctgctgtggccgctgtgctgtggaggaagaagagcagtgactag

SEQ ID NO: 35388 - DNA, 1032 bp, Artificial Sequence
  Description of Artificial Sequence: Synthetic coding sequence
atgaagacccccaggatggtggtgatggcccccaggaccctcttcctgctgctgagcggggccctgaccctgacagagacctgggccggcagccacagcatgagatacttctctgctgctgtgtcccggcccggccgcggggagccccgcttcatcgccatgggctacgtggatgacacccagtttgtgcgctttgacagcgacagcgcctgccccaggatggagccccgggccccctgggtggagcaggagggccctgagtactgggaggaggagaccaggaacaccaaggcccacgcccagacagacaggatgaacctgcagaccctgcggggctactacaaccagagcgaggccagcagccacaccctgcagtggatgattggctgtgacctgggcagtgatggccgcctgctgcggggctatgagcagtatgcctatgatggcaaggactacctggccctgaatgaagacctgcgctcctggacagctgctgacacagctgcccagatcagcaagaggaaatgtgaggccgccaacgtggccgagcagaggcgggcctacctggagggcacctgtgtggagtggctgcaccgctacctggagaatggcaaggagatgctgcagagagctgacccccccaagacccacgtgacccaccaccctgtgtttgattatgaggccaccctgcgctgctgggccctgggcttctacccagctgagatcatcctgacctggcagagagatggagaggaccagacccaggatgtggagctggtggagaccaggcctgctggagatggcaccttccagaagtgggccgctgtggtggtgcccagcggggaggagcagcgctacacctgccacgtgcagcacgagggcctgcctgagcccctgatgctgcgctggaagcagagcagcctgcccaccatccccatcatgggcatcgtggccggcctggtggtgctggccgctgtggtgactggagctgctgtggccgctgtgctgtggaggaagaagagcagtgactag

SEQ ID NO: 35389 - DNA, 1017 bp, Artificial Sequence; identical to SEQ ID NO: 35385
  Description of Artificial Sequence: Synthetic coding sequence

SEQ ID NO: 35390 - DNA, 465 bp, Artificial Sequence; identical to SEQ ID NO: 35386
  Description of Artificial Sequence: Synthetic coding sequence

SEQ ID NO: 35391 - DNA, 741 bp, Artificial Sequence; identical to SEQ ID NO: 35387
  Description of Artificial Sequence: Synthetic coding sequence

SEQ ID NO: 35392 - DNA, 1032 bp, Artificial Sequence; identical to SEQ ID NO: 35388
  Description of Artificial Sequence: Synthetic coding sequence

SEQ ID NO: 35393 - DNA, 1032 bp, Artificial Sequence; identical to SEQ ID NO: 35388
  Description of Artificial Sequence: Synthetic coding sequence

SEQ ID NO: 35394 - DNA, 741 bp, Artificial Sequence; identical to SEQ ID NO: 35387
  Description of Artificial Sequence: Synthetic coding sequence

SEQ ID NO: 35395 - DNA, 465 bp, Artificial Sequence; identical to SEQ ID NO: 35386
  Description of Artificial Sequence: Synthetic coding sequence

SEQ ID NO: 35396 - DNA, 1032 bp, Artificial Sequence; identical to SEQ ID NO: 35388
  Description of Artificial Sequence: Synthetic coding sequence

SEQ ID NO: 35397 - DNA, 1032 bp, Artificial Sequence; identical to SEQ ID NO: 35388
  Description of Artificial Sequence: Synthetic coding sequence

SEQ ID NO: 35398 - DNA, 1017 bp, Artificial Sequence; identical to SEQ ID NO: 35385
  Description of Artificial Sequence: Synthetic coding sequence

SEQ ID NO: 35399 - DNA, 1017 bp, Artificial Sequence; identical to SEQ ID NO: 35385
  Description of Artificial Sequence: Synthetic coding sequence

SEQ ID NO: 35400 - DNA, 741 bp, Artificial Sequence; identical to SEQ ID NO: 35387
  Description of Artificial Sequence: Synthetic coding sequence

SEQ ID NO: 35401 - DNA, 1017 bp, Artificial Sequence; identical to SEQ ID NO: 35385
  Description of Artificial Sequence: Synthetic coding sequence

SEQ ID NO: 35402 - DNA, 1017 bp, Artificial Sequence; identical to SEQ ID NO: 35385
  Description of Artificial Sequence: Synthetic coding sequence

SEQ ID NO: 35403 - DNA, 465 bp, Artificial Sequence; identical to SEQ ID NO: 35386
  Description of Artificial Sequence: Synthetic coding sequence

SEQ ID NO: 35404 - DNA, 741 bp, Artificial Sequence; identical to SEQ ID NO: 35387
  Description of Artificial Sequence: Synthetic coding sequence

SEQ ID NO: 35405 - DNA, 1032 bp, Artificial Sequence; identical to SEQ ID NO: 35388
  Description of Artificial Sequence: Synthetic coding sequence

SEQ ID NO: 35406 - DNA, 741 bp, Artificial Sequence; identical to SEQ ID NO: 35387
  Description of Artificial Sequence: Synthetic coding sequence

SEQ ID NO: 35407 - DNA, 1017 bp, Artificial Sequence; identical to SEQ ID NO: 35385
  Description of Artificial Sequence: Synthetic coding sequence

SEQ ID NO: 35408 - DNA, 465 bp, Artificial Sequence; identical to SEQ ID NO: 35386
  Description of Artificial Sequence: Synthetic coding sequence

SEQ ID NO: 35409 - DNA, 465 bp, Artificial Sequence; identical to SEQ ID NO: 35386
  Description of Artificial Sequence: Synthetic coding sequence

SEQ ID NO: 35410 - DNA, 1017 bp, Artificial Sequence; identical to SEQ ID NO: 35385
  Description of Artificial Sequence: Synthetic coding sequence

SEQ ID NO: 35411 - DNA, 1032 bp, Artificial Sequence; identical to SEQ ID NO: 35388
  Description of Artificial Sequence: Synthetic coding sequence

SEQ ID NO: 35412 - DNA, 741 bp, Artificial Sequence; identical to SEQ ID NO: 35387
  Description of Artificial Sequence: Synthetic coding sequence

SEQ ID NO: 35413 - DNA, 741 bp, Artificial Sequence; identical to SEQ ID NO: 35387
  Description of Artificial Sequence: Synthetic coding sequence

SEQ ID NO: 35414 - DNA, 465 bp, Artificial Sequence; identical to SEQ ID NO: 35386
  Description of Artificial Sequence: Synthetic coding sequence

SEQ ID NO: 35415 - DNA, 741 bp, Artificial Sequence; identical to SEQ ID NO: 35387
  Description of Artificial Sequence: Synthetic coding sequence

SEQ ID NO: 35416 - DNA, 741 bp, Artificial Sequence; identical to SEQ ID NO: 35387
  Description of Artificial Sequence: Synthetic coding sequence

SEQ ID NO: 35417 - DNA, 741 bp, Artificial Sequence; identical to SEQ ID NO: 35387
  Description of Artificial Sequence: Synthetic coding sequence

SEQ ID NO: 35418 - DNA, 741 bp, Artificial Sequence; identical to SEQ ID NO: 35387
  Description of Artificial Sequence: Synthetic coding sequence

SEQ ID NO: 35419 - DNA, 741 bp, Artificial Sequence; identical to SEQ ID NO: 35387
  Description of Artificial Sequence: Synthetic coding sequence

SEQ ID NO: 35420 - DNA, 741 bp, Artificial Sequence; identical to SEQ ID NO: 35387
  Description of Artificial Sequence: Synthetic coding sequence

SEQ ID NO: 35421 - DNA, 1017 bp, Artificial Sequence; identical to SEQ ID NO: 35385
  Description of Artificial Sequence: Synthetic coding sequence

SEQ ID NO: 35422 - DNA, 1017 bp, Artificial Sequence; identical to SEQ ID NO: 35385
  Description of Artificial Sequence: Synthetic coding sequence

SEQ ID NO: 35423 - DNA, 1017 bp, Artificial Sequence; identical to SEQ ID NO: 35385
  Description of Artificial Sequence: Synthetic coding sequence

SEQ ID NO: 35424 - DNA, 1017 bp, Artificial Sequence; identical to SEQ ID NO: 35385
  Description of Artificial Sequence: Synthetic coding sequence

SEQ ID NO: 35425 - DNA, 1017 bp, Artificial Sequence; identical to SEQ ID NO: 35385
  Description of Artificial Sequence: Synthetic coding sequence

SEQ ID NO: 35426 - DNA, 1017 bp, Artificial Sequence; identical to SEQ ID NO: 35385
  Description of Artificial Sequence: Synthetic coding sequence

SEQ ID NO: 35427 - DNA, 372 bp, Artificial Sequence
  Description of Artificial Sequence: Synthetic coding sequence
atgggccacgagcagatgctgcccctgctgtggctgctgccccacagctgggccgtgcctgaggcccccacccccatgtggccagatgacctgcagaaccacaccttcctgcacacagtgtactgccaggacggcagccccagcgtgggcctgtctgaggcctatgatgaggaccagctgttcttctttgacttcagccagaacaccagggtgccccggctgcctgagtttgctgactgggcccaggagcagggagatgccccagccatcctgtttgacaaggagttctgtgagtggatgatccagcagatcggccccaagctggatggcaagatccctgtgtcccggggccaggagttctctggagagtag

SEQ ID NO: 35428 - DNA, 786 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcctgaggcccccacccccatgtggccagatgacctgcagaaccacaccttcctgcacacagtgtactgccaggacggcagccccagcgtgggcctgtctgaggcctatgatgaggaccagctgttcttctttgacttcagccagaacaccagggtgccccggctgcctgagtttgctgactgggcccaggagcagggagatgccccagccatcctgtttgacaaggagttctgtgagtggatgatccagcagatcggccccaagctggatggcaagatccctgtgtcccggggcttccccatcgccgaggtgttcaccctgaagcccctggagtttgggaagcccaacaccctggtgtgctttgtgagcaacctcttcccccccatgctgactgtgaactggcagcaccacagcgtgcctgtggagggcttcggccccacctttgtgtctgctgtggatggcctgtccttccaggccttctcctacctgaacttcaccccagagcccagcgacatcttcagctgcatcgtgacccatgaaattgaccgctacacagccatcgcctactgggtgcccagaaatgccctgcccagcgacctgctggagaatgtgctgtgtggggtggccttcggcctgggcgtgctgggcatcatcgtgggcatcgtgctgatcatctacttcaggaagccctgcagcggggactag

SEQ ID NO: 35429 - DNA, 684 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcctgaggcccccacccccatgtggccagatgacctgcagaaccacaccttcctgcacacagtgtactgccaggacggcagccccagcgtgggcctgtctgaggcctatgatgaggaccagctgttcttctttgacttcagccagaacaccagggtgccccggctgcctgagtttgctgactgggcccaggagcagggagatgccccagccatcctgtttgacaaggagttctgtgagtggatgatccagcagatcggccccaagctggatggcaagatccctgtgtcccgggtgaactggcagcaccacagcgtgcctgtggagggcttcggccccacctttgtgtctgctgtggatggcctgtccttccaggccttctcctacctgaacttcaccccagagcccagcgacatcttcagctgcatcgtgacccatgaaattgaccgctacacagccatcgcctactgggtgcccagaaatgccctgcccagcgacctgctggagaatgtgctgtgtggggtggccttcggcctgggcgtgctgggcatcatcgtgggcatcgtgctgatcatctacttcaggaagccctgcagcggggactag

SEQ ID NO: 35430 - DNA, 501 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcctgagggcttccccatcgccgaggtgttcaccctgaagcccctggagtttgggaagcccaacaccctggtgtgctttgtgagcaacctcttcccccccatgctgactgtgaactggcagcaccacagcgtgcctgtggagggcttcggccccacctttgtgtctgctgtggatggcctgtccttccaggccttctcctacctgaacttcaccccagagcccagcgacatcttcagctgcatcgtgacccatgaaattgaccgctacacagccatcgcctactgggtgcccagaaatgccctgcccagcgacctgctggagaatgtgctgtgtggggtggccttcggcctgggcgtgctgggcatcatcgtgggcatcgtgctgatcatctacttcaggaagccctgcagcggggactag

SEQ ID NO: 35431 - DNA, 786 bp, Artificial Sequence; identical to SEQ ID NO: 35428
  Description of Artificial Sequence: Synthetic coding sequence

SEQ ID NO: 35432 - DNA, 684 bp, Artificial Sequence; identical to SEQ ID NO: 35429
  Description of Artificial Sequence: Synthetic coding sequence

SEQ ID NO: 35433 - DNA, 501 bp, Artificial Sequence; identical to SEQ ID NO: 35430
  Description of Artificial Sequence: Synthetic coding sequence

SEQ ID NO: 35434 - DNA, 726 bp, Artificial Sequence
  Description of Artificial Sequence: Synthetic coding sequence
atgaagtggctgaagaagtgcctggacacagcccccacccccatgtggccagatgacctgcagaaccacaccttcctgcacacagtgtactgccaggacggcagccccagcgtgggcctgtctgaggcctatgatgaggaccagctgttcttctttgacttcagccagaacaccagggtgccccggctgcctgagtttgctgactgggcccaggagcagggagatgccccagccatcctgtttgacaaggagttctgtgagtggatgatccagcagatcggccccaagctggatggcaagatccctgtgtcccggggcttccccatcgccgaggtgttcaccctgaagcccctggagtttgggaagcccaacaccctggtgtgctttgtgagcaacctcttcccccccatgctgactgtgaactggcagcaccacagcgtgcctgtggagggcttcggccccacctttgtgtctgctgtggatggcctgtccttccaggccttctcctacctgaacttcaccccagagcccagcgacatcttcagctgcatcgtgacccatgaaattgaccgctacacagccatcgcctactgggtgcccagaaatgccctgcccagcgacctgctggagaatgtgctgtgtggggtggccttcggcctgggcgtgctgggcatcatcgtgggcatcgtgctgatcatctacttcaggaagccctgcagcggctag

SEQ ID NO: 35435 - DNA, 510 bp, Artificial Sequence
  Description of Artificial Sequence: Synthetic coding sequence
atgtggccagatgacctgcagaaccacaccttcctgcacacagtgtactgccaggacggcagccccagcgtgggcctgtctgaggcctatgatgaggaccagctgttcttctttgacttcagccagaacaccagggtgccccggctgcctgagtttgctgactgggcccaggagcagggagatgccccagccatcctgtttgacaaggagttctgtgagtggatgatccagcagatcggccccaagctggatggcaagatccctgtgtcccggggcttccccatcgccgaggtgttcaccctgaagcccctggagtttgggaagcccaacaccctggtgtgctttgtgagcaacctcttcccccccatgctgactgtgaactggcagcaccacagcgtgcctgtggagggcttcggccccacctttgtgtctgctgtggatggcctgtccttccaggccttctcctacctgaacttcaccccagagcccagcgacatcttcagctgctag

SEQ ID NO: 35436 - DNA, 873 bp, Artificial Sequence
  Description of Artificial Sequence: Synthetic coding sequence
gtgtcctgctggctgagtgacagctgccaggagctgcagaggcggggcatcatcctgtgcagctatggagtgaccagccccatcgctgtgtttggccggcccggccgcctgaggaacagaagacactttgaaagaaggctggtgcccatgaagtggctgaagaagtgcctggacacagcccccacccccatgtggccagatgacctgcagaaccacaccttcctgcacacagtgtactgccaggacggcagccccagcgtgggcctgtctgaggcctatgatgaggaccagctgttcttctttgacttcagccagaacaccagggtgccccggctgcctgagtttgctgactgggcccaggagcagggagatgccccagccatcctgtttgacaaggagttctgtgagtggatgatccagcagatcggccccaagctggatggcaagatccctgtgtcccggggcttccccatcgccgaggtgttcaccctgaagcccctggagtttgggaagcccaacaccctggtgtgctttgtgagcaacctcttcccccccatgctgactgtgaactggcagcaccacagcgtgcctgtggagggcttcggccccacctttgtgtctgctgtggatggcctgtccttccaggccttctcctacctgaacttcaccccagagcccagcgacatcttcagctgcatcgtgacccatgaaattgaccgctacacagccatcgcctactgggtgcccagaaatgccctgcccagcgacctgctggagaatgtgctgtgtggggtggccttcggcctgggcgtgctgggcatcatcgtgggcatcgtgctgatcatctacttcaggaagccctgcagcggctag

SEQ ID NO: 35437 - DNA, 510 bp, Artificial Sequence; identical to SEQ ID NO: 35435
  Description of Artificial Sequence: Synthetic coding sequence

SEQ ID NO: 35438 - DNA, 684 bp, Artificial Sequence; identical to SEQ ID NO: 35429
  Description of Artificial Sequence: Synthetic coding sequence

SEQ ID NO: 35439 - DNA, 510 bp, Artificial Sequence; identical to SEQ ID NO: 35435
  Description of Artificial Sequence: Synthetic coding sequence

SEQ ID NO: 35440 - DNA, 501 bp, Artificial Sequence; identical to SEQ ID NO: 35430
  Description of Artificial Sequence: Synthetic coding sequence

SEQ ID NO: 35441 - DNA, 684 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcctgaggcccccacccccatgtggccagatgacctgcagaaccacaccttcctgcacacagtgtactgccaggacggcagccccagcgtgggcctgtctgaggcctatgatgaggaccagctgttcttctttgacttcagccagaacaccagggtgccccggctgcctgagtttgctgactgggcccaggagcagggagatgccccagccatcctgtttgacaaggagttctgtgagtggatgatccagcagatcggccccaagctggatggcaagatccctgtgtcccgggtgaactggcagcaccacagcatccctgtggagggcttcggccccacctttgtgtctgctgtggatggcctgtccttccaggccttctcctacctgaacttcaccccagagcccagcgacatcttcagctgcatcgtgacccatgaaattgaccgctacacagccatcgcctactgggtgcccagaaatgccctgcccagcgacctgctggagaatgtgctgtgtggggtggccttcggcctgggcgtgctgggcatcatcgtgggcatcgtgctgatcatctacttcaggaagccctgcagcggggactag

SEQ ID NO: 35442 - DNA, 873 bp, Artificial Sequence; identical to SEQ ID NO: 35436
  Description of Artificial Sequence: Synthetic coding sequence

SEQ ID NO: 35443 - DNA, 510 bp, Artificial Sequence; identical to SEQ ID NO: 35435
  Description of Artificial Sequence: Synthetic coding sequence

SEQ ID NO: 35444 - DNA, 510 bp, Artificial Sequence; identical to SEQ ID NO: 35435
  Description of Artificial Sequence: Synthetic coding sequence

SEQ ID NO: 35445 - DNA, 684 bp, Artificial Sequence; identical to SEQ ID NO: 35429
  Description of Artificial Sequence: Synthetic coding sequence

SEQ ID NO: 35446 - DNA, 873 bp, Artificial Sequence; identical to SEQ ID NO: 35436
  Description of Artificial Sequence: Synthetic coding sequence

SEQ ID NO: 35447 - DNA, 786 bp, Artificial Sequence; identical to SEQ ID NO: 35428
  Description of Artificial Sequence: Synthetic coding sequence

SEQ ID NO: 35448 - DNA, 501 bp, Artificial Sequence; identical to SEQ ID NO: 35430
  Description of Artificial Sequence: Synthetic coding sequence

SEQ ID NO: 35449 - DNA, 510 bp, Artificial Sequence; identical to SEQ ID NO: 35435
  Description of Artificial Sequence: Synthetic coding sequence

SEQ ID NO: 35450 - DNA, 786 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcctgaggcccccacccccatgtggccagatgacctgcagaaccacaccttcctgcacacagtgtactgccaggacggcagccccagcgtgggcctgtctgaggcctatgatgaggaccagctgttcttctttgacttcagccagaacaccagggtgccccggctgcctgagtttgctgactgggcccaggagcagggagatgccccagccatcctgtttgacaaggagttctgtgagtggatgatccagcagatcggccccaagctggatggcaagatccctgtgtcccggggcttccccatcgccgaggtgttcaccctgaagcccctggagtttgggaagcccaacaccctggtgtgctttgtgagcaacctcttcccccccatgctgactgtgaactggcagcaccacagcatccctgtggagggcttcggccccacctttgtgtctgctgtggatggcctgtccttccaggccttctcctacctgaacttcaccccagagcccagcgacatcttcagctgcatcgtgacccatgaaattgaccgctacacagccatcgcctactgggtgcccagaaatgccctgcccagcgacctgctggagaatgtgctgtgtggggtggccttcggcctgggcgtgctgggcatcatcgtgggcatcgtgctgatcatctacttcaggaagccctgcagcggggactag

SEQ ID NO: 35451 - DNA, 873 bp, Artificial Sequence; identical to SEQ ID NO: 35436
  Description of Artificial Sequence: Synthetic coding sequence

SEQ ID NO: 35452 - DNA, 510 bp, Artificial Sequence
  Description of Artificial Sequence: Synthetic coding sequence
atgtggccagatgacctgcagaaccacaccttcctgcacacagtgtactgccaggacggcagccccagcgtgggcctgtctgaggcctatgatgaggaccagctgttcttctttgacttcagccagaacaccagggtgccccggctgcctgagtttgctgactgggcccaggagcagggagatgccccagccatcctgtttgacaaggagttctgtgagtggatgatccagcagatcggccccaagctggatggcaagatccctgtgtcccggggcttccccatcgccgaggtgttcaccctgaagcccctggagtttgggaagcccaacaccctggtgtgctttgtgagcaacctcttcccccccatgctgactgtgaactggcagcaccacagcatccctgtggagggcttcggccccacctttgtgtctgctgtggatggcctgtccttccaggccttctcctacctgaacttcaccccagagcccagcgacatcttcagctgctag

SEQ ID NO: 35453 - DNA, 786 bp, Artificial Sequence; identical to SEQ ID NO: 35428
  Description of Artificial Sequence: Synthetic coding sequence

SEQ ID NO: 35454 - DNA, 501 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcctgagggcttccccatcgccgaggtgttcaccctgaagcccctggagtttgggaagcccaacaccctggtgtgctttgtgagcaacctcttcccccccatgctgactgtgaactggcagcaccacagcatccctgtggagggcttcggccccacctttgtgtctgctgtggatggcctgtccttccaggccttctcctacctgaacttcaccccagagcccagcgacatcttcagctgcatcgtgacccatgaaattgaccgctacacagccatcgcctactgggtgcccagaaatgccctgcccagcgacctgctggagaatgtgctgtgtggggtggccttcggcctgggcgtgctgggcatcatcgtgggcatcgtgctgatcatctacttcaggaagccctgcagcggggactag

SEQ ID NO: 35455 - DNA, 786 bp, Artificial Sequence; identical to SEQ ID NO: 35428
  Description of Artificial Sequence: Synthetic coding sequence

SEQ ID NO: 35456 - DNA, 684 bp, Artificial Sequence; identical to SEQ ID NO: 35429
  Description of Artificial Sequence: Synthetic coding sequence

SEQ ID NO: 35457 - DNA, 501 bp, Artificial Sequence; identical to SEQ ID NO: 35430
  Description of Artificial Sequence: Synthetic coding sequence

SEQ ID NO: 35458 - DNA, 684 bp, Artificial Sequence; identical to SEQ ID NO: 35429
  Description of Artificial Sequence: Synthetic coding sequence

SEQ ID NO: 35459 - DNA, 684 bp, Artificial Sequence; identical to SEQ ID NO: 35429
  Description of Artificial Sequence: Synthetic coding sequence

SEQ ID NO: 35460 - DNA, 786 bp, Artificial Sequence; identical to SEQ ID NO: 35428
  Description of Artificial Sequence: Synthetic coding sequence

SEQ ID NO: 35461 - DNA, 501 bp, Artificial Sequence; identical to SEQ ID NO: 35430
  Description of Artificial Sequence: Synthetic coding sequence

SEQ ID NO: 35462 - DNA, 786 bp, Artificial Sequence; identical to SEQ ID NO: 35428
  Description of Artificial Sequence: Synthetic coding sequence

SEQ ID NO: 35463 - DNA, 873 bp, Artificial Sequence; identical to SEQ ID NO: 35436
  Description of Artificial Sequence: Synthetic coding sequence

SEQ ID NO: 35464 - DNA, 873 bp, Artificial Sequence
  Description of Artificial Sequence: Synthetic coding sequence
gtgtcctgctggctgagtgacagctgccaggagctgcagaggcggggcatcatcctgtgcagctatggagtgaccagccccatcgctgtgtttggccggcccggccgcctgaggaacagaagacactttgaaagaaggctggtgcccatgaagtggctgaagaagtgcctggacacagcccccacccccatgtggccagatgacctgcagaaccacaccttcctgcacacagtgtactgccaggacggcagccccagcgtgggcctgtctgaggcctatgatgaggaccagctgttcttctttgacttcagccagaacaccagggtgccccggctgcctgagtttgctgactgggcccaggagcagggagatgccccagccatcctgtttgacaaggagttctgtgagtggatgatccagcagatcggccccaagctggatggcaagatccctgtgtcccggggcttccccatcgccgaggtgttcaccctgaagcccctggagtttgggaagcccaacaccctggtgtgctttgtgagcaacctcttcccccccatgctgactgtgaactggcagcaccacagcatccctgtggagggcttcggccccacctttgtgtctgctgtggatggcctgtccttccaggccttctcctacctgaacttcaccccagagcccagcgacatcttcagctgcatcgtgacccatgaaattgaccgctacacagccatcgcctactgggtgcccagaaatgccctgcccagcgacctgctggagaatgtgctgtgtggggtggccttcggcctgggcgtgctgggcatcatcgtgggcatcgtgctgatcatctacttcaggaagccctgcagcggctag

SEQ ID NO: 35465 - DNA, 873 bp, Artificial Sequence; identical to SEQ ID NO: 35436
  Description of Artificial Sequence: Synthetic coding sequence

SEQ ID NO: 35466 - DNA, 501 bp, Artificial Sequence; identical to SEQ ID NO: 35430
  Description of Artificial Sequence: Synthetic coding sequence

SEQ ID NO: 35467 - DNA, 510 bp, Artificial Sequence; identical to SEQ ID NO: 35435
  Description of Artificial Sequence: Synthetic coding sequence

SEQ ID NO: 35468 - DNA, 792 bp, Artificial Sequence
  Description of Artificial Sequence: Synthetic coding sequence
atgatcaccttcctgcccctgctgctgggcctgagcctgggctgcaccggggccggcggctttgtggcccacgtggagagcacctgcctgctggatgatgctggcacccccaaggacttcacctactgcatctccttcaacaaggacctgctgacctgctgggaccctgaggagaacaagatggccccctgtgaatttggagtgctgaacagcctggccaacgtgctgagccagcacctgaaccagaaggacaccctgatgcagaggctgagaaatggcctgcagaactgtgccacccacacccagcccttctggggcagcctgaccaacagaacccggccccccagcgtgcaggtggccaagaccacccccttcaacacccgggagcctgtgatgctggcctgctacgtgtggggcttctacccagctgaggtgaccatcacctggaggaagaatggcaagctggtgatgccccacagcagcgcccacaagacagcccagcccaatggagactggacctaccagaccctgagccacctggccctgacccccagctatggagacacctacacctgtgtggtggagcacatcggggcccctgagcccatcctgcgggactggaccccaggcctgagccccatgcagaccctgaaggtgtctgtgtctgctgtgaccctgggcctgggcctcatcatcttcagcctgggcgtcatctcctggaggagagctggccacagcagctacacccccctgcccggcagcaactacagcgagggctggcacatctcctag

SEQ ID NO: 35469 - DNA, 792 bp, Artificial Sequence; identical to SEQ ID NO: 35468
  Description of Artificial Sequence: Synthetic coding sequence

SEQ ID NO: 35470 - DNA, 792 bp, Artificial Sequence
  Description of Artificial Sequence: Synthetic coding sequence
atgatcaccttcctgcccctgctgctgggcctgagcctgggctgcaccggggccggcggctttgtggcccacgtggagagcacctgcctgctggatgatgctggcacccccaaggacttcacctactgcatctccttcaacaaggacctgctgacctgctgggaccctgaggagaacaagatggccccctgtgaatttggagtgctgaacagcctggccaacgtgctgagccagcacctgaaccagaaggacaccctgatgcagaggctgagaaatggcctgcagaactgtgccacccacacccagcccttctggggcagcctgaccaacagaacccggccccccagcgtgcaggtggccaagaccacccccttcaacacccgggagcctgtgatgctggcctgctacgtgtggggcttctacccagctgaggtgaccatcacctggaggaagaatggcaagctggtgatgccccacagcagcgcccacaagacagcccagcccaatggagactggacctaccagaccctgagccacctggccctgacccccagctatggagacacctacacctgtgtggtggagcacactggagcccctgagcccatcctgcgggactggaccccaggcctgagccccatgcagaccctgaaggtgtctgtgtctgctgtgaccctgggcctgggcctcatcatcttcagcctgggcgtcatctcctggaggagagctggccacagcagctacacccccctgcccggcagcaactacagcgagggctggcacatctcctag

SEQ ID NO: 35471 - DNA, 426 bp, Artificial Sequence
  Description of Artificial Sequence: Synthetic coding sequence
tgaacacggccccccagcgtgcaggtggccaagaccacccccttcaacacccgggagcctgtgatgctggcctgctacgtgtggggcttctacccagctgaggtgaccatcacctggaggaagaatggcaagctggtgatgccccacagcagcgcccacaagacagcccagcccaatggagactggacctaccagaccctgagccacctggccctgacccccagctatggagacacctacacctgtgtggtggagcacatcggggcccctgagcccatcctgcgggactggaccccaggcctgagccccatgcagaccctgaaggtgtctgtgtctgctgtgaccctgggcctgggcctcatcatcttcagcctgggcgtcatctcctggaggagagctggccacagccgctggcacatctcctag

SEQ ID NO: 35472 - DNA, 774 bp, Artificial Sequence
  Description of Artificial Sequence: Synthetic coding sequence
atgatcaccttcctgcccctgctgctgggcctgagcctgggctgcaccggggccggcggctttgtggcccacgtggagagcacctgcctgctggatgatgctggcacccccaaggacttcacctactgcatctccttcaacaaggacctgctgacctgctgggaccctgaggagaacaagatggccccctgtgaatttggagtgctgaacagcctggccaacgtgctgagccagcacctgaaccagaaggacaccctgatgcagaggctgagaaatggcctgcagaactgtgccacccacacccagcccttctggggcagcctgaccaacagaacccggccccccagcgtgcaggtggccaagaccacccccttcaacacccgggagcctgtgatgctggcctgctacgtgtggggcttctacccagctgaggtgaccatcacctggaggaagaatggcaagctggtgatgccccacagcagcgcccacaagacagcccagcccaatggagactggacctaccagaccctgagccacctggccctgacccccagctatggagacacctacacctgtgtggtggagcacatcggggcccctgagcccatcctgcgggactggaccccaggcctgagccccatgcagaccctgaaggtgtctgtgtctgctgtgaccctgggcctgggcctcatcatcttcagcctgggcgtcatctcctggaggagagctggccacagcagtgacctgatcatcagcctgctcttcatcctgtag

SEQ ID NO: 35473 - DNA, 321 bp, Artificial Sequence
  Description of Artificial Sequence: Synthetic coding sequence
gtggccaagaccacccccttcaacacccgggagcctgtgatgctggcctgctacgtgtggggcttctacccagctgaggtgaccatcacctggaggaagaatggcaagctggtgatgccccacagcagcgcccacaagacagcccagcccaatggagactggacctaccagaccctgagccacctggccctgacccccagctatggagacacctacacctgtgtggtggagcacactggagcccctgagcccatcctgcgggactggagctacacccccctgcccggcagcaactacagcgagggctggcacatctcctag

SEQ ID NO: 35474 - DNA, 426 bp, Artificial Sequence
  Description of Artificial Sequence: Synthetic coding sequence
tgaacacggccccccagcgtgcaggtggccaagaccacccccttcaacacccgggagcctgtgatgctggcctgctacgtgtggggcttctacccagctgaggtgaccatcacctggaggaagaatggcaagctggtgatgccccacagcagcgcccacaagacagcccagcccaatggagactggacctaccagaccctgagccacctggccctgacccccagctatggagacacctacacctgtgtggtggagcacactggagcccctgagcccatcctgcgggactggaccccaggcctgagccccatgcagaccctgaaggtgtctgtgtctgctgtgaccctgggcctgggcctcatcatcttcagcctgggcgtcatctcctggaggagagctggccacagccgctggcacatctcctag

SEQ ID NO: 35475 - DNA, 528 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcctgaggagcagagcatgatcaccttcctgcccctgctgctgggcctgagcctgggctgcaccggggccggcggctttgtggcccacgtggagagcacctgcctgctggatgatgctggcacccccaaggacttcacctactgcatctccttcaacaaggacctgctgacctgctgggaccctgaggagaacaagatggccccctgtgaatttggagtgctgaacagcctggccaacgtgctgagccagcacctgaaccagaaggacaccctgatgcagaggctgagaaatggcctgcagaactgtgccacccacacccagcccttctggggcagcctgaccaacagaacccggccccccagcgtgcaggtggccaagaccacccccttcaacacccgggagcctgtgatgctggcctgctacgtgtggggcttctacccagcctag

SEQ ID NO: 35476 - DNA, 528 bp, Artificial Sequence; identical to SEQ ID NO: 35475
  Description of Artificial Sequence: Synthetic coding sequence

SEQ ID NO: 35477 - DNA, 651 bp, Artificial Sequence
  Description of Artificial Sequence: Synthetic coding sequence
atgatcaccttcctgcccctgctgctgggcctgagcctgggctgcaccggggccggcggctttgtggcccacgtggagagcacctgcctgctggatgatgctggcacccccaaggacttcacctactgcatctccttcaacaaggacctgctgacctgctgggaccctgaggagaacaagatggccccctgtgaatttggagtgctgaacagcctggccaacgtgctgagccagcacctgaaccagaaggacaccctgatgcagaggctgagaaatggcctgcagaactgtgccacccacacccagcccttctggggcagcctgaccaacagaacccggccccccagcgtgcaggtggccaagaccacccccttcaacacccgggagcctgtgatgctggcctgctacgtgtggggcttctacccagctgaggtgaccatcacctggaggaagaatggcaagctggtgatgccccacagcagcgcccacaagacagcccagcccaatggagactggacctaccagaccctgagccacctggccctgacccccagctatggagacacctacacctgtgtggtggagcacactggagcccctgagcccatcctgcgggactggagcaagtgcatggctgatggctggaactag

SEQ ID NO: 35478 - DNA, 792 bp, Artificial Sequence; identical to SEQ ID NO: 35470
  Description of Artificial Sequence: Synthetic coding sequence

SEQ ID NO: 35479 - DNA, 774 bp, Artificial Sequence
  Description of Artificial Sequence: Synthetic coding sequence
atgatcaccttcctgcccctgctgctgggcctgagcctgggctgcaccggggccggcggctttgtggcccacgtggagagcacctgcctgctggatgatgctggcacccccaaggacttcacctactgcatctccttcaacaaggacctgctgacctgctgggaccctgaggagaacaagatggccccctgtgaatttggagtgctgaacagcctggccaacgtgctgagccagcacctgaaccagaaggacaccctgatgcagaggctgagaaatggcctgcagaactgtgccacccacacccagcccttctggggcagcctgaccaacagaacccggccccccagcgtgcaggtggccaagaccacccccttcaacacccgggagcctgtgatgctggcctgctacgtgtggggcttctacccagctgaggtgaccatcacctggaggaagaatggcaagctggtgatgccccacagcagcgcccacaagacagcccagcccaatggagactggacctaccagaccctgagccacctggccctgacccccagctatggagacacctacacctgtgtggtggagcacactggagcccctgagcccatcctgcgggactggaccccaggcctgagccccatgcagaccctgaaggtgtctgtgtctgctgtgaccctgggcctgggcctcatcatcttcagcctgggcgtcatctcctggaggagagctggccacagcagtgacctgatcatcagcctgctcttcatcctgtag

SEQ ID NO: 35480 - DNA, 321 bp, Artificial Sequence
  Description of Artificial Sequence: Synthetic coding sequence
gtggccaagaccacccccttcaacacccgggagcctgtgatgctggcctgctacgtgtggggcttctacccagctgaggtgaccatcacctggaggaagaatggcaagctggtgatgccccacagcagcgcccacaagacagcccagcccaatggagactggacctaccagaccctgagccacctggccctgacccccagctatggagacacctacacctgtgtggtggagcacatcggggcccctgagcccatcctgcgggactggagctacacccccctgcccggcagcaactacagcgagggctggcacatctcctag

SEQ ID NO: 35481 - DNA, 792 bp, Artificial Sequence; identical to SEQ ID NO: 35470
  Description of Artificial Sequence: Synthetic coding sequence

SEQ ID NO: 35482 - DNA, 426 bp, Artificial Sequence; identical to SEQ ID NO: 35474
  Description of Artificial Sequence: Synthetic coding sequence

SEQ ID NO: 35483 - DNA, 792 bp, Artificial Sequence; identical to SEQ ID NO: 35468
  Description of Artificial Sequence: Synthetic coding sequence

SEQ ID NO: 35484 - DNA, 774 bp, Artificial Sequence; identical to SEQ ID NO: 35472
  Description of Artificial Sequence: Synthetic coding sequence

SEQ ID NO: 35485 - DNA, 528 bp, Artificial Sequence; identical to SEQ ID NO: 35475
  Description of Artificial Sequence: Synthetic coding sequence

SEQ ID NO: 35486 - DNA, 528 bp, Artificial Sequence; identical to SEQ ID NO: 35475
  Description of Artificial Sequence: Synthetic coding sequence

SEQ ID NO: 35487 - DNA, 321 bp, Artificial Sequence; identical to SEQ ID NO: 35480
  Description of Artificial Sequence: Synthetic coding sequence

SEQ ID NO: 35488 - DNA, 426 bp, Artificial Sequence; identical to SEQ ID NO: 35474
  Description of Artificial Sequence: Synthetic coding sequence

SEQ ID NO: 35489 - DNA, 528 bp, Artificial Sequence; identical to SEQ ID NO: 35475
  Description of Artificial Sequence: Synthetic coding sequence

SEQ ID NO: 35490 - DNA, 321 bp, Artificial Sequence; identical to SEQ ID NO: 35473
  Description of Artificial Sequence: Synthetic coding sequence

SEQ ID NO: 35491 - DNA, 321 bp, Artificial Sequence; identical to SEQ ID NO: 35480
  Description of Artificial Sequence: Synthetic coding sequence

SEQ ID NO: 35492 - DNA, 321 bp, Artificial Sequence; identical to SEQ ID NO: 35480
  Description of Artificial Sequence: Synthetic coding sequence

SEQ ID NO: 35493 - DNA, 426 bp, Artificial Sequence; identical to SEQ ID NO: 35471
  Description of Artificial Sequence: Synthetic coding sequence

SEQ ID NO: 35494 - DNA, 321 bp, Artificial Sequence; identical to SEQ ID NO: 35473
  Description of Artificial Sequence: Synthetic coding sequence

SEQ ID NO: 35495 - DNA, 774 bp, Artificial Sequence; identical to SEQ ID NO: 35479
  Description of Artificial Sequence: Synthetic coding sequence

SEQ ID NO: 35496 - DNA, 792 bp, Artificial Sequence; identical to SEQ ID NO: 35468
  Description of Artificial Sequence: Synthetic coding sequence

SEQ ID NO: 35497 - DNA, 321 bp, Artificial Sequence; identical to SEQ ID NO: 35473
  Description of Artificial Sequence: Synthetic coding sequence

SEQ ID NO: 35498 - DNA, 426 bp, Artificial Sequence; identical to SEQ ID NO: 35474
  Description of Artificial Sequence: Synthetic coding sequence

SEQ ID NO: 35499 - DNA, 774 bp, Artificial Sequence; identical to SEQ ID NO: 35479
  Description of Artificial Sequence: Synthetic coding sequence

SEQ ID NO: 35500 - DNA, 774 bp, Artificial Sequence; identical to SEQ ID NO: 35472
  Description of Artificial Sequence: Synthetic coding sequence

SEQ ID NO: 35501 - DNA, 528 bp, Artificial Sequence; identical to SEQ ID NO: 35475
  Description of Artificial Sequence: Synthetic coding sequence

SEQ ID NO: 35502 - DNA, 426 bp, Artificial Sequence; identical to SEQ ID NO: 35471
  Description of Artificial Sequence: Synthetic coding sequence

SEQ ID NO: 35503 - DNA, 528 bp, Artificial Sequence; identical to SEQ ID NO: 35475
  Description of Artificial Sequence: Synthetic coding sequence

SEQ ID NO: 35504 - DNA, 528 bp, Artificial Sequence; identical to SEQ ID NO: 35475
  Description of Artificial Sequence: Synthetic coding sequence

SEQ ID NO: 35505 - DNA, 792 bp, Artificial Sequence; identical to SEQ ID NO: 35470
  Description of Artificial Sequence: Synthetic coding sequence

SEQ ID NO: 35506 - DNA, 426 bp, Artificial Sequence; identical to SEQ ID NO: 35471
  Description of Artificial Sequence: Synthetic coding sequence

SEQ ID NO: 35507 - DNA, 774 bp, Artificial Sequence; identical to SEQ ID NO: 35472
  Description of Artificial Sequence: Synthetic coding sequence

SEQ ID NO: 35508 - DNA, 774 bp, Artificial Sequence; identical to SEQ ID NO: 35479
  Description of Artificial Sequence: Synthetic coding sequence

SEQ ID NO: 35509 - DNA, 651 bp, Artificial Sequence
  Description of Artificial Sequence: Synthetic coding sequence
atgatcaccttcctgcccctgctgctgggcctgagcctgggctgcaccggggccggcggctttgtggcccacgtggagagcacctgcctgctggatgatgctggcacccccaaggacttcacctactgcatctccttcaacaaggacctgctgacctgctgggaccctgaggagaacaagatggccccctgtgaatttggagtgctgaacagcctggccaacgtgctgagccagcacctgaaccagaaggacaccctgatgcagaggctgagaaatggcctgcagaactgtgccacccacacccagcccttctggggcagcctgaccaacagaacccggccccccagcgtgcaggtggccaagaccacccccttcaacacccgggagcctgtgatgctggcctgctacgtgtggggcttctacccagctgaggtgaccatcacctggaggaagaatggcaagctggtgatgccccacagcagcgcccacaagacagcccagcccaatggagactggacctaccagaccctgagccacctggccctgacccccagctatggagacacctacacctgtgtggtggagcacatcggggcccctgagcccatcctgcgggactggagcaagtgcatggctgatggctggaactag

SEQ ID NO: 35510 - DNA, 171 bp, Artificial Sequence
  Description of Artificial Sequence: Synthetic coding sequence
atgccccacagcagcgcccacaagacagcccagcccaatggagactggacctaccagaccctgagccacctggccctgacccccagctatggagacacctacacctgtgtggtggagcacatcggggcccctgagcccatcctgcgggactggcgctggcacatctcctag

SEQ ID NO: 35511 - DNA, 171 bp, Artificial Sequence; identical to SEQ ID NO: 35510
  Description of Artificial Sequence: Synthetic coding sequence

SEQ ID NO: 35512 - DNA, 651 bp, Artificial Sequence; identical to SEQ ID NO: 35477
  Description of Artificial Sequence: Synthetic coding sequence

SEQ ID NO: 35513 - DNA, 207 bp, Artificial Sequence
  Description of Artificial Sequence: Synthetic coding sequence
atgccccacagcagcgcccacaagacagcccagcccaatggagactggacctaccagaccctgagccacctggccctgacccccagctatggagacacctacacctgtgtggtggagcacatcggggcccctgagcccatcctgcgggactggagctacacccccctgcccggcagcaactacagcgagggctggcacatctcctag

SEQ ID NO: 35514 - DNA, 171 bp, Artificial Sequence; identical to SEQ ID NO: 35510
  Description of Artificial Sequence: Synthetic coding sequence

SEQ ID NO: 35515 - DNA, 288 bp, Artificial Sequence
  Description of Artificial Sequence: Synthetic coding sequence
atgccccacagcagcgcccacaagacagcccagcccaatggagactggacctaccagaccctgagccacctggccctgacccccagctatggagacacctacacctgtgtggtggagcacatcggggcccctgagcccatcctgcgggactggaccccaggcctgagccccatgcagaccctgaaggtgtctgtgtctgctgtgaccctgggcctgggcctcatcatcttcagcctgggcgtcatctcctggaggagagctggccacagccgctggcacatctcctag

SEQ ID NO: 35516 - DNA, 207 bp, Artificial Sequence; identical to SEQ ID NO: 35513
  Description of Artificial Sequence: Synthetic coding sequence

SEQ ID NO: 35517 - DNA, 207 bp, Artificial Sequence; identical to SEQ ID NO: 35513
  Description of Artificial Sequence: Synthetic coding sequence

SEQ ID NO: 35518 - DNA, 288 bp, Artificial Sequence; identical to SEQ ID NO: 35515
  Description of Artificial Sequence: Synthetic coding sequence

SEQ ID NO: 35519 - DNA, 651 bp, Artificial Sequence; identical to SEQ ID NO: 35509
  Description of Artificial Sequence: Synthetic coding sequence

SEQ ID NO: 35520 - DNA, 207 bp, Artificial Sequence; identical to SEQ ID NO: 35513
  Description of Artificial Sequence: Synthetic coding sequence

SEQ ID NO: 35521 - DNA, 651 bp, Artificial Sequence; identical to SEQ ID NO: 35477
  Description of Artificial Sequence: Synthetic coding sequence

SEQ ID NO: 35522 - DNA, 651 bp, Artificial Sequence; identical to SEQ ID NO: 35477
  Description of Artificial Sequence: Synthetic coding sequence

SEQ ID NO: 35523 - DNA, 171 bp, Artificial Sequence; identical to SEQ ID NO: 35510
  Description of Artificial Sequence: Synthetic coding sequence

SEQ ID NO: 35524 - DNA, 651 bp, Artificial Sequence; identical to SEQ ID NO: 35509
  Description of Artificial Sequence: Synthetic coding sequence

SEQ ID NO: 35525 - DNA, 288 bp, Artificial Sequence; identical to SEQ ID NO: 35515
  Description of Artificial Sequence: Synthetic coding sequence

SEQ ID NO: 35526 - DNA, 288 bp, Artificial Sequence; identical to SEQ ID NO: 35515
  Description of Artificial Sequence: Synthetic coding sequence

SEQ ID NO: 35527 - DNA, 651 bp, Artificial Sequence; identical to SEQ ID NO: 35509
  Description of Artificial Sequence: Synthetic coding sequence

SEQ ID NO: 35528 - DNA, 465 bp, Artificial Sequence
  Description of Artificial Sequence: Synthetic coding sequence
atggccggcggcggcccccaggccaacccagactacctgttccacgtgatcttcctgggggacagcaatgtgggcaagaccagcttcctgcacctgctgcaccagaacagctttgccaccggcctgacagccaccgtgctgcaccccagcctgtgtgtgctgggcgtggacttccgggtgaagaccctgctggtggacaacaagtgctttgtgctgcagctgtgggacacagctggccaggagcgctaccacagcatgacccggcagctgctgaggaaggcagatggagtggtgctgatgtatgacatcaccagccaggagagctttgcccacgtgcgctactggctggactgcctgcaggatgctggcagtgatggagtggtgatcctgctgctgggcaacaagatggactgtgaggaggagcggcaggtgtctgtggaggccggccagcagctggcccagtag

SEQ ID NO: 35529 - DNA, 261 bp, Artificial Sequence
  Description of Artificial Sequence: Synthetic coding sequence
atggccctgcgggccggcctggtgctgggcttccacaccctgatgaccctgctgagcccccaggaggccggggccaccaagggccgggccggccgccacagaagaaaccagagccccagcggccaccctggaggagccctgcagccccagcagagccaccagagggccagcactggagaccgggccccccaggtgtctgggggcgccggccctgcccagcacccccacctgcaccggggccagcacctgcccccctgctag

SEQ ID NO: 35530 - DNA, 261 bp, Artificial Sequence; identical to SEQ ID NO: 35529
  Description of Artificial Sequence: Synthetic coding sequence

SEQ ID NO: 35531 - DNA, 753 bp, Artificial Sequence
  Description of Artificial Sequence: Synthetic coding sequence
atggccctgcgggccggcctggtgctgggcttccacaccctgatgaccctgctgagcccccaggaggccggggccaccaaggctgaccacatgggcagctatggccctgccttctaccagagctatggagccagcggccagttcacccatgaatttgatgaggagcagctgttctctgtggacctgaagaagtctgaggccgtgtggaggctgcctgagtttggagactttgccaggtttgacccccagggcggcctggccggcattgctgccatcaaggcccacctggacatcctggtggagaggagcaacagaagccgggccatcaacgtgcccccccgggtgacagtgctgcccaagagccgggtggagctgggccagcccaacatcctgatctgcatcgtggacaacatcttcccccctgtgatcaacatcacctggctgagaaatggccagacagtgacagaaggagtggcccagaccagcttctacagccagcctgaccacctgttcaggaagttccactacctgccctttgtgcccagcgcagaagatgtgtatgactgccaggtggagcactggggcctggatgcccccctgctgcggcactgggagctgcaggtgcccatccccccaccagatgccatggagaccctggtgtgtgccctgggcctggccatcggcctggtgggcttcctggtgggcaccgtgctgatcatcatgggcacctacgtgtcctctgtgcccaggtag

SEQ ID NO: 35532 - DNA, 261 bp, Artificial Sequence
  Description of Artificial Sequence: Synthetic coding sequence
atggccctgcgggccggcctggtgctgggcttccacaccctgatgaccctgctgagcccccaggaggccggggccaccaagggctgggccggccgccacagaagaaaccagagccccagcggccaccctggaggagccctgcagccccagcagagccaccagagggccagcactggagaccgggccccccaggtgtctgggggcgccggccctgcccagcacccccacctgcaccggggccagcacctgcccccctgctag

SEQ ID NO: 35533 - DNA, 261 bp, Artificial Sequence; identical to SEQ ID NO: 35529
  Description of Artificial Sequence: Synthetic coding sequence

SEQ ID NO: 35534 - DNA, 753 bp, Artificial Sequence; identical to SEQ ID NO: 35531
  Description of Artificial Sequence: Synthetic coding sequence

SEQ ID NO: 35535 - DNA, 753 bp, Artificial Sequence; identical to SEQ ID NO: 35531
  Description of Artificial Sequence: Synthetic coding sequence

SEQ ID NO: 35536 - DNA, 186 bp, Artificial Sequence
  Description of Artificial Sequence: Synthetic coding sequence
atggccctgcgggccggcctggtgctgggcttccacaccctgatgaccctgctgagcccccaggaggccggggccaccaaggctgaccacatgggcagctatggcccccccagcaccagcctgacagccccccgggccagcagccccatgaacctgatgaggaacagctgcagcctgtggacctag

SEQ ID NO: 35537 - DNA, 753 bp, Artificial Sequence; identical to SEQ ID NO: 35531
  Description of Artificial Sequence: Synthetic coding sequence

SEQ ID NO: 35538 - DNA, 753 bp, Artificial Sequence; identical to SEQ ID NO: 35531
  Description of Artificial Sequence: Synthetic coding sequence

SEQ ID NO: 35539 - DNA, 261 bp, Artificial Sequence; identical to SEQ ID NO: 35529
  Description of Artificial Sequence: Synthetic coding sequence

SEQ ID NO: 35540 - DNA, 615 bp, Artificial Sequence
  Description of Artificial Sequence: Synthetic coding sequence
atgggcagctatggccctgccttctaccagagctatggagccagcggccagttcacccatgaatttgatgaggagcagctgttctctgtggacctgaagaagtctgaggccgtgtggaggctgcctgagtttggagactttgccaggtttgacccccagggcggcctggccggcattgctgccatcaaggcccacctggacatcctggtggagaggagcaacagaagccgggccatcaacgtgcccccccgggtgacagtgctgcccaagagccgggtggagctgggccagcccaacatcctgatctgcatcgtggacaacatcttcccccctgtgatcaacatcacctggctgagaaatggccagacagtgacagaaggagtggcccagaccagcttctacagccagcctgaccacctgttcaggaagttccactacctgccctttgtgcccagcgcagaagatgtgtatgactgccaggtggagcactggggcctggatgcccccctgctgcggcactggggcaatgaccccagcgagagaaatgacctgtgggagaccccctgccgcagctcctgggtgtgtgacagcccctgtgtgctgagcgccctgtag

SEQ ID NO: 35541 - DNA, 753 bp, Artificial Sequence; identical to SEQ ID NO: 35531
  Description of Artificial Sequence: Synthetic coding sequence

SEQ ID NO: 35542 - DNA, 261 bp, Artificial Sequence; identical to SEQ ID NO: 35532
  Description of Artificial Sequence: Synthetic coding sequence

SEQ ID NO: 35543 - DNA, 261 bp, Artificial Sequence; identical to SEQ ID NO: 35529
  Description of Artificial Sequence: Synthetic coding sequence

SEQ ID NO: 35544 - DNA, 186 bp, Artificial Sequence; identical to SEQ ID NO: 35536
  Description of Artificial Sequence: Synthetic coding sequence

SEQ ID NO: 35545 - DNA, 186 bp, Artificial Sequence; identical to SEQ ID NO: 35536
  Description of Artificial Sequence: Synthetic coding sequence

SEQ ID NO: 35546 - DNA, 615 bp, Artificial Sequence; identical to SEQ ID NO: 35540
  Description of Artificial Sequence: Synthetic coding sequence

SEQ ID NO: 35547 - DNA, 615 bp, Artificial Sequence; identical to SEQ ID NO: 35540
  Description of Artificial Sequence: Synthetic coding sequence

SEQ ID NO: 35548 - DNA, 615 bp, Artificial Sequence; identical to SEQ ID NO: 35540
  Description of Artificial Sequence: Synthetic coding sequence

SEQ ID NO: 35549 - DNA, 186 bp, Artificial Sequence; identical to SEQ ID NO: 35536
  Description of Artificial Sequence: Synthetic coding sequence

SEQ ID NO: 35550 - DNA, 615 bp, Artificial Sequence; identical to SEQ ID NO: 35540
  Description of Artificial Sequence: Synthetic coding sequence

SEQ ID NO: 35551 - DNA, 615 bp, Artificial Sequence; identical to SEQ ID NO: 35540
  Description of Artificial Sequence: Synthetic coding sequence

SEQ ID NO: 35552 - DNA, 186 bp, Artificial Sequence; identical to SEQ ID NO: 35536
  Description of Artificial Sequence: Synthetic coding sequence

SEQ ID NO: 35553 - DNA, 186 bp, Artificial Sequence; identical to SEQ ID NO: 35536
  Description of Artificial Sequence: Synthetic coding sequence

SEQ ID NO: 35554 - DNA, 186 bp, Artificial Sequence; identical to SEQ ID NO: 35536
  Description of Artificial Sequence: Synthetic coding sequence

SEQ ID NO: 35555 - DNA, 615 bp, Artificial Sequence; identical to SEQ ID NO: 35540
  Description of Artificial Sequence: Synthetic coding sequence

SEQ ID NO: 35556 - DNA, 549 bp, Artificial Sequence
  Description of Artificial Sequence: Synthetic coding sequence
tgaaacctgacccggctggacagctccatgacccagggcacagacagccctgaggactttgtgatccaggccaaggctgactgctacttcaccaacggcacagagaaggtgcagtttgtggtgcgcttcatcttcaacctggaggagtatgtgcgctttgacagtgatgtgggcatgtttgtggccctgaccaagctgggccagccagatgctgagcagtggaacagccggctggacctgctggagaggagccggcaggccgtggatggagtgtgccgccacaactaccgcctgggcgcccccttcaccgtgggcaggaaggaggtgacagtgtacccagagaggacccccctgctgcaccagcacaacctgctgcactgcagcgtgacaggcttctacccaggggacatcaagatcaagtggttcctgaatggccaggaggagcgggccggcgtgatgagcacaggccccatcagaaatggagactggaccttccagacagtggtgatgctggagatgaccccagagctgggccacgtgtacacctag

SEQ ID NO: 35557 - DNA, 822 bp, Artificial Sequence
  Description of Artificial Sequence: Synthetic coding sequence
atgggcagcggctgggtgccctgggtggtggccctgctggtgaacctgacccggctggacagctccatgacccagggcacagacagcccagaagattttgtgatccaggccaaggctgactgctacttcaccaatggaacagagaaggtgcagtttgtggtgcgcttcatcttcaacctggaggagtatgtgcgctttgacagtgatgtgggcatgtttgtggccctgaccaagctgggccagccagatgctgagcagtggaacagccggctggacctgctggagaggagccggcaggccgtggatggagtgtgccgccacaactaccgcctgggcgcccccttcaccgtgggcaggaaggtgcagcctgaggtgacagtgtacccagagaggacccccctgctgcaccagcacaacctgctgcactgcagcgtgacaggcttctacccaggggacatcaagatcaagtggttcctgaatggccaggaggagcgggccggcgtgatgagcacaggccccatcagaaatggagactggaccttccagacagtggtgatgctggagatgaccccagagctgggccacgtgtacacctgcctggtggaccacagcagcctgctgagccctgtgtctgtggagtggagggcccagagcgagtacagctggaggaagatgctgtctggaattgctgccttcctgctgggcctcatcttcctgctggtgggcatcgtcatccagctgcgggcccagaagggctacgtgaggacccagatgtctggaaatgaggtgtccagagctgtgctgctgccccagagctgctag

SEQ ID NO: 35558 - DNA, 822 bp, Artificial Sequence; identical to SEQ ID NO: 35557
  Description of Artificial Sequence: Synthetic coding sequence

SEQ ID NO: 35559 - DNA, 549 bp, Artificial Sequence; identical to SEQ ID NO: 35556
  Description of Artificial Sequence: Synthetic coding sequence

SEQ ID NO: 35560 - DNA, 822 bp, Artificial Sequence; identical to SEQ ID NO: 35557
  Description of Artificial Sequence: Synthetic coding sequence

SEQ ID NO: 35561 - DNA, 549 bp, Artificial Sequence; identical to SEQ ID NO: 35556
  Description of Artificial Sequence: Synthetic coding sequence

SEQ ID NO: 35562 - DNA, 549 bp, Artificial Sequence; identical to SEQ ID NO: 35556
  Description of Artificial Sequence: Synthetic coding sequence

SEQ ID NO: 35563 - DNA, 549 bp, Artificial Sequence; identical to SEQ ID NO: 35556
  Description of Artificial Sequence: Synthetic coding sequence

SEQ ID NO: 35564 - DNA, 822 bp, Artificial Sequence
  Description of Artificial Sequence: Synthetic coding sequence
atgggcagcggctgggtgccctgggtggtggccctgctggtgaacctgacccggctggacagctccatgacccagggcacagacagcccagaagattttgtgatccaggccaaggctgactgctacttcaccaatggaacagagaaggtgcagtttgtggtgcgcttcatcttcaacctggaggagtatgtgcgctttgacagtgatgtgggcatgtttgtggccctgaccaagctgggccagccagatgctgagcagtggaacagccggctggacctgctggagaggagccggcaggccgtggatggagtgtgccgccacaactaccgcctgggcgcccccttcaccgtgggcaggaaggtgcagcctgaggtgacagtgtacccagagaggacccccctgctgcaccagcacaacctgctgcactgcagcgtgacaggcttctacccaggggacatcaagatcaagtggttcctgaatggccaggaggagcgggccggcgtgatgagcacaggccccatcagaaatggagactggaccttccagacagtggtgatgctggagatgaccccagagctgggccacgtgtacacctgcctggtggaccacagcagcctgctgagccccatctctgtggagtggagggcccagagcgagtacagctggaggaagatgctgtctggaattgctgccttcctgctgggcctcatcttcctgctggtgggcatcgtcatccagctgcgggcccagaagggctacgtgaggacccagatgtctggaaatgaggtgtccagagctgtgctgctgccccagagctgctag

SEQ ID NO: 35565 - DNA, 822 bp, Artificial Sequence; identical to SEQ ID NO: 35557
  Description of Artificial Sequence: Synthetic coding sequence

SEQ ID NO: 35566 - DNA, 549 bp, Artificial Sequence; identical to SEQ ID NO: 35556
  Description of Artificial Sequence: Synthetic coding sequence

SEQ ID NO: 35567 - DNA, 822 bp, Artificial Sequence; identical to SEQ ID NO: 35557
  Description of Artificial Sequence: Synthetic coding sequence

SEQ ID NO: 35568 - DNA, 411 bp, Artificial Sequence
  Description of Artificial Sequence: Synthetic coding sequence
atgtcctggaagaaggccctgcgcatccctgggggcctgcgggtggccaccgtgaccctgatgctggccatgctgagcacccctgtggccgagggccgggacagcccagaagattttgtgtaccagttcaagggcatgtgctacttcaccaatggaacagagcgggtgcggctggtgacccgctacatctacaaccgggaggagtatgccaggtttgacagtgatgtgggcgtgtacagagctgtgacccccctgggccccccagatgctgagtactggaacagccagaaggaggtgctggagaggaccagggctgagctggacacagtgtgccgccacaactaccagctggagctgcggaccaccctgcagaggcggggcaccgtgacaggccccagccgctcctggtag

SEQ ID NO: 35569 - DNA, 840 bp, Artificial Sequence
  Description of Artificial Sequence: Synthetic coding sequence
atgtcctggaagatggccctgcagatccctgggggcttctgggccgctgctgtgacagtgatgctggtgatgctgagcacccctgtggccgaggcccgggacttccccaaggacttcctggtgcagttcaagggcatgtgctacttcaccaatggaacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaggccgagctgcggaccaccctgcagaggcaggtggagcccaccgtgaccatcagccccagcaggacagaggccctgaaccaccacaacctgctggtgtgcagcgtgacagacttctacccagcccagatcaaggtgcagtggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggagggcccagagcgagagcgcccagagcaagatgctgggcggcgtgggcggctttgtgctgggcctcatcttcctgggcctgggcctcatcatccgccaccggggccagaagggcccccggggccccccacctgctggcaacatcagcgccatgatccagagcggggagcgggcccaggcctag

SEQ ID NO: 35570 - DNA, 696 bp, Artificial Sequence
  Description of Artificial Sequence: Synthetic coding sequence
atgtcctggaagatggccctgcagatccctgggggcttctgggccgctgctgtgacagtgatgctggtgatgctgagcacccctgtggccgaggcccgggacttccccaaggacttcctggtgcagttcaagggcatgtgctacttcaccaatggaacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaggccgagctgcggaccaccctgcagaggcaggtggagcccaccgtgaccatcagccccagcaggacagaggccctgaaccaccacaacctgctggtgtgcagcgtgacagacttctacccagcccagatcaaggtgcagtggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggaggccccggggccccccacctgctggcctgctgcactag

SEQ ID NO: 35571 - DNA, 807 bp, Artificial Sequence
  Description of Artificial Sequence: Synthetic coding sequence
atgtcctggaagatggccctgcagatccctgggggcttctgggccgctgctgtgacagtgatgctggtgatgctgagcacccctgtggccgaggcccgggacttccccaaggacttcctggtgcagttcaagggcatgtgctacttcaccaatggaacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaggccgagctgcggaccaccctgcagaggcaggtggagcccaccgtgaccatcagccccagcaggacagaggccctgaaccaccacaacctgctggtgtgcagcgtgacagacttctacccagcccagatcaaggtgcagtggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggagggcccagagcgagagcgcccagagcaagatgctgggcggcgtgggcggctttgtgctgggcctcatcttcctgggcctgggcctcatcatccgccaccggggccagaagggcccccggggccccccacctgctggcctgctgcactag

SEQ ID NO: 35572 - DNA, 684 bp, Artificial Sequence
  Description of Artificial Sequence: Synthetic coding sequence
atggccctgcagatccctgggggcttctgggccgctgctgtgacagtgatgctggtgatgctgagcacccctgtggccgaggcccgggacttccccaaggacttcctggtgcagttcaagggcatgtgctacttcaccaatggaacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaggccgagctgcggaccaccctgcagaggcaggtggagcccaccgtgaccatcagccccagcaggacagaggccctgaaccaccacaacctgctggtgtgcagcgtgacagacttctacccagcccagatcaaggtgcgctggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggaggccccggggccccccacctgctggcctgctgcactag

SEQ ID NO: 35573 - DNA, 828 bp, Artificial Sequence
  Description of Artificial Sequence: Synthetic coding sequence
atggccctgcagatccctgggggcttctgggccgctgctgtgacagtgatgctggtgatgctgagcacccctgtggccgaggcccgggacttccccaaggacttcctggtgcagttcaagggcatgtgctacttcaccaatggaacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaggccgagctgcggaccaccctgcagaggcaggtggagcccaccgtgaccatcagccccagcaggacagaggccctgaaccaccacaacctgctggtgtgcagcgtgacagacttctacccagcccagatcaaggtgcgctggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggagggcccagagcgagagcgcccagagcaagatgctgagcggcatcggcggctttgtgctgggcctcatcttcctgggcctgggcctcatcatccgccaccggggccagaagggcccccggggccccccacctgctggcaacatcagcgccatgatccagagcggggagcgggcccaggcctag

SEQ ID NO: 35574 - DNA, 657 bp, Artificial Sequence
  Description of Artificial Sequence: Synthetic coding sequence
tgactgcagatccctgggggcttctgggccgctgctgtgacagtgatgctggtgatgctgagcacccctgtggccgaggcccgggacttccccaaggacttcctggtgcagttcaagggcatgtgctacttcaccaacggcacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaagctgagctgcggaccaccctgcagaggcaggtggagcccaccgtgaccatcagccccagcaggacagaggccctgaaccaccacaacctgctggtgtgcagcgtgacagacttctacccagcccagatcaaggtgcagtggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggaggctgctgcactag

SEQ ID NO: 35575 - DNA, 696 bp, Artificial Sequence; identical to SEQ ID NO: 35570
  Description of Artificial Sequence: Synthetic coding sequence

SEQ ID NO: 35576 - DNA, 657 bp, Artificial Sequence
  Description of Artificial Sequence: Synthetic coding sequence
tgactgcagatccctgggggcttctgggccgctgctgtgacagtgatgctggtgatgctgagcacccctgtggccgaggcccgggacttccccaaggacttcctggtgcagttcaagggcatgtgctacttcaccaacggcacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaagctgagctgcggaccaccctgcagaggcaggtggagcccaccgtgaccatcagccccagcaggacagaggccctgaaccaccacaacctgctggtgtgcagcgtgacagacttctacccagcccagatcaaggtgcgctggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggaggctgctgcactag

SEQ ID NO: 35577 - DNA, 657 bp, Artificial Sequence; identical to SEQ ID NO: 35574
  Description of Artificial Sequence: Synthetic coding sequence

SEQ ID NO: 35578 - DNA, 840 bp, Artificial Sequence; identical to SEQ ID NO: 35569
  Description of Artificial Sequence: Synthetic coding sequence

SEQ ID NO: 35579 - DNA, 795 bp, Artificial Sequence
  Description of Artificial Sequence: Synthetic coding sequence
atggccctgcagatccctgggggcttctgggccgctgctgtgacagtgatgctggtgatgctgagcacccctgtggccgaggcccgggacttccccaaggacttcctggtgcagttcaagggcatgtgctacttcaccaatggaacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaggccgagctgcggaccaccctgcagaggcaggtggagcccaccgtgaccatcagccccagcaggacagaggccctgaaccaccacaacctgctggtgtgcagcgtgacagacttctacccagcccagatcaaggtgcgctggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggagggcccagagcgagagcgcccagagcaagatgctgagcggcatcggcggctttgtgctgggcctcatcttcctgggcctgggcctcatcatccgccaccggggccagaagggcccccggggccccccacctgctggcctgctgcactag

SEQ ID NO: 35580 - DNA, 657 bp, Artificial Sequence; identical to SEQ ID NO: 35576
  Description of Artificial Sequence: Synthetic coding sequence

SEQ ID NO: 35581 - DNA, 657 bp, Artificial Sequence; identical to SEQ ID NO: 35574
  Description of Artificial Sequence: Synthetic coding sequence

SEQ ID NO: 35582 - DNA, 684 bp, Artificial Sequence; identical to SEQ ID NO: 35572
  Description of Artificial Sequence: Synthetic coding sequence

SEQ ID NO: 35583 - DNA, 657 bp, Artificial Sequence; identical to SEQ ID NO: 35576
  Description of Artificial Sequence: Synthetic coding sequence

SEQ ID NO: 35584 - DNA, 696 bp, Artificial Sequence; identical to SEQ ID NO: 35570
  Description of Artificial Sequence: Synthetic coding sequence

SEQ ID NO: 35585 - DNA, 795 bp, Artificial Sequence; identical to SEQ ID NO: 35579
  Description of Artificial Sequence: Synthetic coding sequence

SEQ ID NO: 35586 - DNA, 795 bp, Artificial Sequence; identical to SEQ ID NO: 35579
  Description of Artificial Sequence: Synthetic coding sequence

SEQ ID NO: 35587 - DNA, 807 bp, Artificial Sequence; identical to SEQ ID NO: 35571
  Description of Artificial Sequence: Synthetic coding sequence

SEQ ID NO: 35588 - DNA, 807 bp, Artificial Sequence; identical to SEQ ID NO: 35571
  Description of Artificial Sequence: Synthetic coding sequence

SEQ ID NO: 35589 - DNA, 696 bp, Artificial Sequence; identical to SEQ ID NO: 35570
  Description of Artificial Sequence: Synthetic coding sequence

SEQ ID NO: 35590 - DNA, 840 bp, Artificial Sequence; identical to SEQ ID NO: 35569
  Description of Artificial Sequence: Synthetic coding sequence

SEQ ID NO: 35591 - DNA, 657 bp, Artificial Sequence; identical to SEQ ID NO: 35576
  Description of Artificial Sequence: Synthetic coding sequence

SEQ ID NO: 35592 - DNA, 828 bp, Artificial Sequence; identical to SEQ ID NO: 35573
  Description of Artificial Sequence: Synthetic coding sequence

SEQ ID NO: 35593 - DNA, 795 bp, Artificial Sequence; identical to SEQ ID NO: 35579
  Description of Artificial Sequence: Synthetic coding sequence

SEQ ID NO: 35594 - DNA, 684 bp, Artificial Sequence; identical to SEQ ID NO: 35572
  Description of Artificial Sequence: Synthetic coding sequence

SEQ ID NO: 35595 - DNA, 840 bp, Artificial Sequence; identical to SEQ ID NO: 35569
  Description of Artificial Sequence: Synthetic coding sequence

SEQ ID NO: 35596 - DNA, 828 bp, Artificial Sequence; identical to SEQ ID NO: 35573
  Description of Artificial Sequence: Synthetic coding sequence

SEQ ID NO: 35597 - DNA, 657 bp, Artificial Sequence; identical to SEQ ID NO: 35574
  Description of Artificial Sequence: Synthetic coding sequence

SEQ ID NO: 35598 - DNA, 828 bp, Artificial Sequence; identical to SEQ ID NO: 35573
  Description of Artificial Sequence: Synthetic coding sequence

SEQ ID NO: 35599 - DNA, 684 bp, Artificial Sequence; identical to SEQ ID NO: 35572
  Description of Artificial Sequence: Synthetic coding sequence

SEQ ID NO: 35600 - DNA, 807 bp, Artificial Sequence; identical to SEQ ID NO: 35571
  Description of Artificial Sequence: Synthetic coding sequence

SEQ ID NO: 35601 - DNA, 627 bp, Artificial Sequence
  Description of Artificial Sequence: Synthetic coding sequence
atgctgagcacccctgtggccgaggcccgggacttccccaaggacttcctggtgcagttcaagggcatgtgctacttcaccaacggcacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaagctgagctgcggaccaccctgcagaggcaggtggagcccaccgtgaccatcagccccagcaggacagaggccctgaaccaccacaacctgctggtgtgcagcgtgacagacttctacccagcccagatcaaggtgcagtggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggaggccccggggccccccacctgctggcctgctgcactag

SEQ ID NO: 35602 - DNA, 828 bp, Artificial Sequence
  Description of Artificial Sequence: Synthetic coding sequence
atggccctgcagatccctgggggcttctgggccgctgctgtgacagtgatgctggtgatgctgagcacccctgtggccgaggcccgggacttccccaaggacttcctggtgcagttcaagggcatgtgctacttcaccaatggaacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaggccgagctgcggaccaccctgcagaggcaggtggagcccaccgtgaccatcagccccagcaggacagaggccctgaaccaccacaacctgctggtgtgcagcgtgacagacttctacccagcccagatcaaggtgcagtggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggagggcccagagcgagagcgcccagagcaagatgctgggcggcgtgggcggctttgtgctgggcctcatcttcctgggcctgggcctcatcatccgccaccggggccagaagggcccccggggccccccacctgctggcaacatcagcgccatgatccagagcggggagcgggcccaggcctag

SEQ ID NO: 35603 - DNA, 627 bp, Artificial Sequence
  Description of Artificial Sequence: Synthetic coding sequence
atgctgagcacccctgtggccgaggcccgggacttccccaaggacttcctggtgcagttcaagggcatgtgctacttcaccaacggcacagagcgggtgcggggcgtggcccgctacatctacaaccgggaggagtatggccgctttgacagtgatgtgggggagttccaggccgtgacagagctgggccgcagcattgaggactggaacaactacaaggacttcctggagcaggagagagctgctgtggacaaggtgtgccgccacaactatgaagctgagctgcggaccaccctgcagaggcaggtggagcccaccgtgaccatcagccccagcaggacagaggccctgaaccaccacaacctgctggtgtgcagcgtgacagacttctacccagcccagatcaaggtgcgctggttcagaaatgaccaggaggagacagctggggtggtgtccaccagcctcatcagaaatggagactggaccttccagatcctggtgatgctggagatcaccccccagagaggagacatctacacctgccaggtggagcaccccagcctgcagagccccatcaccgtggagtggaggccccggggccccccacctgctggcctgctgcactag

SEQ ID NO: 35604 - DNA, 627 bp, Artificial Sequence; identical to SEQ ID NO: 35601
  Description of Artificial Sequence: Synthetic coding sequence

SEQ ID NO: 35605 - DNA, 627 bp, Artificial Sequence; identical to SEQ ID NO: 35601
  Description of Artificial Sequence: Synthetic coding sequence

SEQ ID NO: 35606 - DNA, 627 bp, Artificial Sequence; identical to SEQ ID NO: 35603
  Description of Artificial Sequence: Synthetic coding sequence

SEQ ID NO: 35607 - DNA, 627 bp, Artificial Sequence; identical to SEQ ID NO: 35601
  Description of Artificial Sequence: Synthetic coding sequence

SEQ ID NO: 35608 - DNA, 828 bp, Artificial Sequence; identical to SEQ ID NO: 35602
  Description of Artificial Sequence: Synthetic coding sequence

SEQ ID NO: 35609 - DNA, 627 bp, Artificial Sequence; identical to SEQ ID NO: 35603
  Description of Artificial Sequence: Synthetic coding sequence

SEQ ID NO: 35610 - DNA, 828 bp, Artificial Sequence; identical to SEQ ID NO: 35602
  Description of Artificial Sequence: Synthetic coding sequence

SEQ ID NO: 35611 - DNA, 828 bp, Artificial Sequence; identical to SEQ ID NO: 35602
  Description of Artificial Sequence: Synthetic coding sequence

SEQ ID NO: 35612 - DNA, 690 bp, Artificial Sequence
  Description of Artificial Sequence: Synthetic coding sequence
atggccatcagcggcgtgcctgtgctgggcttcttcatcatcgctgtgctgatgtctgcccaggagagctgggccatcaaggaggagcacgtgatcatccaggccgagttctacctgaacccagaccagagcggggagttcatgtttgattttgatggagatgagatcttccacgtggacatggccaagaaggagaccgtgtggaggctggaggagtttggccgctttgccagctttgaggcccagggcgccctggccaacattgctgtggacaaggccaacctggagatcatgaccaagaggagcaactacacccccatcaccaatgacaagttcaccccacctgtggtgaatgtgacctggctgagaaatggcaagcctgtgaccaccggggtgtctgaaacagtgttcctgccccgggaggaccacctgttcaggaagttccactacctgcccttcctgcccagcacagaagatgtgtatgactgccgggtggagcactggggcctggatgagcccctgctgaagcactgggagtttgatgcccccagccccctgcctgagaccacagaaaatgtggtgtgtgccctgggcctgactgtgggcctggtgggcatcatcatcggcaccatcttcatcatcaagggcctgaggaagagcaatgctgctgagcggcggggccccctgtag

SEQ ID NO: 35613 - DNA, 765 bp, Artificial Sequence
  Description of Artificial Sequence: Synthetic coding sequence
atggccatcagcggcgtgcctgtgctgggcttcttcatcatcgctgtgctgatgtctgcccaggagagctgggccatcaaggaggagcacgtgatcatccaggccgagttctacctgaacccagaccagagcggggagttcatgtttgattttgatggagatgagatcttccacgtggacatggccaagaaggagaccgtgtggaggctggaggagtttggccgctttgccagctttgaggcccagggcgccctggccaacattgctgtggacaaggccaacctggagatcatgaccaagaggagcaactacacccccatcaccaacgtgcccccagaggtgacagtgctgaccaacagccctgtggagctgcgggagcccaacgtgctgatctgcttcatcgacaagttcaccccacctgtggtgaatgtgacctggctgagaaatggcaagcctgtgaccactggagtgtctgagaccgtcttcctgccccgggaggaccacctgttcaggaagttccactacctgcccttcctgcccagcacagaagatgtgtatgactgccgggtggagcactggggcctggatgagcccctgctgaagcactgggagtttgatgcccccagccccctgcctgagaccacagaaaatgtggtgtgtgccctgggcctgactgtgggcctggtgggcatcatcatcggcaccatcttcatcatcaagggcctgaggaagagcaatgctgctgagcggcggggccccctgtag

SEQ ID NO: 35614 - DNA, 690 bp, Artificial Sequence
  Description of Artificial Sequence: Synthetic coding sequence
atggccatcagcggcgtgcctgtgctgggcttcttcatcatcgctgtgctgatgtctgcccaggagagctgggccatcaaggaggagcacgtgatcatccaggccgagttctacctgaacccagaccagagcggggagttcatgtttgattttgatggagatgagatcttccacgtggacatggccaagaaggagaccgtgtggaggctggaggagtttggccgctttgccagctttgaggcccagggcgccctggccaacattgctgtggacaaggccaacctggagatcatgaccaagaggagcaactacacccccatcaccaatgacaagttcaccccacctgtggtgaatgtgacctggctgagaaatggcaagcctgtgaccaccggggtgtctgaaacagtgttcctgccccgggaggaccacctgttcaggaagttccactacctgcccttcctgcccagcacagaagatgtgtatgactgccgggtggagcactggggcctggatgagcccctgctgaagcactgggagtttgatgcccccagccccctgcctgagaccacagaaaatgtggtgtgtgccctgggcctgactgtgggcctggtgggcatcatcatcggcaccatcttcatcatcaagggcgtgaggaagagcaatgctgctgagcggcggggccccctgtag

SEQ ID NO: 35615 - DNA, 765 bp, Artificial Sequence
  Description of Artificial Sequence: Synthetic coding sequence
atggccatcagcggcgtgcctgtgctgggcttcttcatcatcgctgtgctgatgtctgcccaggagagctgggccatcaaggaggagcacgtgatcatccaggccgagttctacctgaacccagaccagagcggggagttcatgtttgattttgatggagatgagatcttccacgtggacatggccaagaaggagaccgtgtggaggctggaggagtttggccgctttgccagctttgaggcccagggcgccctggccaacattgctgtggacaaggccaacctggagatcatgaccaagaggagcaactacacccccatcaccaacgtgcccccagaggtgacagtgctgaccaacagccctgtggagctgcgggagcccaacgtgctgatctgcttcatcgacaagttcaccccacctgtggtgaatgtgacctggctgagaaatggcaagcctgtgaccactggagtgtctgagaccgtcttcctgccccgggaggaccacctgttcaggaagttccactacctgcccttcctgcccagcacagaagatgtgtatgactgccgggtggagcactggggcctggatgagcccctgctgaagcactgggagtttgatgcccccagccccctgcctgagaccacagaaaatgtggtgtgtgccctgggcctgactgtgggcctggtgggcatcatcatcggcaccatcttcatcatcaagggcgtgaggaagagcaatgctgctgagcggcggggccccctgtag

SEQ ID NO: 35616 - DNA, 765 bp, Artificial Sequence; identical to SEQ ID NO: 35613
  Description of Artificial Sequence: Synthetic coding sequence

SEQ ID NO: 35617 - DNA, 690 bp, Artificial Sequence; identical to SEQ ID NO: 35614
  Description of Artificial Sequence: Synthetic coding sequence

SEQ ID NO: 35618 - DNA, 765 bp, Artificial Sequence; identical to SEQ ID NO: 35615
  Description of Artificial Sequence: Synthetic coding sequence

SEQ ID NO: 35619 - DNA, 765 bp, Artificial Sequence; identical to SEQ ID NO: 35615
  Description of Artificial Sequence: Synthetic coding sequence

SEQ ID NO: 35620 - DNA, 690 bp, Artificial Sequence; identical to SEQ ID NO: 35614
  Description of Artificial Sequence: Synthetic coding sequence

SEQ ID NO: 35621 - DNA, 765 bp, Artificial Sequence; identical to SEQ ID NO: 35615
  Description of Artificial Sequence: Synthetic coding sequence

SEQ ID NO: 35622 - DNA, 690 bp, Artificial Sequence; identical to SEQ ID NO: 35614
  Description of Artificial Sequence: Synthetic coding sequence

SEQ ID NO: 35623 - DNA, 690 bp, Artificial Sequence; identical to SEQ ID NO: 35614
  Description of Artificial Sequence: Synthetic coding sequence

SEQ ID NO: 35624 - DNA, 690 bp, Artificial Sequence; identical to SEQ ID NO: 35612
  Description of Artificial Sequence: Synthetic coding sequence

SEQ ID NO: 35625 - DNA, 765 bp, Artificial Sequence; identical to SEQ ID NO: 35615
  Description of Artificial Sequence: Synthetic coding sequence

SEQ ID NO: 35626 - DNA, 543 bp, Artificial Sequence
  Description of Artificial Sequence: Synthetic coding sequence
atggccatcagcggcgtgcctgtgctgggcttcttcatcatcgctgtgctgatgtctgcccaggagagctgggccatcaaggaggagcacgtgatcatccaggccgagttctacctgaacccagaccagagcggggagttcatgtttgattttgatggagatgagatcttccacgtggacatggccaagaaggagaccgtgtggaggctggaggagtttggccgctttgccagctttgaggcccagggcgccctggccaacattgctgtggacaaggccaacctggagatcatgaccaagaggagcaagcccagcccccgggactaccgggagcggggcgtgtgccccggccctgactgtggcagcggcggccaccactactgggaccacctgcaccaccagggcatcgcccagaagcagtgcagcaggacccagggcgcctctgtgcgccacatggaggtgatggtgttcctgcgggagaagatcacagaggagaccagcgccctgatggccctgcagagctggcagtactacaacccctag

SEQ ID NO: 35627 - DNA, 714 bp, Artificial Sequence
  Description of Artificial Sequence: Synthetic coding sequence
atgtctgcccaggagagctgggccatcaaggaggagcacgtgatcatccaggccgagttctacctgaacccagaccagagcggggagttcatgtttgattttgatggagatgagatcttccacgtggacatggccaagaaggagaccgtgtggaggctggaggagtttggccgctttgccagctttgaggcccagggcgccctggccaacattgctgtggacaaggccaacctggagatcatgaccaagaggagcaactacacccccatcaccaacgtgcccccagaggtgacagtgctgaccaacagccctgtggagctgcgggagcccaacgtgctgatctgcttcatcgacaagttcaccccacctgtggtgaatgtgacctggctgagaaatggcaagcctgtgaccaccggggtgtctgaaacagtgttcctgccccgggaggaccacctgttcaggaagttccactacctgcccttcctgcccagcacagaagatgtgtatgactgccgggtggagcactggggcctggatgagcccctgctgaagcactgggagtttgatgcccccagccccctgcctgagaccacagaaaatgtggtgtgtgccctgggcctgactgtgggcctggtgggcatcatcatcggcaccatcttcatcatcaagggcgtgaggaagagcaatgctgctgagcggcggggccccctgtag

SEQ ID NO: 35628 - DNA, 498 bp, Artificial Sequence
  Description of Artificial Sequence: Synthetic coding sequence
atggccaagaaggagaccgtgtggaggctggaggagtttggccgctttgccagctttgaggcccagggcgccctggccaacattgctgtggacaaggccaacctggagatcatgaccaagaggagcaactacacccccatcaccaacgtgcccccagaggtgacagtgctgaccaacagccctgtggagctgcgggagcccaacgtgctgatctgcttcatcgacaagttcaccccacctgtggtgaatgtgacctggctgagaaatggcaagcctgtgaccactggagtgtctgagaccgtcttcctgagcatcgccttcagctgcatctacttccccctcttccccatcatcctgctgagcccctgcaatgccagcggcatcaagcacactggagtgtgcctgtgctacggcatgcctcatggagccagcctggtgtacctgctcttcaaggtgagcagcaactgtgacttcagcgagcacaacaagctgttctag

SEQ ID NO: 35629 - DNA, 453 bp, Artificial Sequence
  Description of Artificial Sequence: Synthetic coding sequence
atggccatcagcggcgtgcctgtgctgggcttcttcatcatcgctgtgctgatgtctgcccaggagagctgggccatcaaggaggagcacgtgatcatccaggccgagttctacctgaacccagaccagagcggggagttcatgtttgattttgatggagatgagatcttccacgtggacatggccaagaaggagaccgtgtggaggctggaggagtttggccgctttgccagctttgaggcccagggcgccctggccaacattgctgtggacaaggccaacctggagatcatgaccaagaggagcaactacacccccatcaccaacgtgcccccagaggtgacagtgctgaccaacagccctgtggagctgcgggagcccaacgtgctgatctgcttcatcatcaagggcgtgaggaagagcaatgctgctgagcggcggggccccctgtag

SEQ ID NO: 35630 - DNA, 543 bp, Artificial Sequence
  Description of Artificial Sequence: Synthetic coding sequence
atggccatcagcggcgtgcctgtgctgggcttcttcatcatcgctgtgctgatgtctgcccaggagagctgggccatcaaggaggagcacgtgatcatccaggccgagttctacctgaacccagaccagagcggggagttcatgtttgattttgatggagatgagatcttccacgtggacatggccaagaaggagaccgtgtggaggctggaggagtttggccgctttgccagctttgaggcccagggcgccctggccaacattgctgtggacaaggccaacctggagatcatgaccaagaggagcaagcccagcccccgggactaccgggagcggggcgtgtgccccggccctgactgtggcagcggcggccaccactactgggaccacctgcaccaccagggcagcgcccagaagcagtgcagcaggacccagggcgcctctgtgcgccacatggaggtgatggtgttcctgcgggagaagatcacagaggagaccagcgccctgatgaccctgcagagctggcagtactacaacccctag

SEQ ID NO: 35631 - DNA, 543 bp, Artificial Sequence; identical to SEQ ID NO: 35630
  Description of Artificial Sequence: Synthetic coding sequence

SEQ ID NO: 35632 - DNA, 498 bp, Artificial Sequence; identical to SEQ ID NO: 35628
  Description of Artificial Sequence: Synthetic coding sequence

SEQ ID NO: 35633 - DNA, 543 bp, Artificial Sequence; identical to SEQ ID NO: 35630
  Description of Artificial Sequence: Synthetic coding sequence

SEQ ID NO: 35634 - DNA, 498 bp, Artificial Sequence; identical to SEQ ID NO: 35628
  Description of Artificial Sequence: Synthetic coding sequence

SEQ ID NO: 35635 - DNA, 714 bp, Artificial Sequence; identical to SEQ ID NO: 35627
  Description of Artificial Sequence: Synthetic coding sequence

SEQ ID NO: 35636 - DNA, 543 bp, Artificial Sequence; identical to SEQ ID NO: 35630
  Description of Artificial Sequence: Synthetic coding sequence

SEQ ID NO: 35637 - DNA, 498 bp, Artificial Sequence; identical to SEQ ID NO: 35628
  Description of Artificial Sequence: Synthetic coding sequence

SEQ ID NO: 35638 - DNA, 498 bp, Artificial Sequence; identical to SEQ ID NO: 35628
  Description of Artificial Sequence: Synthetic coding sequence

SEQ ID NO: 35639 - DNA, 714 bp, Artificial Sequence; identical to SEQ ID NO: 35627
  Description of Artificial Sequence: Synthetic coding sequence

SEQ ID NO: 35640 - DNA, 543 bp, Artificial Sequence
  Description of Artificial Sequence: Synthetic coding sequence
atggccatcagcggcgtgcctgtgctgggcttcttcatcatcgctgtgctgatgtctgcccaggagagctgggccatcaaggaggagcacgtgatcatccaggccgagttctacctgaacccagaccagagcggggagttcatgtttgattttgatggagatgagatcttccacgtggacatggccaagaaggagaccgtgtggaggctggaggagtttggccgctttgccagctttgaggcccagggcgccctggccaacattgctgtggacaaggccaacctggagatcatgaccaagaggagcaagcccagcccccgggactacagagaatgtggggtgtgccccggccctgactgtggcagcggcggccaccactactgggaccacctgcaccaccagggcagcgcccagaagcagtgcagcaggacccagggcgcctctgtgcgccacatggaggtgatgatgttcctgcgggagaagatcacagaggagaccagcgccctgatgaccctgcagagctggcagtactacaacccctag

SEQ ID NO: 35641 - DNA, 498 bp, Artificial Sequence; identical to SEQ ID NO: 35628
  Description of Artificial Sequence: Synthetic coding sequence

SEQ ID NO: 35642 - DNA, 714 bp, Artificial Sequence; identical to SEQ ID NO: 35627
  Description of Artificial Sequence: Synthetic coding sequence

SEQ ID NO: 35643 - DNA, 801 bp, Artificial Sequence
  Description of Artificial Sequence: Synthetic coding sequence
atggtgtgcctgaagctgcccggcggcagctgcatggccgccctgactgtgaccctgactgtgctgagcagccccctggccctggccggggacacccagccccgcttcctggagcaggccaagtgtgagtgccacttcctgaatggaacagagcgggtgtggaacctgatccgctacatctacaaccaggaggagtatgcccgctacaacagcgacctgggggagtaccaggccgtgacagagctgggccgcccagatgctgagtactggaacagccagaaggacctgctggagcggcggcgggcagaggtggacacctactgccgctacaactacggcgtggtggagagcttcaccgtgcagaggagagtgcagcccaaggtgacagtgtaccccagcaagacccagcccctgcagcaccacaacctgctggtgtgcagcgtgaatggcttctacccaggcagcattgaggtgcgctggttcagaaatggccaggaggagaaggccggcgtggtgtccacaggcctcatccagaatggagactggaccttccagaccctggtgatgctggagaccgtgcccaggtctggagaggtgtacacctgccaggtggagcaccccagcatgatgagccccctgactgtgcagtggagcgcccggtctgagagcgcccagagcaagatgctgagcggcgtgggcggctttgtgctgggcctgctcttcctgggcaccggcctcttcatctacttcaggaaccagaagggccacagcggcctgcagcccaccggcctgctgtcctag

SEQ ID NO: 35644 - DNA, 801 bp, Artificial Sequence
  Description of Artificial Sequence: Synthetic coding sequence
atggtgtgcctgaagctgcccggcggcagctgcatggccgccctgactgtgaccctgactgtgctgagcagccccctggccctggccggggacacccagccccgcttcctggagcaggccaagtgtgagtgccacttcctgaatggaacagagcgggtgtggaacctgatccgctacatctacaaccaggaggagtatgcccgctacaacagcgacctgggggagtaccaggccgtgacagagctgggccgcccagatgctgagtactggaacagccagaaggacctgctggagcggcggcgggcagaggtggacacctactgccgctacaactacggcgtggtggagagcttcaccgtgcagaggagagtgcagcccaaggtgacagtgtaccccagcaagacccagcccctgcagcaccacaacctgctggtgtgcagcgtgaatggcttctacccaggcagcattgaggtgcgctggttcaggaacagccaggaggagaaggccggcgtggtgtccacaggcctcatccagaatggagactggaccttccagaccctggtgatgctggagaccgtgcccaggtctggagaggtgtacacctgccaggtggagcaccccagcatgatgagccccctgactgtgcagtggagcgcccggtctgagagcgcccagagcaagatgctgagcggcgtgggcggctttgtgctgggcctgctcttcctgggcaccggcctcttcatctacttcaggaaccagaagggccacagcggcctgcagcccaccggcctgctgtcctag

SEQ ID NO: 35645 - DNA, 801 bp, Artificial Sequence; identical to SEQ ID NO: 35643
  Description of Artificial Sequence: Synthetic coding sequence

SEQ ID NO: 35646 - DNA, 1173 bp, Artificial Sequence
  Description of Artificial Sequence: Synthetic coding sequence
atgtctgtgcgggtggcccgggtggcctgggtgcggggcctgggcgccagctacagaagaggagccagcagcttccctgtgcccccacctggggcccagggcgtggccgagctgctgagagatgccactggagctgaggaggaggccccctgggccgccacagagaggaggatgcctggccagtgcagcgtgctgctcttccctggccagggcagccaggtggtgggcatgggccggggcctgctgaactacccccgggtgcgggagctgtatgctgctgccaggagagtgctgggctatgacctgctggagctgagcctgcacggcccccaggagaccctggacagaacagtgcactgccagcctgccatctttgtggccagcctggccgctgtggagaagctgcaccacctgcagcccagcgtgattgagaactgtgtggccgccgccggcttctctgtgggggagtttgctgccctggtgtttgctggggccatggagtttgctgagggcctgtatgctgtgaagatccgggcagaggccatgcaggaggccagcgaggccgtgcccagcggcatgctgtctgtgctgggccagccccagagcaagttcaactttgcctgcctggaggcccgggagcactgcaagagcctgggcattgaaaatcctgtgtgtgaggtgagcaactacctgttcccagactgcagggtcatcagcggccaccaggaggccctgcgcttcctgcagaagaacagcagcaagttccacttccggaggaccaggatgctgcctgtgtctggggccttccacacccggctgatggagcctgctgtggagcccctgacccaggccctgaaggctgtggacatcaagaagcccctggtgtctgtgtacagcaatgtgcacgcccaccgctaccgccaccctggccacatccacaagctgctggcccagcagctggtgtcccctgtgaagtgggagcagaccatgcacgccatctatgaaaggaagaagggccggggcttcccccagacctttgaggtgggccctggccggcagctgggcgccatcctgaagagctgcaacatgcaggcctggaagagctacagcgctgtggatgtgctgcagaccctggagcacgtggacctggacccccaggagccccccaggtag

SEQ ID NO: 35647 - DNA, 543 bp, Artificial Sequence
  Description of Artificial Sequence: Synthetic coding sequence
atgtctgtgcgggtggcccgggtggcctgggtgcggggcctgggcgccagctacagaagaggagccagcagcttccctgtgcccccacctggggcccagggcgtggccgagctgctgagagatgccactggagctgaggaggaggccccctgggccgccacagagaggaggatgcctggccagtgcagcgtgctgctcttccctggccagggcagccaggtggtgggcatgggccggggcctgctgaactacccccgggtgcgggagctgtatgctgctgccaggagagtgctgggctatgacctgctggagctgagcctgcacggcccccaggagaccctggacagaacagtgcactgccagcctgccatctttgtggccagcctggccgctgtggagaagctgcaccacctgcagcccagcgtgattgagaactgtgtggccgccgccggcttctctgtgggggagtttgctgccctggtgtttgctggggccatggagtttgctgagggcagcacagtgtccccagaggagttcctgtag

SEQ ID NO: 35648 - DNA, 3414 bp, Artificial Sequence
  Description of Artificial Sequence: Synthetic coding sequence
atgcccctgagcagccacctgctgcctgccctggtgctcttcctggccggcagcagcggctgggcctgggtgcccaaccactgccgcagccctggccaggccgtgtgcaactttgtgtgtgactgccgggactgcagtgatgaggcccagtgtggctaccacggggccagccccaccctgggcgccccctttgcctgtgactttgagcaggacccctgtggctggagggacatcagcaccagcggctacagctggctgcgggaccgggccggggccgccctggagggccctggcccccacagcgaccacaccctgggcacagacctgggctggtacatggctgtgggcacccaccggggcaaggaggccagcacagctgccctgcggagccccaccctgcgggaggccgccagcagctgcaagctgcggctgtggtaccacgccgccagcggagatgtggccgagctgcgggtggagctgacccacggggctgagaccctgaccctgtggcagagcacaggcccctggggccctggctggcaggagctggccgtgaccaccggccgcatccggggggacttccgggtgaccttcagcgccaccagaaatgccacccacagaggagctgtggccctggatgacctggagttctgggactgtggcctgcccaccccccaggccaactgccccccaggccaccaccactgccagaacaaggtgtgtgtggagccccagcagctgtgtgatggagaggacaactgtggggacctgagtgatgagaaccccctgacctgtggccgccacatcgccacagactttgaaacaggcctgggcccctggaacagaagtgagggctggagcaggaaccaccgggccggcggccctgagcggcccagctggccccggcgggaccacagcagaaattctgcccagggcagcttcctggtgtctgtggccgagcccggcaccccagccatcctgagcagccctgagttccaggccagcggcaccagcaactgcagcctggtgttctaccagtacctgagcggcagcgaggccggctgcctgcagctgttcctgcagaccctgggccctggggccccccgggcccctgtgctgctgcggaggagaagaggagagctgggcacagcctgggtgcgggacagagtggacatccagagcgcctaccccttccagatcctgctggccggccagacaggccctgggggcgtggtgggcctggatgacctgatcctgagtgaccactgcaggcctgtgtctgaggtgtccaccctgcagcccctgcccccaggcccccgggccccagccccccagcccctgccccccagcagccggctgcaggacagctgcaagcagggccacctggcctgtggggacctgtgtgtgcccccagagcagctgtgtgactttgaggagcagtgtgctggaggagaagatgagcaggcctgtggcaccacagactttgagagccctgaggccggcggctgggaggatgcctctgtgggccgcctgcagtggaggagagtgtctgcccaggagagccagggcagcagcgctgctgctgctggccacttcctgagcctgcagagggcctggggccagctgggcgctgaggcccgggtgctgacccccctgctgggccccagcggccccagctgtgagctgcacctggcctactacctgcagagccagccccgggaggtgtcctgcaactttgagcgggacacctgctcctggtacccaggccacctgagtgacacccactggcgctgggtggagagccggggccctgaccatgaccacaccaccggccagggccactttgtgctgctggaccccacagaccccctggcctggggccacagcgcccacctgctgagccggccccaggtgcctgctgcccccacagagtgcctgtccttctggtaccacctgcacggcccccagatcggcaccctgcggctggccatgagaagagaaggagaggagacccacctgtggagccgcagcggcacccagggcaaccgctggcatgaggcctgggccaccctgagccaccagcccggcagccacgcccagtaccagctgctgtttgagggcctgagagatggctaccacggcaccatggccctggatgatgtggccgtgcggcccggcccctgctgggcccccaactactgcagctttgaagattctgactgtggcttcagccctgggggccagggcctgtggaggcggcaggccaatgccagcggccatgctgcctggggccccccaacagaccacaccacagaaacagcccagggccactacatggtggtggacaccagcccagatgccctgccccggggccagacagccagcctgaccagcaaggagcaccggcccctggcccagcctgcctgcctgaccttctggtaccacggcagcctgcggagccctggcaccctgcgggtgtacctggaggagcggggccgccaccaggtgctgagcctgagcgcccacggcggcctggcctggaggctgggctccatggatgtgcaggccgagcgggcctggagggtggtgtttgaggccgtggccgccggcgtggcccacagctatgtggccctggatgacctgctgctgcaggacggcccctgcccccagcccggcagctgtgactttgagagcggcctgtgtggctggagccacctggcctggccaggcctgggcggctacagctgggactggggcggcggggccacccccagccgctacccccagccccctgtggaccacaccctgggcacagaggccggccactttgccttctttgagaccggggtgctgggccctgggggccgggccgcctggctgcggtctgagcccctgcctgccaccccagccagctgcctgcgcttctggtaccacatgggcttccctgagcacttctacaagggggagctgaaggtgctgctgcacagcgcccagggccagctggccgtgtggggcgctgggggccaccggcggcaccagtggctggaggcccaggtggaggtggccagcgccaaggagttccagatcgtgtttgaggccaccctgggcggccagcctgccctgggccccatcgccctggatgatgtggagtacctggccggccagcactgccagcagcctgcccccagccctggcaacacagctgcccctggctctgtgcctgctgtggtgggcagcgccctgctgctgctgatgctgctggtgctgctgggcctgggcggccgccgctggctgcagaagaagggcagctgccccttccagagcaacacagaggccacagcccctggctttgacaacatcctcttcaatgctgatggagtgaccctgcctgcctctgtgaccagtgacccctag

SEQ ID NO: 35649 - DNA, 3609 bp, Artificial Sequence
  Description of Artificial Sequence: Synthetic coding sequence
tgaggctgggcctgggtgcccaaccactgccgcagccctggccaggccgtgtgcaactttgtgtgtgactgccgggactgcagtgatgaggcccagtgtggctaccacggggccagccccaccctgggcgccccctttgcctgtgactttgagcaggacccctgtggctggagggacatcagcaccagcggctacagctggctgcgggaccgggccggggccgccctggagggccctggcccccacagcgaccacaccctgggcacagacctgggctggtacatggctgtgggcacccaccggggcaaggaggccagcacagctgccctgcggagccccaccctgcgggaggccgccagcagctgcaagctgcggctgtggtaccacgccgccagcggagatgtggccgagctgcgggtggagctgacccacggggctgagaccctgaccctgtggcagagcacaggcccctggggccctggctggcaggagctggccgtgaccaccggccgcatccggggggacttccgggtgaccttcagcgccaccagaaatgccacccacagaggagctgtggccctggatgacctggagttctgggactgtggcctgcccaccccccaggccaactgccccccaggccaccaccactgccagaacaaggtgtgtgtggagccccagcagctgtgtgatggagaggacaactgtggggacctgagtgatgagaaccccctgacctgtggccgccacatcgccacagactttgaaacaggcctgggcccctggaacagaagtgagggctggagcaggaaccaccgggccggcggccctgagcggcccagctggccccggcgggaccacagcagaaattctgcccagggcagcttcctggtgtctgtggccgagcccggcaccccagccatcctgagcagccctgagttccaggccagcggcaccagcaactgcagcctggtgttctaccagtacctgagcggcagcgaggccggctgcctgcagctgttcctgcagaccctgggccctggggccccccgggcccctgtgctgctgcggaggagaagaggagagctgggcacagcctgggtgcgggacagagtggacatccagagcgcctaccccttccagatcctgctggccggccagacaggccctgggggcgtggtgggcctggatgacctgatcctgagtgaccactgcaggcctgtgtctgaggtgtccaccctgcagcccctgcccccaggcccccgggccccagccccccagcccctgccccccagcagccggctgcaggacagctgcaagcagggccacctggcctgtggggacctgtgtgtgcccccagagcagctgtgtgactttgaggagcagtgtgctggaggagaagatgagcaggcctgtggcaccacagactttgagagccctgaggccggcggctgggaggatgcctctgtgggccgcctgcagtggaggagagtgtctgcccaggagagccagggcagcagcgctgctgctgctggggaggcccagggccacttcctgagcctgcagagggcctggggccagctgggcgctgaggcccgggtgctgacccccctgctgggccccagcggccccagctgtgagctgcacctggcctactacctgcagagccagccccggggcttcctggccctggtggtggtggacaatggcagccgggagctggcctggcaggccctgagcagcagcgctggcatctggaaggtggacaaggtgctgctgggcgccaggagaagacccttccggctggagtttgtgggcctggtggacctggatggccctgaccagcagggcgctggggtggacaacgtgaccctgcgggactgcagccccaccgtgaccacagagcgggaccgggaggtgtcctgcaactttgagcgggacacctgctcctggtacccaggccacctgagtgacacccactggcgctgggtggagagccggggccctgaccatgaccacaccaccggccagggccactttgtgctgctggaccccacagaccccctggcctggggccacagcgcccacctgctgagccggccccaggtgcctgctgcccccacagaatgtctgtccttctggtaccacctgcacggcccccagatcggcaccctgcggctggccatgaggcgggagggggaggagacccacctgtggagccgcagcggcacccagggcaaccgctggcatgaggcctgggccaccctgagccaccagcccggcagccacgcccagtaccagctgctgtttgagggcctgagagatggctaccacggcaccatggccctggatgatgtggccgtgcggcccggcccctgctgggcccccaactactgcagctttgaggacagcgactgtggcttcagccctgggggccagggcctgtggaggcggcaggccaatgccagcggccacgccgcctggggccccccaacagaccacaccacagaaacagcccagggccactacatggtggtggacaccagcccagatgccctgccccggggccagacagccagcctgaccagcaaggagcaccggcccctggcccagcctgcctgcctgaccttctggtaccacggcagcctgcggagccctggcaccctgcgggtgtacctggaggagcggggccgccaccaggtgctgagcctgagcgcccatggaggcctggcctggaggctgggctccatggatgtgcaggccgagcgggcctggagggtggtgtttgaagctgtggccgccggcgtggcccacagctatgtggccctggatgacctgctgctgcaggacggcccctgcccccagcccggcagctgtgactttgaaagtggcctgtgtggctggagccacctggcctggccaggcctgggcggctacagctgggactggggcggcggggccacccccagccgctacccccagccccctgtggaccacaccctgggcacagaagctggccactttgccttctttgaaacaggagtgctgggccctgggggccgggccgcctggctgcggtctgagcccctgcctgccaccccagccagctgcctgcgcttctggtaccacatgggcttccctgagcacttctacaagggggagctgaaggtgctgctgcacagcgcccagggccagctggccgtgtggggcgccggcggccacagaagacaccagtggctggaggcccaggtggaggtggccagcgccaaggagttccagatcgtgtttgaggccaccctgggcggccagcctgccctgggccccatcgccctggatgatgtggagtacctggccggccagcactgccagcagcctgcccccagccctggcaacacagctgcccctggctctgtgcctgctgtggtgggcagcgccctgctgctgctgatgctgctggtgctgctgggcctgggcggccgccgctggctgcagaagaagggcagctgccccttccagagcaacacagaggccacagcccctggctttgacaacatcctcttcaatgctgatggagtgaccctgcctgcctctgtgaccagtgacccctag

SEQ ID NO: 35650 - DNA, 3651 bp, Artificial Sequence
  Description of Artificial Sequence: Synthetic coding sequence
atgcccctgagcagccacctgctgcctgccctggtgctcttcctggccggcagcagcggctgggcctgggtgcccaaccactgccgcagccctggccaggccgtgtgcaactttgtgtgtgactgccgggactgcagtgatgaggcccagtgtggctaccacggggccagccccaccctgggcgccccctttgcctgtgactttgagcaggacccctgtggctggagggacatcagcaccagcggctacagctggctgcgggaccgggccggggccgccctggagggccctggcccccacagcgaccacaccctgggcacagacctgggctggtacatggctgtgggcacccaccggggcaaggaggccagcacagctgccctgcggagccccaccctgcgggaggccgccagcagctgcaagctgcggctgtggtaccacgccgccagcggagatgtggccgagctgcgggtggagctgacccacggggctgagaccctgaccctgtggcagagcacaggcccctggggccctggctggcaggagctggccgtgaccaccggccgcatccggggggacttccgggtgaccttcagcgccaccagaaatgccacccacagaggagctgtggccctggatgacctggagttctgggactgtggcctgcccaccccccaggccaactgccccccaggccaccaccactgccagaacaaggtgtgtgtggagccccagcagctgtgtgatggagaggacaactgtggggacctgagtgatgagaaccccctgacctgtggccgccacatcgccacagactttgaaacaggcctgggcccctggaacagaagtgagggctggagcaggaaccaccgggccggcggccctgagcggcccagctggccccggcgggaccacagcagaaattctgcccagggcagcttcctggtgtctgtggccgagcccggcaccccagccatcctgagcagccctgagttccaggccagcggcaccagcaactgcagcctggtgttctaccagtacctgagcggcagcgaggccggctgcctgcagctgttcctgcagaccctgggccctggggccccccgggcccctgtgctgctgcggaggagaagaggagagctgggcacagcctgggtgcgggacagagtggacatccagagcgcctaccccttccagatcctgctggccggccagacaggccctgggggcgtggtgggcctggatgacctgatcctgagtgaccactgcaggcctgtgtctgaggtgtccaccctgcagcccctgcccccaggcccccgggccccagccccccagcccctgccccccagcagccggctgcaggacagctgcaagcagggccacctggcctgtggggacctgtgtgtgcccccagagcagctgtgtgactttgaggagcagtgtgctggaggagaagatgagcaggcctgtggcaccacagactttgagagccctgaggccggcggctgggaggatgcctctgtgggccgcctgcagtggaggagagtgtctgcccaggagagccagggcagcagcgctgctgctgctggccacttcctgagcctgcagagggcctggggccagctgggcgctgaggcccgggtgctgacccccctgctgggccccagcggccccagctgtgagctgcacctggcctactacctgcagagccagccccggggcttcctggccctggtggtggtggacaatggcagccgggagctggcctggcaggccctgagcagcagcgctggcatctggaaggtggacaaggtgctgctgggcgccaggagaagacccttccggctggagtttgtgggcctggtggacctggatggccctgaccagcagggcgctggggtggacaacgtgaccctgcgggactgcagccccaccgtgaccacagagcgggaccgggaggtgtcctgcaactttgagcgggacacctgctcctggtacccaggccacctgagtgacacccactggcgctgggtggagagccggggccctgaccatgaccacaccaccggccagggccactttgtgctgctggaccccacagaccccctggcctggggccacagcgcccacctgctgagccggccccaggtgcctgctgcccccacagaatgtctgtccttctggtaccacctgcacggcccccagatcggcaccctgcggctggccatgaggcgggagggggaggagacccacctgtggagccgcagcggcacccagggcaaccgctggcatgaggcctgggccaccctgagccaccagcccggcagccacgcccagtaccagctgctgtttgagggcctgagagatggctaccacggcaccatggccctggatgatgtggccgtgcggcccggcccctgctgggcccccaactactgcagctttgaggacagcgactgtggcttcagccctgggggccagggcctgtggaggcggcaggccaatgccagcggccacgccgcctggggccccccaacagaccacaccacagaaacagcccagggccactacatggtggtggacaccagcccagatgccctgccccggggccagacagccagcctgaccagcaaggagcaccggcccctggcccagcctgcctgcctgaccttctggtaccacggcagcctgcggagccctggcaccctgcgggtgtacctggaggagcggggccgccaccaggtgctgagcctgagcgcccatggaggcctggcctggaggctgggctccatggatgtgcaggccgagcgggcctggagggtggtgtttgaagctgtggccgccggcgtggcccacagctatgtggccctggatgacctgctgctgcaggacggcccctgcccccagcccggcagctgtgactttgaaagtggcctgtgtggctggagccacctggcctggccaggcctgggcggctacagctgggactggggcggcggggccacccccagccgctacccccagccccctgtggaccacaccctgggcacagaagctggccactttgccttctttgaaacaggagtgctgggccctgggggccgggccgcctggctgcggtctgagcccctgcctgccaccccagccagctgcctgcgcttctggtaccacatgggcttccctgagcacttctacaagggggagctgaaggtgctgctgcacagcgcccagggccagctggccgtgtggggcgccggcggccacagaagacaccagtggctggaggcccaggtggaggtggccagcgccaaggagttccagatcgtgtttgaggccaccctgggcggccagcctgccctgggccccatcgccctggatgatgtggagtacctggccggccagcactgccagcagcctgcccccagccctggcaacacagctgcccctggctctgtgcctgctgtggtgggcagcgccctgctgctgctgatgctgctggtgctgctgggcctgggcggccgccgctggctgcagaagaagggcagctgccccttccagagcaacacagaggccacagcccctggctttgacaacatcctcttcaatgctgatggagtgaccctgcctgcctctgtgaccagtgacccctag

SEQ ID NO: 35651 - DNA, 1353 bp, Artificial Sequence
  Description of Artificial Sequence: Synthetic coding sequence
atgatgcagtttgcctggcagagctacaagagatatgccatgggcaagaatgagctgcggcccctgaccaaggatggctatgagggcaacatgtttggaggcctgagcggggccaccgtgattgacagcctggacaccctgtacctgatggagctgaaggaggagttccaggaggccaaggcctgggtgggggagagcttccacctgaatgtgtctggagaggccagcctgtttgaggtgaacatccgctacatcggcggcctgctgagcgccttctacctgactggagaggaggtgttccgcatcaaggccatccggctgggggagaagctgctgcctgccttcaacacccccaccggcatccccaagggcgtggtgtccttcaagagcggcaactggggctgggccacagctggcagcagcagcatcctggccgagtttggcagcctgcacctggagttcctgcacctgacagagctgagcggcaaccaggtgtttgctgagaaggtgaggaacatcaggaaggtgctgaggaagattgagaagcccttcggcctgtaccccaacttcctgagccctgtgtctggcaactgggtgcagcaccacgtgtctgtgggcggcctgggggacagcttctatgagtacctgatcaagtcctggctgatgtctgggaagacagacatggaggccaagaacatgtactatgaggccctggaggccatcgagacctacctgctgaatgtgtcccctgggggcctgacctacatcgccgagtggaggggcggcatcctggaccacaagatgggccacctggcctgcttcagcggcggcatgattgccctgggcgcagaagatgccaaggaggagaagagggcccactaccgggagctggccgcccagatcaccaagacctgccacgagagctatgcccggagtgacaccaagctgggccctgaggccttctggttcaacagcggccgggaggccgtggccacccagctgtctgagagctactacatcctgcggcctgaggtggtggagagctacatgtacctgtggaggcagacccacaaccccatctaccgggagtggggctgggaggtggtgctggccctggagaagtactgcaggacagaggccggcttcagcggcatccaggatgtgtacagcagcacccccaaccacgacaacaagcagcagagcttcttcctggccgagaccctgaagtacctgtacctgctcttctctgaagatgacctgctgagcctggaggactgggtgttcaacacagaggcccaccccctgcctgtgaaccacagcgacagcagcggccgggcctggggccgccactag

SEQ ID NO: 35652 - DNA, 1206 bp, Artificial Sequence
  Description of Artificial Sequence: Synthetic coding sequence
atggagctgaaggaggagttccaggaggccaaggcctgggtgggggagagcttccacctgaatgtgtctggagaggccagcctgtttgaggtgaacatccgctacatcggcggcctgctgagcgccttctacctgaccggggaggaggtgttccgcatcaaggccatccggctgggggagaagctgctgcctgccttcaacacccccaccggcatccccaagggcgtggtgtccttcaagagcggcaactggggctgggccacagctggcagcagcagcatcctggccgagtttggcagcctgcacctggagttcctgcacctgacagagctgagcggcaaccaggtgtttgctgagaaggtgaggaacatcaggaaggtgctgaggaagattgagaagcccttcggcctgtaccccaacttcctgagccctgtgtctggcaactgggtgcagcaccacgtgtctgtgggcggcctgggggacagcttctatgagtacctgatcaagtcctggctgatgtctgggaagacagacatggaggccaagaacatgtactatgaggccctggaggccatcgagacctacctgctgaatgtgtccccaggcggcctgacctacatcgccgagtggaggggcggcatcctggaccacaagatgggccacctggcctgcttcagcggcggcatgattgccctgggcgcagaagatgccaaggaggagaagagggcccactaccgggagctggccgcccagatcaccaagacctgccacgagagctatgcccggagtgacaccaagctgggccctgaggccttctggttcaacagcggccgggaggccgtggccacccagctgtctgagagctactacatcctgcggcctgaggtggtggagagctacatgtacctgtggaggcagacccacaaccccatctaccgggagtggggctgggaggtggtgctggccctggagaagtactgcaggacagaagctggcttcagcggcatccaggatgtgtacagcagcacccccaaccacgacaacaagcagcagagcttcttcctggccgagaccctgaagtacctgtacctgctcttctctgaagatgacctgctgagcctggaggactgggtgttcaacacagaggcccaccccctgcctgtgaaccacagcgacagcagcggccgggcctggggccgccactag

SEQ ID NO: 35653 - DNA, 1170 bp, Artificial Sequence
  Description of Artificial Sequence: Synthetic coding sequence
atgatgcagtttgcctggcagagctacaagagatatgccatgggcaagaatgagctgcggcccctgaccaaggatggctatgagggcaacatgtttggaggcctgagcggggccaccgtgattgacagcctggacaccctgtacctgatggagctgaaggaggagttccaggaggccaaggcctgggtgggggagagcttccacctgaatgtgtctggagaggccagcctgtttgaggtgaacatccgctacatcggcggcctgctgagcgccttctacctgactggagaggaggtgttccgcatcaaggccatccggctgggggagaagctgctgcctgccttcaacacccccaccggcatccccaagggcgtggtgtccttcaagagcggcaactggggctgggccacagctggcagcagcagcatcctggccgagtttggcagcctgcacctggagttcctgcacctgacagagctgagcggcaaccaggtgtttgctgagaaggtgaggaacatcaggaaggtgctgaggaagattgagaagcccttcggcctgtaccccaacttcctgagccctgtgtctggcaactgggtgcagcaccacgtgtctgtgggcggcctgggggacagcttctatgagtacctgatcaagtcctggctgatgtctgggaagacagacatggaggccaagaacatgtactatgaggccctggaggccatcgagacctacctgctgaatgtgtcccctgggggcctgacctacatcgccgagtggaggggcggcatcctggaccacaagatgggccacctggcctgcttcagcggcggcatgattgccctgggcgcagaagatgccaaggaggagaagagggcccactaccgggagctggccgcccagatcaccaagacctgccacgagagctatgcccggagtgacaccaagctgggccctgaggccttctggttcaacagcggccgggaggccgtggccacccagctgtctgagagctactacatcctgcggcctgaggtggtggagagctacatgtacctgtggaggcagacccacaaccccatctaccgggagtggggctgggagggcgccggcctgggggagatcctgagtgacaggagccgcttcctgtgggacccccggcgggtgcagtag

SEQ ID NO: 35654 - DNA, 1893 bp, Artificial Sequence
  Description of Artificial Sequence: Synthetic coding sequence
atgctgatgaggaaggtgcccggctttgtgcctgccagcccctggggcctgcggctgccccagaagttcctgttcctgctcttcctgagcggcctggtgaccctgtgctttggagccctcttcctgctgccccacagcagccggctgaagaggctcttcctggcccccaggacccagcagcccggcctggaggtggtggccgagattgctggccacgccccagcccgggagcaggagcccccacccaacccagccccagctgccccagcccctggagaagatgaccccagctcctgggccagccccaggaggaggaagggcggcctgcggaggacccggcccaccggcccccgggaggaggccacagctgcccggggcaacagcatcccagccagcaggcctggagatgagggcgtgcccttccgctttgacttcaatgccttccgcagccggctgcggcaccctgtgctgggcaccagggcagatgagagccaggagccccagagccaggtgcgggcccagcgggagaagatcaaggagatgatgcagtttgcctggcagagctacaagagatatgccatgggcaagaatgagctgcggcccctgaccaaggatggctatgagggcaacatgtttggaggcctgagcggggccaccgtgattgacagcctggacaccctgtacctgatggagctgaaggaggagttccaggaggccaaggcctgggtgggggagagcttccacctgaatgtgtctggagaggccagcctgtttgaggtgaacatccgctacatcggcggcctgctgagcgccttctacctgactggagaggaggtgttccgcatcaaggccatccggctgggggagaagctgctgcctgccttcaacacccccaccggcatccccaagggcgtggtgtccttcaagagcggcaactggggctgggccacagctggcagcagcagcatcctggccgagtttggcagcctgcacctggagttcctgcacctgacagagctgagcggcaaccaggtgtttgctgagaaggtgaggaacatcaggaaggtgctgaggaagattgagaagcccttcggcctgtaccccaacttcctgagccctgtgtctggcaactgggtgcagcaccacgtgtctgtgggcggcctgggggacagcttctatgagtacctgatcaagtcctggctgatgtctgggaagacagacatggaggccaagaacatgtactatgaggccctggaggccatcgagacctacctgctgaatgtgtcccctgggggcctgacctacatcgccgagtggaggggcggcatcctggaccacaagatgggccacctggcctgcttcagcggcggcatgattgccctgggcgcagaagatgccaaggaggagaagagggcccactaccgggagctggccgcccagatcaccaagacctgccacgagagctatgcccggagtgacaccaagctgggccctgaggccttctggttcaacagcggccgggaggccgtggccacccagctgtctgagagctactacatcctgcggcctgaggtggtggagagctacatgtacctgtggaggcagacccacaaccccatctaccgggagtggggctgggaggtggtgctggccctggagaagtactgcaggacagaggccggcttcagcggcatccaggatgtgtacagcagcacccccaaccacgacaacaagcagcagagcttcttcctggccgagaccctgaagtacctgtacctgctcttctctgaagatgacctgctgagcctggaggactgggtgttcaacacagaggcccaccccctgcctgtgaaccacagcgacagcagcggccgggcctggggccgccactag

SEQ ID NO: 35655 - DNA, 258 bp, Artificial Sequence
  Description of Artificial Sequence: Synthetic coding sequence
atggccagtgacctggacttcagccccccagaggtgcctgagcccaccttcctggagaacctgctgcgctatggcctcttcctgggcgccatcttccagctgatctgtgtgctggccatcatcgtgcccatccccaagagccatgaggccgaggccgagcccagcgagcccaggtctgctgaggtgaccaggaagcccaaggctgctgtgcccagcgtgaacaagaggcccaagaaggagaccaagaagaagaggtag

SEQ ID NO: 35656 - DNA, 258 bp, Artificial Sequence; identical to SEQ ID NO: 35655
  Description of Artificial Sequence: Synthetic coding sequence

SEQ ID NO: 35657 - DNA, 171 bp, Artificial Sequence
  Description of Artificial Sequence: Synthetic coding sequence
atggccagtgacctggacttcagccccccagaggtgcctgagcccaccttcctggagaacctgctgcgctatggcctcttcctgggcgccatcttccagctgatctgtgtgctggccatcatcgtgcccatccccaagagccatgaggccgagttccacgtggaggcctag

SEQ ID NO: 35658 - DNA, 258 bp, Artificial Sequence; identical to SEQ ID NO: 35655
  Description of Artificial Sequence: Synthetic coding sequence

SEQ ID NO: 35659 - DNA, 258 bp, Artificial Sequence; identical to SEQ ID NO: 35655
  Description of Artificial Sequence: Synthetic coding sequence

SEQ ID NO: 35660 - DNA, 258 bp, Artificial Sequence; identical to SEQ ID NO: 35655
  Description of Artificial Sequence: Synthetic coding sequence

SEQ ID NO: 35661 - DNA, 708 bp, Artificial Sequence
  Description of Artificial Sequence: Synthetic coding sequence
atgatcaccggcagcccccagatgacctggtgcccccccttctggaccccacccatcagcacagccagccgctatggcagccacggggccttctaccgctacaagaacagcatgggcaagagcctgcccctcttctacatctatgacagctacctgaccagccctgaggcctgggcccacctgctgaccccaaatggcccccacagcatccggaacaccccctatgatggagtcttcatcgccctgctggtggaggagggccacacccatgacatcctggccgccggctttgatggcatgtacacctactttgccagcaatggcttctcctttggcagcagccaccagaactggaaggctgtgaagaacttctgtgatgccaacaacctgatgttcatccccagcgtgggccctggctacatcgacaccagcatccggccctggaacaaccacaacaccaggaacagagtgaatggcaagtactatgaaacagccctgcaggccgccctgactgtgcggcctgagatcgtgtccatcaccagcttcaatgagtggcatgagggcacccagatcgagaaggccatccccaagaagacccccacccggctgtacctggactacctgccccaccagcccagcctgtacctggagctgacccggcgctgggccgagcacttcatcaaggagaaggagcagtggctgatgtag

SEQ ID NO: 35662 - DNA, 1374 bp, Artificial Sequence
  Description of Artificial Sequence: Synthetic coding sequence
atggccaggagaagaagaagagcctgcatcgccctcttcctggtgctgctgtttgccttcggcaccctgatgggcctgcggaccctgaaggccccagatggcctgcctgccctgggccctggcctggagctggccccctttgaaagaagacctgagggcgccccagccccagctgcccgggccccagctgccccagctgcccctcctcctcctcctcctccacccaggacagctgaccccggcggcagccctggccctgccccagctgaggccgagcccgcccctgtgcagagcctgcgggtgtacagcgacctgcacgccttctactacagctggtacggcagcccccggcgggagggccactacatccactgggaccacgtgatggtgccccactgggaccccaagatcagcgccagctacccccggggccgccacagccccccagatgacctgggcagcagcttctacccagagctgggcccctacagcagccgggaccctgaggtgctgcgggagcacatgacccagctgaaggaggccgccatcggcgtgctggtgctgtcctggtacccacctggcatggctgatgacaatggagagcccagtgatgacctggtgcctgccatcctggacacagcccaccagtacagcatccaggtggccttccacatccagccctacaagggcagagatgacatcaccgtgcatgacaacatcaagtacatcatcgacacctacggcagccacggggccttctaccgctacaagaacagcatgggcaagagcctgcccctcttctacatctatgacagctacctgaccagccctgaggcctgggcccacctgctgaccccaaatggcccccacagcatccggaacaccccctatgatggagtcttcatcgccctgctggtggaggagggccacacccatgacatcctggccgccggctttgatggcatgtacacctactttgccagcaatggcttctcctttggcagcagccaccagaactggaaggctgtgaagaacttctgtgatgccaacaacctgatgttcatccccagcgtgggccctggctacatcgacaccagcatccggccctggaacaaccacaacaccaggaacagagtgaatggcaagtactatgaaacagccctgcaggccgccctgactgtgcggcctgagatcgtgtccatcaccagcttcaatgagtggcatgagggcacccagatcgagaaggccatccccaagaagacccccacccggctgtacctggactacctgccccaccagcccagcctgtacctggagctgacccggcgctgggccgagcacttcatcaaggagaaggagcagtggctgatgtag

SEQ ID NO: 35663 - DNA, 753 bp, Artificial Sequence
  Description of Artificial Sequence: Synthetic coding sequence
atggccaggagaagaagaagagcctgcatcgccctcttcctggtgctgctgtttgccttcggcaccctgatgggcctgcggaccctgaaggccccagatggcctgcctgccctgggccctggcctggagctggccccctttgaaagaagacctgagggcgccccagccccagctgcccgggccccagctgccccagctgcccctcctcctcctcctcctccacccaggacagctgaccccggcggcagccctggccctgccccagctgaggccgagcccgcccctgtgcagagcctgcgggtgtacagcgacctgcacgccttctactacagctggtacggcagcccccggcgggagggccactacatccactgggaccacgtgatggtgccccactgggaccccaagatcagcgccagctacccccggggccgccacagccccccagatgacctgggcagcagcttctacccagagctgggcccctacagcagccgggaccctgaggtgctgcgggagcacatgacccagctgaaggaggccgccatcggcgtgctggtgctgtcctggtacccacctggcatggctgatgacaatggagagcccagtgatgacctggtgcctgccatcctggacacagcccaccagtacagcatccaggtggccttccacatccagccctacaagggcagagatgacatcaccgtgcatgacaacatcaagtacatcatcgacaccaccgggaagctgtag

SEQ ID NO: 35664 - DNA, 1437 bp, Artificial Sequence
  Description of Artificial Sequence: Synthetic coding sequence
atgttcaagttccaccagatgaagcacatctttgagatcctggacaagatgcgctgcctgaggaagaggagcacagtgtccttcctgggcgtgctggtgatcttcctgctcttcatgaacctgtacatcgaggacagctatgtgctggagggggacaagcagctgatccgggagaccagcacccaccagctgaacagcgagagatatgtgcacaccttcaaggacctgagcaacttcagcggggccatcaacgtgacctaccgctacctggccgccacccccctgcagaggaagcgctacctgaccatcggcctgagctctgtgaagaggaagaagggcaactacctgctggagaccatcaagagcatctttgagcagagcagctatgaggagctgaaggagatctctgtggtggtgcacctggccgacttcaacagctcctggagagatgccatggtgcaggacatcacccagaagtttgcccaccacatcatcgccggccgcctgatggtgattcatgcccctgaggagtactaccccatcctggatggcctgaagaggaactacaatgaccctgaagatagagtgaagttccgcagcaagcagaatgtggactatgccttcctgctgaacttctgtgccaacaccagtgactactacgtgatgctggaggatgatgtgcgctgcagcaagaacttcctgacagccatcaagaaggtgattgccagcctggagggcacctactgggtgaccctggagttcagcaagctgggctacatcggcaagctgtaccacagccatgacctgccccggctggcccacttcctgctgatgttctaccaggagatgccctgtgactggctgctgacccacttccggggcctgctggcccagaagaatgtcatccgcttcaagcccagcctcttccagcacatgggctactacagcagctacaagggcacagagaacaagctgaaggatgatgactttgaggaggagagctttgacatcccagacaaccccccagccagcctgtacaccaacatgaatgtgtttgaaaattatgaggccagcaaggcctacagctctgtggatgagtacttctggggcaagccacccagcactggagatgtgtttgtgattgtgtttgagaaccccatcatcatcaagaagatcaaggtgaacacaggaacagaagatcggcagaatgacatcctgcaccacggggccctggatgtgggagaaaatgtgatgcccagcaagcagaggcggcagtgcagcacctacctgcggctgggggagttcaagaatggaaactttgagatgtctggagtgaaccagaagatcccctttgacatccactgcatgaggatctacgtgaccaagacccagaaggagtggctgatcatccgcagcatcagcatctggaccagctag

SEQ ID NO: 35665 - DNA, 1524 bp, Artificial Sequence
  Description of Artificial Sequence: Synthetic coding sequence
atgctgggcaaggacatggtgcgctttgtggtgaggaagacagtgcagaggtctgtggccaagggcagccgccgctgcaagaagaggatgttcaagttccaccagatgaagcacatctttgagatcctggacaagatgcgctgcctgaggaagaggagcacagtgtccttcctgggcgtgctggtgatcttcctgctcttcatgaacctgtacattgaagattcctatgtgctggagggggacaagcagctgatccgggagaccagcacccaccagctgaacagcgagcgctacgtgcacaccttcaaggacctgagcaacttcagcggggccatcaacgtgacctaccgctacctggccgccacccccctgcagaggaagcgctacctgaccatcggcctgagctctgtgaagaggaagaagggcaactacctgctggagaccatcaagagcatctttgagcagagcagctatgaggagctgaaggagatctctgtggtggtgcacctggccgacttcaacagctcctggagagatgccatggtgcaggacatcacccagaagtttgcccaccacatcatcgccggccgcctgatggtgatccacgcccctgaggagtactaccccatcctggatggcctgaagaggaactacaatgaccctgaggacagagtgaagttccgcagcaagcagaatgtggactatgccttcctgctgaacttctgtgccaacaccagtgactactacgtgatgctggaggatgatgtgcgctgcagcaagaacttcctgacagccatcaagaaggtgattgccagcctggagggcacctactgggtgaccctggagttcagcaagctgggctacatcggcaagctgtaccacagccatgacctgccccggctggcccacttcctgctgatgttctaccaggagatgccctgtgactggctgctgacccacttccggggcctgctggcccagaagaatgtcatccgcttcaagcccagcctcttccagcacatgggctactacagcagctacaagggcacagagaacaagctgaaggatgatgactttgaggaggagagctttgacatcccagacaaccccccagccagcctgtacaccaacatgaatgtgtttgagaactatgaggccagcaaggcctacagctctgtggatgagtacttctggggcaagccacccagcactggagatgtgtttgtgattgtgtttgagaaccccatcatcatcaagaagatcaaggtgaacacaggaacagaggaccggcagaatgacatcctgcaccacggggccctggatgtgggggagaatgtgatgcccagcaagcagaggcggcagtgcagcacctacctgcggctgggggagttcaagaatggaaactttgagatgtctggagtgaaccagaagatcccctttgacatccactgcatgaggatctacgtgaccaagacccagaaggagtggctgatcatccgcagcatcagcatctggaccagctag

SEQ ID NO: 35666 - DNA, 1197 bp, Artificial Sequence
  Description of Artificial Sequence: Synthetic coding sequence
atgttcaagttccaccagatgaagcacatctttgagatcctggacaagatgcgctgcctgaggaagaggagcacagtgtccttcctgggcgtgctggtgatcttcctgctcttcatgaacctgtacatcgaggacagctatgtgctggagggggacaagcagctgatccgggagaccagcacccaccagctgaacagcgagagatatgtgcacaccttcaaggacctgagcaacttcagcggggccatcaacgtgacctaccgctacctggccgccacccccctgcagaggaagcgctacctgaccatcggcctgagctctgtgaagaggaagaagggcaactacctgctggagaccatcaagagcatctttgagcagagcagctatgaggagctgaaggagatctctgtggtggtgcacctggccgacttcaacagctcctggagagatgccatggtgcaggacatcacccagaagtttgcccaccacatcatcgccggccgcctgatggtgattcatgcccctgaggagtactaccccatcctggatggcctgaagaggaactacaatgaccctgaagatagagtgaagttccgcagcaagcagaatgtggactatgccttcctgctgaacttctgtgccaacaccagtgactactacgtgatgctggaggatgatgtgcgctgcagcaagaacttcctgacagccatcaagaaggtgattgccagcctggagggcacctactgggtgaccctggagttcagcaagctgggctacatcggcaagctgtaccacagccatgacctgccccggctggcccacttcctgctgatgttctaccaggagatgccctgtgactggctgctgacccacttccggggcctgctggcccagaagaatgtcatccgcttcaagcccagcctcttccagcacatgggctactacagcagctacaagggcacagagaacaagctgaaggatgatgactttgaggaggagagctttgacatcccagacaaccccccagccagcctgtacaccaacatgaatgtgtttgaaaattatgaggccagcaaggcctacagctctgtggatgagtacttctggggcaagccacccagcactggagatgtgtttgtgattgtgtttgagaaccccatcatcatcaagaagatcaaggtgaacacaggcacctag

SEQ ID NO: 35667 - DNA, 1437 bp, Artificial Sequence; identical to SEQ ID NO: 35664
  Description of Artificial Sequence: Synthetic coding sequence

SEQ ID NO: 35668 - DNA, 1437 bp, Artificial Sequence; identical to SEQ ID NO: 35664
  Description of Artificial Sequence: Synthetic coding sequence

SEQ ID NO: 35669 - DNA, 1437 bp, Artificial Sequence; identical to SEQ ID NO: 35664
  Description of Artificial Sequence: Synthetic coding sequence

SEQ ID NO: 35670 - DNA, 1437 bp, Artificial Sequence; identical to SEQ ID NO: 35664
  Description of Artificial Sequence: Synthetic coding sequence

SEQ ID NO: 35671 - DNA, 810 bp, Artificial Sequence
  Description of Artificial Sequence: Synthetic coding sequence
atggcccgggccagcagtggaaatggcagcgaggaggcctggggcgccctgcgggccccccagcagcagctgcgggagctgtgccctggggtgaacaaccagccctacctgtgtgagagcggccactgctgcggggagaccggctgctgcacctactactatgagctgtggtggttctggctgctgtggacagtgctgatcctcttcagctgctgctgtgccttccgccaccggcgggccaagctgcggctgcagcagcagcagaggcagcgggagatcaacctgctggcctaccatggagcctgccacggggccggccccttccccaccggcagcctgctggacctgcgcttcctgagcaccttcaagcccccagcctatgaagatgtggtgcaccggcccggcaccccacctccaccctacacagtggcccctggccggcccctgacagccagcagcgagcagacctgctgcagcagcagcagcagctgcccagcccactttgagggcaccaacgtggagggcgtgagcagccaccagagcgccccaccccaccaggagggggagcccggggccggcgtgaccccagccagcaccccacccagctgccgctaccgccgcctgactggagacagcggcatcgagctgtgcccctgcccagccagcggggagggggagcctgtgaaggaggtgcgggtgtctgccaccctgcctgacctggaggactacagcccctgtgccctgcccccagagagcgtgccccagatcttccccatgggcctgagcagcagcgagggggacatcccctag

SEQ ID NO: 35672 - DNA, 2196 bp, Artificial Sequence
  Description of Artificial Sequence: Synthetic coding sequence
atgaagaccaggagccccaagcccctgctgaccggcctgatgtgggcccagcagggcaccaccccaggcacccccaagctgcggcacacctgtgagcagggagatggagtgggcccctacggctgggagttccatgatggcctgagctttggccggcagcacatccaggatggagccctgcggctgaccacagaatttgtgaagaggcctgggggccagcacggcggggactggagctggagggtgacagtggagccccaggacagcggcaccagcgccctgcccctggtgtccctcttcttctacgtggtgacagatggcaaggaggtgctgctgcctgaggtgggcgccaagggccagctgaagttcatcagcggccacaccagcgagctgggggacttccgcttcaccctgctgccccccaccagccctggggacacagcccccaagtatggcagctacaacgtgttctggaccagcaaccctggcctgcccctgctgacagagatggtgaagagccggctgaacagctggttccagcacaggcctcctggggcccctcctgagcgctacctgggcctgcccggcagcctgaagtgggaggaccggggccccagcggccagggccagggccagttcctgatccagcaggtgaccctgaagatccccatcagcattgaatttgtgtttgagagcggcagcgcccaggccggcggcaaccaggccctgccccggctggccggcagcctgctgacccaggccctggagagccatgctgagggcttccgggagagatttgagaagaccttccagctgaaggagaagggcctgagcagtggagagcaggtgctgggccaggccgccctgagcggcctgctgggcggcatcggctacttctacggccagggcctggtgctgcctgacattggagtggagggcagcgagcagaaggtggaccctgccctcttcccccctgtgcccctcttcaccgctgtgcccagccgctccttcttcccccggggcttcctgtgggatgagggcttccaccagctggtggtgcagcgctgggaccccagcctgacccgggaggccctgggccactggctgggcctgctgaatgctgatggctggattggccgggagcagatcctgggagatgaggcccgggcccgggtgcccccagagttcctggtgcagagagctgtgcacgccaacccccccaccctgctgctgcctgtggcccacatgctggaggtgggggaccctgatgacctggccttcctgaggaaggccctgccccggctgcacgcctggttctcctggctgcaccagagccaggccggccccctgcccctgagctaccgctggaggggccgggaccctgccctgcccaccctgctgaaccccaagaccctgcccagcggcctggatgactacccccgggccagccaccccagcgtgacagagcggcacctggacctgcgctgctgggtggccctgggcgcccgggtgctgacccggctggccgagcacctgggggaggccgaggtggccgctgagctgggccccctggccgccagcctggaggccgctgagagcctggatgagctgcactgggcccctgagctgggcgtgtttgctgactttggaaaccacaccaaggctgtgcagctgaagccccggcccccccagggcctggtgcgggtggtgggccggccccagccccagctgcagtatgtggatgccctgggctacgtgtccctcttccccctgctgctgcggctgctggaccccaccagcagccggctgggccccctgctggacatcctggccgacagccgccacctgtggagccccttcggcctgcggagcctggccgccagcagcagcttctacggccagagaaattctgaacatgaccccccctactggagaggagctgtgtggctgaatgtgaactacctggccctgggcgccctgcaccactacggccacctggagggcccccaccaggcccgggccgccaagctgcacggggagctgcgggccaacgtggtgggcaatgtgtggaggcagtaccaggccaccggcttcctgtgggagcagtacagcgacagagatggccggggcatgggctgccggcccttccacggctggaccagcctggtgctgctggccatggccgaggactactag

SEQ ID NO: 35673 - DNA, 480 bp, Artificial Sequence
  Description of Artificial Sequence: Synthetic coding sequence
atggcccggggggagaggagaagaagagctgtgcctgctgagggcgtgaggacagctgagcgggccgcccggggcggccctggaagaagagatggccggggcggcggccccaggagcacagctggaggagtggccctggccgtggtggtgctgagcctggccctgggcatgagcggccgctgggtgctggcctggtaccgggccaggagagctgtgaccctgcacagcgcccctcctgtgctgcctgctgacagcagcagccctgctgtggccccagacctcttctggggcacctaccggccccacgtgtacttcggcatgaagaccaggagccccaagcccctgctgaccggcctgcgctacttctgcccccccttcggcctgcctgtgctgctgtgtggggaccgctggcagggcagccccaccacccggggctggggccagggcgctgtggaggtgtaccagtgggcccaccagtag

SEQ ID NO: 35674 - DNA, 1296 bp, Artificial Sequence
  Description of Artificial Sequence: Synthetic coding sequence
atgttctttggaggagagggcagcctgacctacaccctggtgatcatctgcttcctgaccctgcggctgagcgccagccagaactgcctgaagaagagcctggaggatgtggtgattgacatccagagcagcctgagcaagggcatcagaggaaatgaacctgtgtacaccagcacccaggaggactgcatcaacagctgctgcagcaccaagaacatcagcggggacaaggcctgcaacctgatgatctttgacaccaggaagacagcccggcagcccaactgctacctgttcttctgccccaatgaggaggcctgccccctgaagccagccaagggcctgatgagctaccgcatcatcacagacttccccagcctgaccaggaacctgcccagccaggagctgccccaggaggacagcctgctgcacggccagttcagccaggccgtgacccccctggcccaccaccacacagactacagcaagcccacagacatctcctggagggacaccctgagccagaagtttggcagcagtgaccacctggagaagctgttcaagatggatgaggccagcgcccagctgctggcctacaaggagaagggccacagccagagcagccagttcagcagtgaccaggagatcgcccacctgctgcctgaaaatgtgtctgccctgcctgccaccgtggccgtggccagcccccacaccaccagcgccacccccaagccagccaccctgctgcccaccaatgcctctgtgaccccatctggcaccagccagccccagctggccaccacagcccctcctgtgaccaccgtgaccagccagccccccaccaccctcatcagcacagtgttcaccagggctgctgccaccctgcaggccatggccaccacagctgtgctgaccaccaccttccaggcccccacagacagcaagggcagcctggagaccatccccttcacagagatcagcaacctgaccctgaacacaggaaatgtgtacaaccccacagccctgtccatgagcaatgtggagagcagcaccatgaacaagacagcctcctgggagggccgggaggccagccctggcagcagcagccagggctctgtgcctgagaaccagtatggcctgccctttgagaagtggctgctgattggcagcctgctgtttggagtgctcttcctggtgattggcctggtgctgctgggccgcatcctgtctgagagcctgcggaggaagcgctacagccggctggactacctgatcaatggcatctacgtggacatctag

SEQ ID NO: 35675 - DNA, 174 bp, Artificial Sequence
  Description of Artificial Sequence: Synthetic coding sequence
atgttctttggaggagagggcagcctgacctacaccctggtgatcatctgcttcctgaccctgcggctgagcgccagccagaactgcctgaagaagagcctggaggatgtggtgattgacatccagagcagcctgagcaagggcatcagaggaaatgaacctgtgtacacctag

SEQ ID NO: 35676 - DNA, 615 bp, Artificial Sequence
  Description of Artificial Sequence: Synthetic coding sequence
atggaggccccagctgagctgctggccgccctgcctgccctggccacagccctggccctgctgctggcctggctgctggtgagaagaggagctgctgccagccctgagcccgcccgggcccctcctgagcccgcccccccagctgaggccactggagccccagcccccagccggccctgtgcccctgagcctgctgccagccctgctggccctgaggagcccggggagcccgccggcctgggggagctgggggagcctgctggccctggagagcctgagggccctggggaccctgctgctgccccagctgaggccgaggagcaggccgtggaggcccggcaggaggaggagcaggacctggatggagagaagggccccagcagcgagggccctgaggaggaggatggagagggcttctccttcaagtacagccctgggaagctgcggggcaaccagtacaagaagatgatgaccaaggaggagctggaggaggagcagagggtgcagaaggagcagctggccgccatcttcaagctgatgaaggacaacaaggagacctttggagagatgtctgatggagatgtgcaggagcagctgcggctgtatgacatgtag

SEQ ID NO: 35677 - DNA, 534 bp, Artificial Sequence
  Description of Artificial Sequence: Synthetic coding sequence
atggaggccccagctgagctgctggccgccctgcctgccctggccacagccctggccctgctgctggcctggctgctggtgagaagaggagctgctgccagccctgagcccgcccgggcccctcctgagcccgcccccccagctgaggccactggagccccagcccccagccggccctgtgcccctgagcctgctgccagccctgctggccctgaggagcccggggagcccgccggcctgggggagctgggggagcctgctggccctggagagcctgagggccctggggaccctgctgctgccccagctgaggccgaggagcaggccgtggaggcccggcaggaggaggagcaggacctggatggagagaagggccccagcagcgagggccctgaggaggaggatggagagggcttctccttcaagtacagccctgggaagctgcggggcaaccagtacaagaagatgatgaccaaggaggagctggaggaggagcagagaattgagctgaccagtgacctgaccagcctgtag

SEQ ID NO: 35678 - DNA, 513 bp, Artificial Sequence
  Description of Artificial Sequence: Synthetic coding sequence
atggaggccccagctgagctgctggccgccctgcctgccctggccacagccctggccctgctgctggcctggctgctggtgagaagaggagctgctgccagccctgagcccgcccgggcccctcctgagcccgcccccccagctgaggccactggagccccagcccccagccggccctgtgcccctgagcctgctgccagccctgctggccctgaggagcccggggagcccgccggcctgggggagctgggggagcctgctggccctggagagcctgagggccctggggaccctgctgctgccccagctgaggccgaggagcaggccgtggaggcccggcaggaggaggagcaggacctggatggagagaagggccccagcagcgagggccctgaggaggaggatggagagggcttctccttcaagtacagccctgggaagctgcggggcaaccagtacaagaagatgatgaccaaggaggagctggaggaggagcagaggacccagaggtag

SEQ ID NO: 35679 - DNA, 513 bp, Artificial Sequence
  Description of Artificial Sequence: Synthetic coding sequence
atggaggccccagctgagctgctggccgccctgcctgccctggccacagccctggccctgctgctggcctggctgctggtgagaagaggagctgctgccagccctgagcccgcccgggcccctcctgagcccgcccccccagctgaggccactggagccccagcccccagccggccctgtgcccctgagcctgctgccagccctgctggccctgaggagcccggggagcccgccggcctgggggagctgggggagcctgctggccctggagagcctgagggccctggggaccctgctgctgccccagctgaggccgaggagcaggccgtggaggcccggcaggaggaggagcaggacctggatggagagaagggccccagcagcgagggccctgaggaggaggatggagagggcttctccttcaagtacagccctgggaagctgcggggcaaccagtacaagaagatgatgaccaaggaggagctggaggaggagcagaggacagaggagtag

SEQ ID NO: 35680 - DNA, 1329 bp, Artificial Sequence
  Description of Artificial Sequence: Synthetic coding sequence
atggccctgcccagccgcatcctgctgtggaagctggtgctgctgcagagcagcgctgtgctgctgcacagcggcagctctgtgcctgctgctgctggcagctctgtggtgtctgagagcgctgtgtcctgggaggccggggcccgggctgtgctgcgctgccagagccccaggatggtgtggacccaggaccggctgcatgaccggcagagggtgctgcactgggacctgcggggccctgggggcggccctgcccggcggctgctggacctgtacagcgctggggagcagagggtgtatgaggcccgggaccggggccgcctggagctgagcgccagcgcctttgatgatggcaacttcagcctgctgatccgggctgtggaggagacagatgctggcctgtacacctgcaacctgcaccaccactactgccacctgtatgagagcctggccgtgcggctggaggtgacagatggccccccagccaccccagcctactgggatggagagaaggaggtgctggccgtggcccggggggccccagccctgctgacctgtgtgaacagaggacatgtgtggacagacagacatgtggaggaggcccagcaggtggtgcactgggaccggcagcccccaggagtgccccatgacagagctgaccggctgctggacctgtatgccagcggggagcggcgggcctacggccccctcttcctgcgggacagagtggccgtgggcgcagatgcctttgagcggggggacttcagcctgagaattgagcccctggaggtggctgatgagggcacctacagctgccacctgcaccaccactactgcggcctgcacgagcggcgggtcttccacctgactgtggccgagccccacgccgagcccccaccccggggcagccctggaaatggcagcagccacagcggggcccctggccctgaccccaccctggcccggggccacaacgtcatcaacgtcatcgtgcctgagagccgggcccacttcttccagcagctgggctacgtgctggccaccctgctgctcttcatcctgctgctggtgacagtgctgctggccgccaggagaagaagaggaggctatgagtacagcgaccagaagagcggcaagagcaagggcaaggatgtgaacctggccgagtttgctgtggccgccggggaccagatgctgtacagaagtgaggacatccagctggactacaagaacaacatcctgaaggagcgggcagagctggcccacagccccctgcctgccaagtacatcgacctggacaagggcttcagaaaagaaaactgcaagtag

SEQ ID NO: 35681 - DNA, 1026 bp, Artificial Sequence
  Description of Artificial Sequence: Synthetic coding sequence
atggccctgcccagccgcatcctgctgtggaagctggtgctgctgcagagcagcgctgtgctgctgcacagcgctgtggaggagacagatgctggcctgtacacctgcaacctgcaccaccactactgccacctgtatgagagcctggccgtgcggctggaggtgacagatggccccccagccaccccagcctactgggatggagagaaggaggtgctggccgtggcccggggggccccagccctgctgacctgtgtgaacagaggccacgtgtggacagacagacatgtggaggaggcccagcaggtggtgcactgggaccggcagcccccaggagtgccccatgacagagctgaccggctgctggacctgtatgccagcggggagcggcgggcctacggccccctcttcctgcgggacagagtggccgtgggcgcagatgcctttgagcggggggacttcagcctgcgcatcgagcccctggaggtggctgatgagggcacctacagctgccacctgcaccaccactactgcggcctgcatgaaagaagagtcttccacctgactgtggccgagccccatgctgagcccccaccccggggcagccctggaaatggcagcagccacagcggggcccctggccctgaccccaccctggcccggggccacaacgtcatcaacgtgattgtgcctgagagccgggcccacttcttccagcagctgggctacgtgctggccaccctgctgctcttcatcctgctgctggtgacagtgctgctggccgccaggagaagaagaggaggctatgagtacagcgaccagaagagcggcaagagcaagggcaaggatgtgaacctggccgagtttgctgtggccgccggggaccagatgctgtacagaagtgaggacatccagctggactacaagaacaacatcctgaaggagagagctgagctggcccacagccccctgcctgccaagtacatcgacctggacaagggcttcaggaaggagaactgcaagtag

SEQ ID NO: 35682 - DNA, 1302 bp, Artificial Sequence
  Description of Artificial Sequence: Synthetic coding sequence
atgatccgctgtgccgccactggatctgctgtgctgctgcacagcggcagctctgtgcctgctgctgctggcagctctgtggtgtctgagagcgctgtgtcctgggaggccggggcccgggctgtgctgcgctgccagagccccaggatggtgtggacccaggaccggctgcatgaccggcagagggtgctgcactgggacctgcggggccctgggggcggccctgcccggcggctgctggacctgtacagcgctggggagcagagggtgtatgaggcccgggaccggggccgcctggagctgagcgccagcgcctttgatgatggcaacttcagcctgctgatccgggctgtggaggagacagatgctggcctgtacacctgcaacctgcaccaccactactgccacctgtatgagagcctggccgtgcggctggaggtgacagatggccccccagccaccccagcctactgggatggagagaaggaggtgctggccgtggcccggggggccccagccctgctgacctgtgtgaacagaggccacgtgtggacagacagacatgtggaggaggcccagcaggtggtgcactgggaccggcagcccccaggagtgccccatgacagagctgaccggctgctggacctgtatgccagcggggagcggcgggcctacggccccctcttcctgcgggacagagtggccgtgggcgcagatgcctttgagcggggggacttcagcctgcgcatcgagcccctggaggtggctgatgagggcacctacagctgccacctgcaccaccactactgcggcctgcatgaaagaagagtcttccacctgactgtggccgagccccatgctgagcccccaccccggggcagccctggaaatggcagcagccacagcggggcccctggccctgaccccaccctggcccggggccacaacgtcatcaacgtgattgtgcctgagagccgggcccacttcttccagcagctgggctacgtgctggccaccctgctgctcttcatcctgctgctggtgacagtgctgctggccgccaggagaagaagaggaggctatgagtacagcgaccagaagagcggcaagagcaagggcaaggatgtgaacctggccgagtttgctgtggccgccggggaccagatgctgtacagaagtgaggacatccagctggactacaagaacaacatcctgaaggagagagctgagctggcccacagccccctgcctgccaagtacatcgacctggacaagggcttcaggaaggagaactgcaagtag

SEQ ID NO: 35683 - DNA, 1353 bp, Artificial Sequence
  Description of Artificial Sequence: Synthetic coding sequence
atggccctgcccagccgcatcctgctgtggaagctggtgctgctgcagagcagcgctgtgctgctgcacagcggcagctctgtgcctgctgctgctggcagctctgtggtgtctgagagcgctgtgtcctgggaggccggggcccgggctgtgctgcgctgccagagccccaggatggtgtggacccaggaccggctgcatgaccggcagagggtgctgcactgggacctgcggggccctgggggcggccctgcccggcggctgctggacctgtacagcgctggggagcagagggtgtatgaggcccgggaccggggccgcctggagctgagcgccagcgcctttgatgatggcaacttcagcctgctgatccgggctgtggaggagacagatgctggcctgtacacctgcaacctgcaccaccactactgccacctgtatgagagcctggccgtgcggctggaggtgacagatggccccccagccaccccagcctactgggatggagagaaggaggtgctggccgtggcccggggggccccagccctgctgacctgtgtgaacagaggacatgtgtggacagacagacatgtggaggaggcccagcaggtggtgcactgggaccggcagcccccaggagtgccccatgacagagctgaccggctgctggacctgtatgccagcggggagcggcgggcctacggccccctcttcctgcgggacagagtggccgtgggcgcagatgcctttgagcggggggacttcagcctgagaattgagcccctggaggtggctgatgagggcacctacagctgccacctgcaccaccactactgcggcctgcacgagcggcgggtcttccacctgactgtggccgagccccacgccgagcccccaccccggggcagccctggaaatggcagcagccacagcggggcccctggccctgaccccaccctggcccggggccacaacgtcatcaacgtcatcgtgcctgagagccgggcccacttcttccagcagctgggctacgtgctggccaccctgctgctcttcatcctgctgctggtgacagtgctgctggccgccaggagaagaagaggaggctatgagtacagcgaccagaagagcggcaagagcaagggcaaggatgtgaacctggccgagtttgctgtggccgccggggaccagatgctgtacagaagtgaggacatccagctggccagcagccccccaacagactacaagaacaacatcctgaaggagcgggcagagctggcccacagccccctgcctgccaagtacatcgacctggacaaggaccccagcggcctgtgccccctgggcgcctag

SEQ ID NO: 35684 - DNA, 207 bp, Artificial Sequence
  Description of Artificial Sequence: Synthetic coding sequence
atgccccagaaggacccctgccagaagcaggcctgtgagatccagaagtgcctgcaggccaacagctacatggagagcaagtgccaggccgtcatccaggagctgaggaagtgctgtgcccagtaccccaagggccgctctgtggtgtgcagcggctttgagaaggaggaggaggagaacctgaccaggaagagcgccagcaagtag

SEQ ID NO: 35685 - DNA, 207 bp, Artificial Sequence; identical to SEQ ID NO: 35684
  Description of Artificial Sequence: Synthetic coding sequence

SEQ ID NO: 35686 - DNA, 618 bp, Artificial Sequence
  Description of Artificial Sequence: Synthetic coding sequence
atgtctgcccagaggctcatcagcaacagaaccagccagcagagcgccagcaacagcgactacacctgggagtatgagtactatgagatcggccctgtgtcctttgagggcctgaaggcccacaagtacagcatcgtgattggcttctgggtgggcctggccgtgtttgtgatcttcatgttctttgtgctgaccctgctgaccaagacaggagccccccaccaggacaatgctgagagcagcgagaagcgcttcaggatgaacagctttgtgtctgactttggccggcccctggagccagacaaggtgttcagccggcagggcaatgaggagagccgcagcctcttccactgctacatcaatgaggtggagcggctggaccgggccaaggcctgccaccagaccacagccctggacagtgatgtgcagctgcaggaggccatccgcagcagcggccagcctgaggaggagctgaaccggctgatgaagtttgacatccccaactttgtgaacacagaccagaactactttggagaagatgacctgctgatcagcgagccccccatcgtgctggagaccaagcccctgagccagaccagccacaaggacctggactag

SEQ ID NO: 35687 - DNA, 930 bp, Artificial Sequence
  Description of Artificial Sequence: Synthetic coding sequence
atgagcctggagcagaggagcctgcactgcaagccagaggaggccctggaggcccagcaggaggccctgggcctggtgtgtgtgcaggccgccaccagcagcagcagccccctggtgctgggcaccctggaggaggtgcccacagctggcagcacagaccccccccagagcccccagggcgccagcgccttccccaccaccatcaacttcacccggcagaggcagcccagcgagggcagcagcagccgggaggaggagggccccagcaccagctgcatcctggagagcctcttccgggccgtcatcaccaagaaggtggccgacctggtgggcttcctgctgctgaagtaccgggcccgggagcctgtgaccaaggccgagatgctggagagcgtcatcaagaactacaagcactgcttccctgagatctttgggaaggccagcgagagcctgcagctggtgtttggaattgatgtgaaggaggccgaccccaccggccacagctatgtgctggtgacctgcctgggcctgtcctatgatggcctgctgggggacaaccagatcatgcccaagacaggcttcctgatcatcgtgctggtgatgattgccatggagggcggccacgcccctgaggaggagatctgggaggagctgtctgtgatggaggtgtatgatggccgggagcacagcgcctacggggagcccaggaagctgctgacccaggacctggtgcaggagaagtacctggagtaccggcaggtgcctgacagcgaccctgcccgctatgagttcctgtggggcccccgggccctggccgagaccagctatgtgaaggtgctggagtatgtgatcaaggtgtctgcccgggtgcgcttcttcttccccagcctgcgggaggccgccctgcgggaggaggaggagggcgtgtag

SEQ ID NO: 35688 - DNA, 4368 bp, Artificial Sequence
  Description of Artificial Sequence: Synthetic coding sequence
atgagcaagagcctgaagaagaagagccactggaccagcaaggtgcatgagagcgtcatcggcaggaaccctgagggccagctgggctttgagctgaagggcggcgcagaaaatggccagttcccctacctgggggaggtgaagccaggcaaggtggcctatgagagcggcagcaagctggtgtctgaggagctgctgctggaggtgaatgagacccctgtggccggcctgaccatcagagatgtgctggccgtcatcaagcactgcaaggaccccctgcggctgaagtgtgtgaagcagggcggcatcgtggacaaggacctgcggcactacctgaacctgcgcttccagaagggctctgtggaccacgagctgcagcagatcatccgggacaacctgtacctgaggacagtgccctgcaccacccggccccacaaggagggggaggtgcctggggtggactacatcttcatcaccgtggaggacttcatggagctggagaagagcggggccctgctggagagcggcacctatgaggacaactactacggcacccccaagcccccagctgagcccgcccccctgctgctgaatgtgacagaccagatcctgcccggggccacccccagcgctgagggcaagaggaagaggaacaagtctgtgagcaacatggagaaggccagcattgagcccccagaggaggaggaggaggagaggcctgtggtgaatggaaatggagtggtggtgaccccagagagcagcgagcacgaggacaagtctgctggggccagcggggagatgcccagccagccctacccagcccctgtgtacagccagcctgaggagctgaaggagcagatggatgacaccaagcccaccaagccagaggacaatgaggagccagaccccctgcctgacaactgggagatggcctacacagagaagggggaggtgtacttcatcgaccacaacaccaagaccacctcctggctggacccccggctggccaagaaggccaagcccccagaggagtgcaaggaaaatgagctgccctacggctgggagaagattgatgaccccatctacggcacctactacgtggaccacatcaacagaaggacccagtttgaaaatcctgtgctggaggccaagaggaagctgcagcagcacaacatgccccacacagagctgggcaccaagcccctgcaggcccctggcttccgggagaagcccctcttcaccagagatgccagccagctgaagggcaccttcctgagcaccaccctgaagaagagcaacatgggcttcggcttcaccatcattggaggagatgagccagatgagttcctgcaggtgaagagcgtcatcccagatggccctgctgcccaggacggcaagatggagactggagatgtgattgtgtacatcaatgaggtgtgtgtgctgggccacacccatgctgatgtggtgaagctgttccagagcgtgcccatcggccagagcgtgaacctggtgctgtgccggggctaccccctgccctttgatcctgaagatcctgccaacagcatggtgccccccctggccatcatggagaggcctcctcctgtgatggtgaatggccgccacaactatgagacctacctggagtacatcagcaggaccagccagagcgtgcctgacatcacagacaggcctccccacagcctgcacagcatgcccacagatggccagctggatggcacctacccacctcctgtgcatgatgacaacgtgtccatggccagcagcggggccacccaggccgagctgatgaccctgaccatcgtgaagggggcccagggcttcggcttcaccatcgctgacagccccaccggccagagggtgaagcagatcctggacatccagggctgccccggcctgtgtgagggggacctgattgtggagatcaaccagcagaatgtgcagaacctgagccacacagaggtggtggacatcctgaaggactgccccatcggcagcgagaccagcctcatcatccaccggggcggcttcttcagcccctggaagacccccaagcccatcatggaccgctgggagaaccagggcagcccccagaccagcctgagcgccccagccatcccccagaacctgcccttccccccagccctgcacaggagcagcttcccagacagcacagaggcctttgaccccaggaagccagacccctatgagctgtatgagaagagccgggccatctatgagagccggcagcaggtgccccccaggaccagcttcaggatggacagcagcggccctgactacaaggagctggatgtgcacctgcggaggatggagagcggcttcggcttccgcatcctgggcggagatgagcccggccagcccatcctgattggagctgtgattgccatgggcagcgctgacagagatggccgcctgcaccctggagatgagctggtgtatgtggatggcatccctgtggccggcaagacccaccgctacgtgattgacctgatgcaccacgccgccagaaatggccaggtgaacctgactgtgcggaggaaggtgctgtgtggcggggagccctgcccagaaaatggccgcagccctggctctgtgtccacccaccacagcagccccaggagtgactatgccacctacaccaacagcaaccacgccgcccccagcagcaatgccagccccccagagggctttgccagccacagcctgcagaccagtgatgtggtgatccacaggaaagaaaatgaaggatttggatttgtgatcatcagcagcctgaacagacctgagagcggcagcaccatcaccgtgccccacaagattggccgcatcattgatggcagccctgctgacagatgtgccaagctgaaggtgggggaccgcatcctggccgtgaatggccagagcatcatcaacatgcctcatgctgacatcgtgaagctgatcaaggatgctggcctgtctgtgaccctgcgcatcatcccccaggaggagctgaacagccccaccagcgcccccagcagcgagaagcagagccccatggcccagcagagccccctggcccagcagagccccctggcccagcccagccctgccacccccaacagccccatcgcccagcctgccccaccccagcccctgcagctgcagggccacgagaacagctacagaagtgaggtgaaggcccggcaggatgtgaagccagacatccggcagccccccttcacagactaccggcagccccccctggactaccggcagcccccaggaggagactaccagcagcccccacccctggactaccggcagccccccctgctggactaccggcagcacagcccagacacccggcagtaccccctgagtgactaccggcagccccaggactttgactacttcaccgtggacatggagaagggggccaagggcttcggcttcagcatccggggcggccgggagtacaagatggacctgtatgtgctgcggctggccgaggatggccctgccatcagaaatggaaggatgagggtgggggaccagatcatcgagatcaacggggagagcacccgggacatgacccacgcccgggccatcgagctgatcaagagcggcggcagaagagtgcggctgctgctgaagaggggcaccggccaggtgcctgaatatgatgagcccgccccctggagcagccctgctgctgctgcccctggcctgcctgaggtgggcgtgtccctggatgatggcctggcccccttcagccccagccacccagccccacccagcgaccccagccaccagatcagccctggccccacctgggacatcaagcgggagcatgatgtgaggaagcccaaggagctgagcgcctgtggccagaagaagcagaggctgggggagcagcgggagaggtctgccagcccccagagagctgcccggccccggctggaggaggcccctgggggccagggccggcctgaggccggccgcccagccagcgaggcccgggcccctggcctggccgctgctgatgctgctgatgctgcccgggccggcggcaaggaggcccccagggctgctgctggcagcgagctgtgcagaagagagggccctggagctgccccagcctttgctggccctgggggcggcggcagcggggccctggaggccgagggccgggccggggcccgggccggcccccggcccggcccccggcccccaggaggagccccagccaggaaggctgctgtggcccctggcccctggaaggtgcccggcagtgacaagctgcccagcgtgctgaagccaggggccagcgctgccagcaggtag

SEQ ID NO: 35689 - DNA, 4326 bp, Artificial Sequence
  Description of Artificial Sequence: Synthetic coding sequence
atgagcaagagcctgaagaagaagagccactggaccagcaaggtgcatgagagcgtcatcggcaggaaccctgagggccagctgggctttgagctgaagggcggcgcagaaaatggccagttcccctacctgggggaggtgaagccaggcaaggtggcctatgagagcggcagcaagctggtgtctgaggagctgctgctggaggtgaatgagacccctgtggccggcctgaccatcagagatgtgctggccgtcatcaagcactgcaaggaccccctgcggctgaagtgtgtgaagcagggcggcatcgtggacaaggacctgcggcactacctgaacctgcgcttccagaagggctctgtggaccacgagctgcagcagatcatccgggacaacctgtacctgaggacagtgccctgcaccacccggccccacaaggagggggaggtgcctggggtggactacatcttcatcaccgtggaggacttcatggagctggagaagagcggggccctgctggagagcggcacctatgaggacaactactacggcacccccaagcccccagctgagcccgcccccctgctgctgaatgtgacagaccagatcctgcccggggccacccccagcgctgagggcaagaggaagaggaacaagtctgtgagcaacatggagaaggccagcattgagcccccagaggaggaggaggaggagaggcctgtggtgaatggaaatggagtggtggtgaccccagagagcagcgagcacgaggacaagtctgctggggccagcggggagatgcccagccagccctacccagcccctgtgtacagccagcctgaggagctgaaggagcagatggatgacaccaagcccaccaagccagaggacaatgaggagccagaccccctgcctgacaactgggagatggcctacacagagaagggggaggtgtacttcatcgaccacaacaccaagaccacctcctggctggacccccggctggccaagaaggccaagcccccagaggagtgcaaggaaaatgagctgccctacggctgggagaagattgatgaccccatctacggcacctactacgtggaccacatcaacagaaggacccagtttgaaaatcctgtgctggaggccaagaggaagctgcagcagcacaacatgccccacacagagctgggcaccaagcccctgcaggcccctggcttccgggagaagcccctcttcaccagagatgccagccagctgaagggcaccttcctgagcaccaccctgaagaagagcaacatgggcttcggcttcaccatcattggaggagatgagccagatgagttcctgcaggtgaagagcgtcatcccagatggccctgctgcccaggacggcaagatggagactggagatgtgattgtgtacatcaatgaggtgtgtgtgctgggccacacccatgctgatgtggtgaagctgttccagagcgtgcccatcggccagagcgtgaacctggtgctgtgccggggctaccccctgccctttgatcctgaagatcctgccaacagcatggtgccccccctggccatcatggagaggcctcctcctgtgatggtgaatggccgccacaactatgagacctacctggagtacatcagcaggaccagccagagcgtgcctgacatcacagacaggcctccccacagcctgcacagcatgcccacagatggccagctggatggcacctacccacctcctgtgcatgatgacaacgtgtccatggccagcagcggggccacccaggccgagctgatgaccctgaccatcgtgaagggggcccagggcttcggcttcaccatcgctgacagccccaccggccagagggtgaagcagatcctggacatccagggctgccccggcctgtgtgagggggacctgattgtggagatcaaccagcagaatgtgcagaacctgagccacacagaggtggtggacatcctgaaggactgccccatcggcagcgagaccagcctcatcatccaccggggcggcttcttcagcccctggaagacccccaagcccatcatggaccgctgggagaaccagggcagcccccagaccagcctgagcgccccagccatcccccagaacctgcccttccccccagccctgcacaggagcagcttcccagacagcacagaggcctttgaccccaggaagccagacccctatgagctgtatgagaagagccgggccatctatgagagccggcggccagactacaaggagctggatgtgcacctgcggaggatggagagcggcttcggcttccgcatcctgggcggagatgagcccggccagcccatcctgattggagctgtgattgccatgggcagcgctgacagagatggccgcctgcaccctggagatgagctggtgtatgtggatggcatccctgtggccggcaagacccaccgctacgtgattgacctgatgcaccacgccgccagaaatggccaggtgaacctgactgtgcggaggaaggtgctgtgtggcggggagccctgcccagaaaatggccgcagccctggctctgtgtccacccaccacagcagccccaggagtgactatgccacctacaccaacagcaaccacgccgcccccagcagcaatgccagccccccagagggctttgccagccacagcctgcagaccagtgatgtggtgatccacaggaaagaaaatgaaggatttggatttgtgatcatcagcagcctgaacagacctgagagcggcagcaccatcaccgtgccccacaagattggccgcatcattgatggcagccctgctgacagatgtgccaagctgaaggtgggggaccgcatcctggccgtgaatggccagagcatcatcaacatgcctcatgctgacatcgtgaagctgatcaaggatgctggcctgtctgtgaccctgcgcatcatcccccaggaggagctgaacagccccaccagcgcccccagcagcgagaagcagagccccatggcccagcagagccccctggcccagcagagccccctggcccagcccagccctgccacccccaacagccccatcgcccagcctgccccaccccagcccctgcagctgcagggccacgagaacagctacagaagtgaggtgaaggcccggcaggatgtgaagccagacatccggcagccccccttcacagactaccggcagccccccctggactaccggcagcccccaggaggagactaccagcagcccccacccctggactaccggcagccccccctgctggactaccggcagcacagcccagacacccggcagtaccccctgagtgactaccggcagccccaggactttgactacttcaccgtggacatggagaagggggccaagggcttcggcttcagcatccggggcggccgggagtacaagatggacctgtatgtgctgcggctggccgaggatggccctgccatcagaaatggaaggatgagggtgggggaccagatcatcgagatcaacggggagagcacccgggacatgacccacgcccgggccatcgagctgatcaagagcggcggcagaagagtgcggctgctgctgaagaggggcaccggccaggtgcctgaatatgatgagcccgccccctggagcagccctgctgctgctgcccctggcctgcctgaggtgggcgtgtccctggatgatggcctggcccccttcagccccagccacccagccccacccagcgaccccagccaccagatcagccctggccccacctgggacatcaagcgggagcatgatgtgaggaagcccaaggagctgagcgcctgtggccagaagaagcagaggctgggggagcagcgggagaggtctgccagcccccagagagctgcccggccccggctggaggaggcccctgggggccagggccggcctgaggccggccgcccagccagcgaggcccgggcccctggcctggccgctgctgatgctgctgatgctgcccgggccggcggcaaggaggcccccagggctgctgctggcagcgagctgtgcagaagagagggccctggagctgccccagcctttgctggccctgggggcggcggcagcggggccctggaggccgagggccgggccggggcccgggccggcccccggcccggcccccggcccccaggaggagccccagccaggaaggctgctgtggcccctggcccctggaaggtgcccggcagtgacaagctgcccagcgtgctgaagccaggggccagcgctgccagcaggtag

SEQ ID NO: 35690 - DNA, 1668 bp, Artificial Sequence
  Description of Artificial Sequence: Synthetic coding sequence
atggagctggagaagagcggggccctgctggagagcggcacctatgaggacaactactacggcacccccaagcccccagctgagcccgcccccctgctgctgaatgtgacagaccagatcctgcccggggccaccccatctgctgagggcaagaggaagaggaacaagtctgtgagcaacatggagaaggccagcattgagcccccagaggaggaggaggaggagaggcctgtggtgaatggaaatggagtggtggtgaccccagagagcagcgagcacgaggacaagtctgctggggccagcggggagatgcccagccagccctacccagcccctgtgtacagccagcctgaggagctgaaggagcagatggatgacaccaagcccaccaagccagaagataatgaggagccagaccccctgcctgacaactgggagatggcctacacagagaagggggaggtgtacttcatcgaccacaacaccaagaccacctcctggctggacccccggctggccaagaaggccaagcccccagaggagtgcaaggaaaatgagctgccctacggctgggagaagattgatgaccccatctacggcacctactacgtggaccacatcaacagaaggacccagtttgagaaccctgtgctggaggccaagaggaagctgcagcagcacaacatgccccacacagagctgggcaccaagcccctgcaggcccctggcttccgggagaagcccctcttcaccagagatgccagccagctgaagggcaccttcctgagcaccaccctgaagaagagcaacatgggcttcggcttcaccatcattggaggagatgagccagatgagttcctgcaggtgaagagcgtcatcccagatggccctgctgcccaggacggcaagatggagactggagatgtgattgtgtacatcaatgaggtgtgtgtgctgggccacacccatgctgatgtggtgaagctgttccagagcgtgcccatcggccagagcgtgaacctggtgctgtgccggggctaccccctgccctttgatcctgaggaccctgccaacagcatggtgccccccctggccatcatggagcggcccccacctgtgatggtgaatggccgccacaactatgagacctacctggagtacatcagcaggaccagccagagcgtgcctgacatcacagaccggcccccccacagcctgcacagcatgcccacagatggccagctggatggcacctacccacctcctgtgcatgatgacaacgtgtccatggccagcagcggggccacccaggccgagctgatgaccctgaccatcgtgaagggggcccagggcttcggcttcaccatcgctgacagccccaccggccagagggtgaagcagatcctggacatccagggctgccccggcctgtgtgagggggacctgattgtggagatcaaccagcagaatgtgcagaacctgagccacacagaggtggtggacatcctgaaggactgccccatcggcagcgagaccagcctcatcatccacagaggaggcaagaccaacacaggcagcgccatcaagtatgtgggcaagatcgtgggcagcttcaacaacatcgtgaagatgcagatcagcctggagctgaatgagatcatcctgtag

SEQ ID NO: 35691 - DNA, 3762 bp, Artificial Sequence
  Description of Artificial Sequence: Synthetic coding sequence
atgagcaagagcctgaagaagaagagccactggaccagcaaggtgcatgagagcgtcatcggcaggaaccctgagggccagctgggctttgagctgaagggcggcgcagaaaatggccagttcccctacctgggggaggtgaagccaggcaaggtggcctatgagagcggcagcaagctggtgtctgaggagctgctgctggaggtgaatgagacccctgtggccggcctgaccatcagagatgtgctggccgtcatcaagcactgcaaggaccccctgcggctgaagtgtgtgaagcagggcggcatcgtggacaaggacctgcggcactacctgaacctgcgcttccagaagggctctgtggaccacgagctgcagcagatcatccgggacaacctgtacctgaggacagtgccctgcaccacccggccccacaaggagggggaggtgcctggggtggactacatcttcatcaccgtggaggacttcatggagctggagaagagcggggccctgctggagagcggcacctatgaggacaactactacggcacccccaagcccccagctgagcccgcccccctgctgctgaatgtgacagaccagatcctgcccggggccacccccagcgctgagggcaagaggaagaggaacaagtctgtgagcaacatggagaaggccagcattgagcccccagaggaggaggaggaggagaggcctgtggtgaatggaaatggagtggtggtgaccccagagagcagcgagcacgaggacaagtctgctggggccagcggggagatgcccagccagccctacccagcccctgtgtacagccagcctgaggagctgaaggagcagatggatgacaccaagcccaccaagccagaggacaatgaggagccagaccccctgcctgacaactgggagatggcctacacagagaagggggaggtgtacttcatcgaccacaacaccaagaccacctcctggctggacccccggctggccaagaaggccaagcccccagaggagtgcaaggaaaatgagctgccctacggctgggagaagattgatgaccccatctacggcacctactacgtggaccacatcaacagaaggacccagtttgaaaatcctgtgctggaggccaagaggaagctgcagcagcacaacatgccccacacagagctgggcaccaagcccctgcaggcccctggcttccgggagaagcccctcttcaccagagatgccagccagctgaagggcaccttcctgagcaccaccctgaagaagagcaacatgggcttcggcttcaccatcattggaggagatgagccagatgagttcctgcaggtgaagagcgtcatcccagatggccctgctgcccaggacggcaagatggagactggagatgtgattgtgtacatcaatgaggtgtgtgtgctgggccacacccatgctgatgtggtgaagctgttccagagcgtgcccatcggccagagcgtgaacctggtgctgtgccggggctaccccctgccctttgatcctgaagatcctgccaacagcatggtgccccccctggccatcatggagaggcctcctcctgtgatggtgaatggccgccacaactatgagacctacctggagtacatcagcaggaccagccagagcgtgcctgacatcacagacaggcctccccacagcctgcacagcatgcccacagatggccagctggatggcacctacccacctcctgtgcatgatgacaacgtgtccatggccagcagcggggccacccaggccgagctgatgaccctgaccatcgtgaagggggcccagggcttcggcttcaccatcgctgacagccccaccggccagagggtgaagcagatcctggacatccagggctgccccggcctgtgtgagggggacctgattgtggagatcaaccagcagaatgtgcagaacctgagccacacagaggtggtggacatcctgaaggactgccccatcggcagcgagaccagcctcatcatccaccggggcggcttcttcagcccctggaagacccccaagcccatcatggaccgctgggagaaccagggcagcccccagaccagcctgagcgccccagccatcccccagaacctgcccttccccccagccctgcacaggagcagcttcccagacagcacagaggcctttgaccccaggaagccagacccctatgagctgtatgagaagagccgggccatctatgagagccggcagcaggtgccccccaggaccagcttcaggatggacagcagcggccctgactacaaggagctggatgtgcacctgcggaggatggagagcggcttcggcttccgcatcctgggcggagatgagcccggccagcccatcctgattggagctgtgattgccatgggcagcgctgacagagatggccgcctgcaccctggagatgagctggtgtatgtggatggcatccctgtggccggcaagacccaccgctacgtgattgacctgatgcaccacgccgccagaaatggccaggtgaacctgactgtgcggaggaaggtgctgtgtggcggggagccctgcccagaaaatggccgcagccctggctctgtgtccacccaccacagcagccccaggagtgactatgccacctacaccaacagcaaccacgccgcccccagcagcaatgccagccccccagagggctttgccagccacagcctgcagaccagtgatgtggtgatccacaggaaagaaaatgaaggatttggatttgtgatcatcagcagcctgaacagacctgagagcggcagcaccatcaccgtgccccacaagattggccgcatcattgatggcagccctgctgacagatgtgccaagctgaaggtgggggaccgcatcctggccgtgaatggccagagcatcatcaacatgcctcatgctgacatcgtgaagctgatcaaggatgctggcctgtctgtgaccctgcgcatcatcccccaggaggagctgaacagccccaccagcgcccccagcagcgagaagcagagccccatggcccagcagagccccctggcccagcagagccccctggcccagcccagccctgccacccccaacagccccatcgcccagcctgccccaccccagcccctgcagctgcagggccacgagaacagctacagaagtgaggtgaaggcccggcaggatgtgaagccagacatccggcagccccccttcacagactaccggcagccccccctggactaccggcagcccccaggaggagactaccagcagcccccacccctggactaccggcagccccccctgctggactaccggcagcacagcccagacacccggcagtaccccctgagtgactaccggcagccccaggactttgactacttcaccgtggacatggagaagggggccaagggcttcggcttcagcatccggggcggccgggagtacaagatggacctgtatgtgctgcggctggccgaggatggccctgccatcagaaatggaaggatgagggtgggggaccagatcatcgagatcaacggggagagcacccgggacatgacccacgcccgggccatcgagctgatcaagagcggcggcagaagagtgcggctgctgctgaagaggggcaccggccaggtgcctgaatatgaccccccagccccagcccaggccgtgctgctgcgcttccggctgacagccttctag

SEQ ID NO: 35692 - DNA, 1653 bp, Artificial Sequence
  Description of Artificial Sequence: Synthetic coding sequence
atgatcagcgcccacaggaacctgtgcctgcctgacaactactacggcacccccaagcccccagctgagcccgcccccctgctgctgaatgtgacagaccagatcctgcccggggccacccccagcgctgagggcaagaggaagaggaacaagtctgtgagcaacatggagaaggccagcattgagcccccagaggaggaggaggaggagaggcctgtggtgaatggaaatggagtggtggtgaccccagagagcagcgagcacgaggacaagtctgctggggccagcggggagatgcccagccagccctacccagcccctgtgtacagccagcctgaggagctgaaggagcagatggatgacaccaagcccaccaagccagaggacaatgaggagccagaccccctgcctgacaactgggagatggcctacacagagaagggggaggtgtacttcatcgaccacaacaccaagaccacctcctggctggacccccggctggccaagaaggccaagcccccagaggagtgcaaggaaaatgagctgccctacggctgggagaagattgatgaccccatctacggcacctactacgtggaccacatcaacagaaggacccagtttgaaaatcctgtgctggaggccaagaggaagctgcagcagcacaacatgccccacacagagctgggcaccaagcccctgcaggcccctggcttccgggagaagcccctcttcaccagagatgccagccagctgaagggcaccttcctgagcaccaccctgaagaagagcaacatgggcttcggcttcaccatcattggaggagatgagccagatgagttcctgcaggtgaagagcgtcatcccagatggccctgctgcccaggacggcaagatggagactggagatgtgattgtgtacatcaatgaggtgtgtgtgctgggccacacccatgctgatgtggtgaagctgttccagagcgtgcccatcggccagagcgtgaacctggtgctgtgccggggctaccccctgccctttgatcctgaagatcctgccaacagcatggtgccccccctggccatcatggagaggcctcctcctgtgatggtgaatggccgccacaactatgagacctacctggagtacatcagcaggaccagccagagcgtgcctgacatcacagacaggcctccccacagcctgcacagcatgcccacagatggccagctggatggcacctacccacctcctgtgcatgatgacaacgtgtccatggccagcagcggggccacccaggccgagctgatgaccctgaccatcgtgaagggggcccagggcttcggcttcaccatcgctgacagccccaccggccagagggtgaagcagatcctggacatccagggctgccccggcctgtgtgagggggacctgattgtggagatcaaccagcagaatgtgcagaacctgagccacacagaggtggtggacatcctgaaggactgccccatcggcagcgagaccagcctcatcatccaccggggcggcaagaccaacacaggcagcgccatcaagtatgtgggcaagatcgtgggcagcttcaacaacatcgtgaagatgcagatcagcctggagctgaatgagatcatcctgtag

SEQ ID NO: 35693 - DNA, 1419 bp, Artificial Sequence
  Description of Artificial Sequence: Synthetic coding sequence
atgagccctgaggagtggacctacctggtggtgctgctgatcagcatccccatcggcttcctgttcaagaaggccggccctggcctgaagcgctggggcgctgctgctgtgggcctgggcctgaccctcttcacctgtggcccccacaccctgcacagcctggtgaccatcctgggcacctgggccctgatccaggcccagccctgcagctgccacgccctggccctggcctggaccttctcctacctgctcttcttccgggccctgagcctgctgggcctgcccacccccacccccttcaccaatgctgtgcagctgctgctgaccctgaagctggtgtccctggccagcgaggtgcaggacctgcacctggcccagaggaaggagatggccagcggcttcagcaagggccccaccctgggcctgctgcctgatgtgcccagcctgatggagaccctgagctacagctactgctacgtgggcatcatgacaggccccttcttccgctaccgcacctacctggactggctggagcagcccttccctggagctgtgcccagcctgcggcccctgctgcggcgggcctggccagcccccctgtttggcctgctcttcctgctgagcagccacctgttccccctggaggccgtgagagaagatgccttctacgcccggcccctgcctgcccggctcttctacatgatccctgtgttctttgccttcaggatgaggttctacgtggcctggattgctgctgaatgtggctgcatcgctgctggctttggagcctaccctgtggccgccaaggcccgggccggcggcggccccaccctgcagtgccccccacccagcagccctgagaaggccgccagcctggagtatgactatgagaccatccggaacatcgactgctacagcacagacttctgtgtgcgggtgagagatggcatgagatactggaacatgacagtgcagtggtggctggcccagtacatctacaagagcgccccagcccggagctatgtgctgcggagcgcctggaccatgctgctgagcgcctactggcacggcctgcaccctggctactacctgtccttcctgaccatccccctgtgcctggccgctgagggccgcctggagagcgccctgcggggccgcctgagccctgggggccagaaggcctgggactgggtgcactggttcctgaagatgagggcctatgactacatgtgcatgggctttgtgctgctgagcctggccgacaccctgcgctactgggccagcatctacttctgcatccacttcctggccctggccgccctgggcctgggcctggccctgggcggcggcagccccagcaggaggaaggccgccagccagcccaccagcctggcccctgagaagctgcgggaggagtag

SEQ ID NO: 35694 - DNA, 1200 bp, Artificial Sequence
  Description of Artificial Sequence: Synthetic coding sequence
atgggcagcagccgctgtggccctggggcccaccctgtgcacctgtggccaccccactttgccttcagcggccaccacccccgggacctgggcccccacagcggccctgccctgctggtgtccctggccagcgaggtgcaggacctgcacctggcccagaggaaggagatggccagcggcttcagcaagggccccaccctgggcctgctgcctgatgtgcccagcctgatggagaccctgagctacagctactgctacgtgggcatcatgacaggccccttcttccgctaccgcacctacctggactggctggagcagcccttccctggagctgtgcccagcctgcggcccctgctgcggcgggcctggccagcccccctgtttggcctgctcttcctgctgagcagccacctgttccccctggaggccgtgcgggaggatgccttctacgcccggcccctgcctgcccggctcttctacatgatccctgtgttctttgccttcaggatgaggttctacgtggcctggattgctgctgaatgtggctgcatcgccgccggctttggagcctaccctgtggccgccaaggcccgggccggcggcggccccaccctgcagtgccccccacccagcagccctgagaaggccgccagcctggagtatgactatgagaccatcagaaatattgactgctacagcacagacttctgtgtgcgggtgagagatggcatgagatactggaacatgacagtgcagtggtggctggcccagtacatctacaagagcgccccagcccggagctatgtgctgcggagcgcctggaccatgctgctgagcgcctactggcacggcctgcaccctggctactacctgtccttcctgaccatccccctgtgcctggccgctgagggccgcctggagagcgccctgcggggccgcctgagccctgggggccagaaggcctgggactgggtgcactggttcctgaagatgagggcctatgactacatgtgcatgggctttgtgctgctgagcctggccgacaccctgcgctactgggccagcatctacttctgcatccacttcctggccctggccgccctgggcctgggcctggccctgggcggcggcagccccagcaggaggaaggccgccagccagcccaccagcctggcccctgagaagctgcgggaggagtag

SEQ ID NO: 35695 - DNA, 1035 bp, Artificial Sequence
  Description of Artificial Sequence: Synthetic coding sequence
atgagccctgaggagtggacctacctggtggtgctgctgatcagcatccccatcggcttcctgttcaagaaggccggccctggcctgaagcgctggggcgctgctgctgtgggcctgggcctgaccctcttcacctgtggcccccacaccctgcacagcctggtgaccatcctgggcacctgggccctgatccaggcccagccctgcagctgccacgccctggccctggcctggaccttctcctacctgctcttcttccgggccctgagcctgctgggcctgcccacccccacccccttcaccaatgctgtgcagctgctgctgaccctgaagctggtgtccctggccagcgaggtgcaggacctgcacctggcccagaggaaggagatggccagcggcttcagcaagggccccaccctgggcctgctgcctgatgtgcccagcctgatggagaccctgagctacagctactgctacgtgggcatcatgacaggccccttcttccgctaccgcacctacctggactggctggagcagcccttccctggagctgtgcccagcctgcggcccctgctgcggcgggcctggccagcccccctgtttggcctgctcttcctgctgagcagccacctgttccccctggaggccgtgagagaagatgccttctacgcccggcccctgcctgcccggctcttctacatgatccctgtgttctttgccttcaggatgaggttctacgtggcctggattgctgctgaatgtggctgcatcgctgctggctttggagcctaccctgtggccgccaaggcccgggccggcggcggccccaccctgcagtgccccccacccagcagccctgagaaggccgccagcctggagtatgactatgagaccatccggaacatcgactgctacagcacagacttctgtgtgcgggtgagagatggcatgagatactggaacatgacagtgcagtggtggctggcccagtacatctacaagagcgccccagcccggagctatgtgctgaggtag

SEQ ID NO: 35696 - DNA, 771 bp, Artificial Sequence
  Description of Artificial Sequence: Synthetic coding sequence
atgagccctgaggagtggacctacctggtggtgctgctgatcagcatccccatcggcttcctgttcaagaaggccggccctggcctgaagcgctggggcgctgctgctgtgggcctgggcctgaccctcttcacctgtggcccccacaccctgcacagcctggtgaccatcctgggcacctgggccctgatccaggcccagccctgcagctgccacgccctggccctggcctggaccttctcctacctgctcttcttccgggccctgagcctgctgggcctgcccacccccacccccttcaccaatgctgtgcagctgctgctgaccctgaagctggtgtccctggccagcgaggtgcaggacctgcacctggcccagaggaaggagatggccagcggcttcagcaagggccccaccctgggcctgctgcctgatgtgcccagcctgatggagaccctgagctacagctactgctacgtgggcatcatgacaggccccttcttccgctaccgcacctacctggactggctggagcagcccttccctggagctgtgcccagcctgcggcccctgctgcggcgggcctggccagcccccctgtttggcctgctcttcctgctgagcagccacctgttccccctggaggccgtgagagaagatgccttctacgcccggcccctgcctgcccggctcttctacatgatccctgtgttctttgccttcaggatgaggttctacgtggcctggattgctgctgaatgtggctgctag

SEQ ID NO: 35697 - DNA, 1200 bp, Artificial Sequence; identical to SEQ ID NO: 35694
  Description of Artificial Sequence: Synthetic coding sequence

SEQ ID NO: 35698 - DNA, 513 bp, Artificial Sequence
  Description of Artificial Sequence: Synthetic coding sequence
atgagccctgaggagtggacctacctggtggtgctgctgatcagcatccccatcggcttcctgttcaagaaggccggccctggcctgaagcgctggggcgctgctgctgtgggcctgggcctgaccctcttcacctgtggcccccacaccctgcacagcctggtgaccatcctgggcacctgggccctgatccaggcccagccctgcagctgccacgccctggccctggcctggaccttctcctacctgctcttcttccgggccctgagcctgctgggcctgcccacccccacccccttcaccaatgctgtgcagctgctgctgaccctgaagctggtgtccctggccagcgaggtgcaggacctgcacctggcccagaggaaggagatggccagcggcttcagcaagggccccaccctgggcctgctgcctgatgtgcccagcctgatggagaccctgagctacagctactgctacgtgggcatcatgacaggccccttcttccgctactag

SEQ ID NO: 35699 - DNA, 1740 bp, Artificial Sequence
  Description of Artificial Sequence: Synthetic coding sequence
atgaaggacttcagtgatgtgatcctgtgcatggaggccacagagagcagcaagacagagttctgcaacccagcctttgagcctgagagcggccccccctgccccccacctgtgtttcctgaagatgccagctacagcgtgcctgccccctggcacggccggcggccccggggcctgcggccagactgccgcttctcctggctgtgtgtgctgctgctgagcagcctgctgctgctgctgctgggcctgctggtggccatcatcctggcccagctgcaggccgccccacccagcggggccagccacagccccctgcctgctgggggcctgaccaccaccaccaccacccccaccatcaccaccagccaggccgccggcacccccaagggccagcaggagagcggcgtgagccccagcccccagagcacctgtggcggcctgctgagcggcccccggggcttcttcagcagccccaactacccagacccctacccacccaacacccactgtgtgtggcacatccaggtggccacagaccacgccatccagctgaagattgaggccctgagcattgaatctgtggccagctgcctgtttgaccggctggagctgagccctgagcctgagggccccctgctgcgggtgtgtggccgggtgcccccacccaccctgaacaccaatgccagccacctgctggtggtgtttgtgtctgacagctctgtggagggcttcggcttccacgcctggtaccaggccatggcccctggccggggcagctgtgcccatgatgagttccgctgtgaccagctgatctgcctgctgcctgattctgtgtgtgatggctttgccaactgtgctgatggcagtgatgagaccaactgcagcgccaagttcagcggctgcggcggcaacctgaccggcctgcagggcaccttcagcacccccagctacctgcagcagtacccccaccagctgctgtgcacctggcacatctctgtgcctgctggccacagcattgagctgcagttccacaacttcagcctggaggcccaggatgagtgcaagtttgattatgtggaggtgtatgagaccagcagcagcggggccttcagcctgctgggccgcttctgtggggctgagcccccaccccacctggtgagcagccaccacgagctggccgtgctcttcagaacagaccacggcatcagcagcggcggcttcagcgccacctacctggccttcaatgccacagagaacccctgtggccccagcgagctgagctgccaggccggcggctgcaagggcgtgcagtggatgtgtgacatgtggagggactgcacagatggcagtgatgacaactgcagcggccccctcttccccccacctgagctggcctgtgagcctgtgcaggtggagatgtgcctgggcctgagctacaacaccacagccttccccaacatctgggtgggcatgatcacccaggaggaggtggtggaggtgctgagcggctacaagagcctgaccagcctgccctgctaccagcacttccggcggctgctgtgtggcctgctggtgccccgctgcacccccctgggctctgtgctgcccccctgccgctctgtgtgccaggaggccgagcaccagtgccagagcggcctggccctgctgggcaccccctggcccttcaactgcaaccggctgcctgaggccgctgacctggaggcctgtgcccagccctag

SEQ ID NO: 35700 - DNA, 1740 bp, Artificial Sequence; identical to SEQ ID NO: 35699
  Description of Artificial Sequence: Synthetic coding sequence

SEQ ID NO: 35701 - DNA, 396 bp, Artificial Sequence
  Description of Artificial Sequence: Synthetic coding sequence
atggcccccagcctgtggaagggcctggtgggcatcggcctgtttgccctggcccacgccgccttctctgctgcccagcacaggagctacatgaggctgacagagaaggaggatgagagcctgcccattgatattgtgctgcagaccctgctggcctttgctgtgacctgctacggcatcgtgcacatcgccggggagttcaaggacatggatgccaccagcgagctgaagaacaagacctttgacaccctgaggaaccaccccagcttctacgtgttcaaccaccggggccgggtgctcttccggcccagcgacacagccaacagcagcaaccaggatgccctgagcagcaacaccagcctgaagctgaggaagctggagagcctgcggaggtag

SEQ ID NO: 35702 - DNA, 591 bp, Artificial Sequence
  Description of Artificial Sequence: Synthetic coding sequence
atgacccccctgggcagcggccccccccgggaggccagcatcgcccagcccagcggcttcagcaccacagagaccctgtgtgcccaggacttcagtgatgtgatcttcctgcggcgggctgacacccggcgctggaagaagaagcagctgcggcggcccagcctgctgctgctgggctgctgcagctttggcatcatggcccccagcctgtggaagggcctggtgggcatcggcctgtttgccctggcccatgctgccttctctgctgcccagcacaggagctacatgaggctgacagagaaggaggatgagagcctgcccatcgacatcgtgctgcagaccctgctggcctttgctgtgacctgctatggaattgtgcacatcgccggggagttcaaggacatggatgccaccagcgagctgaagaacaagacctttgacaccctgaggaaccaccccagcttctacgtgttcaaccaccggggccgggtgctcttccggcccagcgacacagccaacagcagcaaccaggatgccctgagcagcaacaccagcctgaagctgaggaagctggagagcctgcggaggtag

SEQ ID NO: 35703 - DNA, 2139 bp, Artificial Sequence
  Description of Artificial Sequence: Synthetic coding sequence
atggagagcaccagccaggaccggcgggccacccacgtgatcaccatcaagcccaatgaaacagtgctgacagccttcccctaccggccccacagcagcctgctggacttcctgaagggggagccccgggtgctgggcgccacccagatcctgctggccctgatcatcgtgggcttcggcaccatctttgccctgaactacatcggcttcagccagaggctgcccctggtggtgctgaccggctaccccttctggggcgccctgatcttcatcctgaccggctacctgactgtgacagacaagaagagcaagctgctgggccagggcgtgacaggcatgaatgtcatcagcagcctggtggccatcaccggcatcaccttcaccatcctgagctaccgccaccaggacaagtactgccagatgcccagctttgaggagatctgtgtgttcagcaggaccctcttcatcggcatcctgctgatcctgctgatcatcagcattgctgagctgagcatctctgtgaccatcgccagcttccgcagcaagtgctggacccagagtgatgaggtgctcttcttcctgcccagtgatgtgacccagaacagcgagcagcctgccccagaagaaaatgaccagctgcagtttgtgctgcaggaggagttcagcagtgatgacagcaccaccaatgcccagagcgtcatctttggaggctacgccttcttcaagctgaccctgagccgcagccccctggtgtcccagcccggcaacaagggccgggagtttgtgcctgatgagcagaagcagagcatcctgcccagccccaagttcagcgaggaggagattgagcccctgccccccaccctggagaagaagcccagcgagaacatgagcatccagctggacagcaccttcaagcagatgaaggatgaggacctgcagagcgccatcgtgcagcccagccagatgcagaccaagctgctgcaggaccaggccgccagcctgcaggtgttccccagccacagcgccctgaagctggaggacatcagccctgaggacctgcccagccaggccctgcctgtggagggcctgtctgagcagaccatgcccagcaagagcaccagcagccacgtgaagcagagcagcaacctgacagccaatgacctgcccccccagggcatcctgagccaggacaccagcagccaggacatgctgttccatgacatgaccagccaggacatgcagagcctggacatgctgagccaggacacccccagccacgccatgccaccccaggacatccccagccaggacatgctgagccaggccctgagcgcccacgccatcctgcctgaggccagcaccagccacatcgtgcagtttcctgagatccagcacctgctgcagcagcccccagacctgcagcctgagaacacagagccccagaaccagcagatcctgcagatgagctaccaggacatccgctctgaggtgatggaggagaccaaggagtggaagtctgaggaggagctgcacaggaggaagagcagcagaagacacagcctgaaccagcagaccaaggccctgcagtacctgcggcggcacagcctggatgtgcaggccaagggccagaagagcagcaagaggcacagcctggaccagcagagcaagggctggcagagccccaagcagaagagcctggaccagcagatcaaggactggctgagccccaagaggcacagcgtggacaagcaggcccagctgaaccagaccaaggagcagctgcctgaccagcaggccgaggaccagcaggccaagggggagcagtacccagagggccagagcaaggatggccaggtgaaggaccagcagacagacaaggagcagaacagcaagaagcagacccaggaccagcagacagaggaccagcctgcccaggagaagaagagccccaagggccagttccagaatgtgcaggccgagggccagcaggcccaggtggagaaggtgcccaagctgctgtgccaggacagcgagagccagatccagcagtaccagttctggcagttccacaagggcaacctgcaggccggccagcccaggacagtgaacctgctggccaagaaccccctgactggatag

SEQ ID NO: 35704 - DNA, 339 bp, Artificial Sequence
  Description of Artificial Sequence: Synthetic coding sequence
atgattggcatcttccacatcttcatgtggtacttcctgctggtgctgtacatgggccagatcaagggggccttcggcacctatgagcctgtgacctacaagacaggctgcaccctgtggggcatcttcttcatcatcgccggggtcttcctgatccgggtgaccaagtaccccaccaggtctgggaagctgggccgggaggtgagccgcatcctgctcttcttctacggcctggagttcagcatcgccctgacccacagcatctacagctgcagcaacctcttccggcggcagaatgacctgacctctgtgacagaggaggccgagagcaccccctag

SEQ ID NO: 35705 - DNA, 459 bp, Artificial Sequence
  Description of Artificial Sequence: Synthetic coding sequence
atgattggcatcttccacatcttcatgtggtacttcctgctggtgctgtacatgggccagatcaagggggccttcggcacctatgagcctgtgacctacaagacaggctgcaccctgtggggcatcttcttcatcatcgccggggtcttcctgatccgggtgaccaagtaccccaccaggagcggcatcatcagcaccctcatcatcaacatcatctgcatcatcaccaccatcacagctgtgaccctgaccatcatcgagctgagccacttcaacagcgtgtcctacagaaattatggccaggccaagctgggccgggaggtgagccgcatcctgctcttcttctacggcctggagttcagcatcgccctgacccacagcatctacagctgcagcaacctcttccggcggcagaatgacctgacctctgtgacagaggaggccgagagcaccccctag

SEQ ID NO: 35706 - DNA, 282 bp, Artificial Sequence
  Description of Artificial Sequence: Synthetic coding sequence
atgattggcatcttccacatcttcatgtggtacttcctgctggtgctgtacatgggccagatcaagggggccttcggcacctatgagcctgtgacctacaagacaggctgcaccctgtggggcatcttcaagctgggccgggaggtgagccgcatcctgctcttcttctacggcctggagttcagcatcgccctgacccacagcatctacagctgcagcaacctcttccggcggcagaatgacctgacctctgtgacagaggaggccgagagcaccccctag

SEQ ID NO: 35707 - DNA, 2040 bp, Artificial Sequence
  Description of Artificial Sequence: Synthetic coding sequence
atggagagcaccagccaggaccggcgggccacccacgtgatcaccatcaagcccaatgaaacagtgctgacagccttcccctaccggccccacagcagcctgctggacttcctgaagggggagccccgggtgctgggcgccacccagatcctgctggccctgatcatcgtgggcttcggcaccatctttgccctgaactacatcggcttcagccagaggctgcccctggtggtgctgaccggctaccccttctggggcgccctgatcttcatcctgaccggctacctgactgtgacagacaagaagagcaagctgctgggccagggcgtgacaggcatgaatgtcatcagcagcctggtggccatcaccggcatcaccttcaccatcctgagctaccgccaccaggacaagtactgccagatgcccagctttgaggagatctgtgtgttcagcaggaccctcttcatcgtgctcttcttcctgcccagtgatgtgacccagaacagcgagcagcctgcccctgaggagaatgaccagctgcagtttgtgctgcaggaggagttcagcagtgatgacagcaccaccaatgcccagagcgtcatctttggaggctacgccttcttcaagctgaccctgagccgcagccccctggtgtcccagcccggcaacaagggccgggagtttgtgcctgatgagcagaagcagagcatcctgcccagccccaagttcagcgaggaggagattgagcccctgccccccaccctggagaagaagcccagcgagaacatgagcatccagctggacagcaccttcaagcagatgaaggatgaggacctgcagagcgccatcgtgcagcccagccagatgcagaccaagctgctgcaggaccaggccgccagcctgcaggtgttccccagccacagcgccctgaagctggaggacatcagccctgaggacctgcccagccaggccctgcctgtggagggcctgtctgagcagaccatgcccagcaagagcaccagcagccacgtgaagcagagcagcaacctgacagccaatgacctgcccccccagggcatcctgagccaggacaccagcagccaggacatgctgttccatgacatgaccagccaggacatgcagagcctggacatgctgagccaggacacccccagccacgccatgccaccccaggacatccccagccaggacatgctgagccaggccctgagcgcccacgccatcctgcctgaggccagcaccagccacatcgtgcagtttcctgagatccagcacctgctgcagcagcccccagacctgcagccagaaaatacagagccccagaaccagcagatcctgcagatgagctaccaggacatccgctctgaggtgatggaggagaccaaggagtggaagtctgaggaggagctgcacaggaggaagagcagccgccgccacagcctgaaccagcagaccaaggccctgcagtacctgcggcggcacagcctggatgtgcaggccaagggccagaagagcagcaagaggcacagcctggaccagcagagcaagggctggcagagccccaagcagaagagcctggaccagcagatcaaggactggctgagccccaagaggcacagcgtggacaagcaggcccagctgaaccagaccaaggagcagctgcctgaccagcaggccgaggaccagcaggccaagggggagcagtacccagagggccagagcaaggatggccaggtgaaggaccagcagacagacaaggagcagaacagcaagaagcagacccaggaccagcagacagaggaccagcctgcccaggagaagaagagccccaagggccagttccagaatgtgcaggccgagggccagcaggcccaggtggagaaggtgcccaagctgctgtgccaggacagcgagagccagatccagcagtaccagttctggcagttccacaagggcaacctgcaggccggccagcccaggacagtgaacctgctggccaagaaccccctgaccggctag

SEQ ID NO: 35708 - DNA, 177 bp, Artificial Sequence
  Description of Artificial Sequence: Synthetic coding sequence
atgaatgtcatcagcagcctggtggccatcaccggcatcaccttcaccatcctgagctaccgccaccaggacaagtactgccagatgcccagctttgaggagatctgtgtgttcagcaggaccctcttcatcgacttcatcctgctgaccccaccccacagcagccacttcctgtag

SEQ ID NO: 35709 - DNA, 1989 bp, Artificial Sequence
  Description of Artificial Sequence: Synthetic coding sequence
atggagagcaccagccaggaccggcgggccacccacgtgatcaccatcaagcccaatgaaacagtgctgacagccttcccctaccggccccacagcagcctgctggacttcctgaagggggagccccgggtgctgggcgccacccagatcctgctggccctgatcatcgtgggcttcggcaccatctttgccctgaactacatcggcttcagccagaggctgcccctggtggtgctgaccggctaccccttctggggcgccctgattggccagggcgtgacaggcatgaatgtcatcagcagcctggtggccatcaccggcatcaccttcaccatcctgagctaccgccaccaggacaagtactgccagatgcccagctttgaggagatctgtgtgttcagcaggaccctcttcatcgtgctcttcttcctgcccagtgatgtgacccagaacagcgagcagcctgccccagaagaaaatgaccagctgcagtttgtgctgcaggaggagttcagcagtgatgacagcaccaccaatgcccagagcgtcatctttggaggctacgccttcttcaagctgaccctgagccgcagccccctggtgtcccagcccggcaacaagggccgggagtttgtgcctgatgagcagaagcagagcatcctgcccagccccaagttcagcgaggaggagattgagcccctgccccccaccctggagaagaagcccagcgagaacatgagcatccagctggacagcaccttcaagcagatgaaggatgaggacctgcagagcgccatcgtgcagcccagccagatgcagaccaagctgctgcaggaccaggccgccagcctgcaggtgttccccagccacagcgccctgaagctggaggacatcagccctgaggacctgcccagccaggccctgcctgtggagggcctgtctgagcagaccatgcccagcaagagcaccagcagccacgtgaagcagagcagcaacctgacagccaatgacctgcccccccagggcatcctgagccaggacaccagcagccaggacatgctgttccatgacatgaccagccaggacatgcagagcctggacatgctgagccaggacacccccagccacgccatgccaccccaggacatccccagccaggacatgctgagccaggccctgagcgcccacgccatcctgcctgaggccagcaccagccacatcgtgcagtttcctgagatccagcacctgctgcagcagcccccagacctgcagcctgagaacacagagccccagaaccagcagatcctgcagatgagctaccaggacatccgctctgaggtgatggaggagaccaaggagtggaagtctgaggaggagctgcacaggaggaagagcagcagaagacacagcctgaaccagcagaccaaggccctgcagtacctgcggcggcacagcctggatgtgcaggccaagggccagaagagcagcaagaggcacagcctggaccagcagagcaagggctggcagagccccaagcagaagagcctggaccagcagatcaaggactggctgagccccaagaggcacagcgtggacaagcaggcccagctgaaccagaccaaggagcagctgcctgaccagcaggccgaggaccagcaggccaagggggagcagtacccagagggccagagcaaggatggccaggtgaaggaccagcagacagacaaggagcagaacagcaagaagcagacccaggaccagcagacagaggaccagcctgcccaggagaagaagagccccaagggccagttccagaatgtgcaggccgagggccagcaggcccaggtggagaaggtgcccaagctgctgtgccaggacagcgagagccagatccagcagtaccagttctggcagttccacaagggcaacctgcaggccggccagcccaggacagtgaacctgctggccaagaaccccctgactggatag

SEQ ID NO: 35710 - DNA, 1704 bp, Artificial Sequence
  Description of Artificial Sequence: Synthetic coding sequence
atgaatgtcatcagcagcctggtggccatcaccggcatcaccttcaccatcctgagctaccgccaccaggacaagtactgccagatgcccagctttgaggagatctgtgtgttcagcaggaccctcttcatcgtgctcttcttcctgcccagtgatgtgacccagaacagcgagcagcctgcccctgaggagaatgaccagctgcagtttgtgctgcaggaggagttcagcagtgatgacagcaccaccaatgcccagagcgtcatctttggaggctacgccttcttcaagctgaccctgagccgcagccccctggtgtcccagcccggcaacaagggccgggagtttgtgcctgatgagcagaagcagagcatcctgcccagccccaagttcagcgaggaggagattgagcccctgccccccaccctggagaagaagcccagcgagaacatgagcatccagctggacagcaccttcaagcagatgaaggatgaggacctgcagagcgccatcgtgcagcccagccagatgcagaccaagctgctgcaggaccaggccgccagcctgcaggtgttccccagccacagcgccctgaagctggaggacatcagccctgaggacctgcccagccaggccctgcctgtggagggcctgtctgagcagaccatgcccagcaagagcaccagcagccacgtgaagcagagcagcaacctgacagccaatgacctgcccccccagggcatcctgagccaggacaccagcagccaggacatgctgttccatgacatgaccagccaggacatgcagagcctggacatgctgagccaggacacccccagccacgccatgccaccccaggacatccccagccaggacatgctgagccaggccctgagcgcccacgccatcctgcctgaggccagcaccagccacatcgtgcagtttcctgagatccagcacctgctgcagcagcccccagacctgcagccagaaaatacagagccccagaaccagcagatcctgcagatgagctaccaggacatccgctctgaggtgatggaggagaccaaggagtggaagtctgaggaggagctgcacaggaggaagagcagccgccgccacagcctgaaccagcagaccaaggccctgcagtacctgcggcggcacagcctggatgtgcaggccaagggccagaagagcagcaagaggcacagcctggaccagcagagcaagggctggcagagccccaagcagaagagcctggaccagcagatcaaggactggctgagccccaagaggcacagcgtggacaagcaggcccagctgaaccagaccaaggagcagctgcctgaccagcaggccgaggaccagcaggccaagggggagcagtacccagagggccagagcaaggatggccaggtgaaggaccagcagacagacaaggagcagaacagcaagaagcagacccaggaccagcagacagaggaccagcctgcccaggagaagaagagccccaagggccagttccagaatgtgcaggccgagggccagcaggcccaggtggagaaggtgcccaagctgctgtgccaggacagcgagagccagatccagcagtaccagttctggcagttccacaagggcaacctgcaggccggccagcccaggacagtgaacctgctggccaagaaccccctgaccggctag

SEQ ID NO: 35711 - DNA, 444 bp, Artificial Sequence
  Description of Artificial Sequence: Synthetic coding sequence
atggtgagaagaggccacgtgggcatcttcttcatcgagggcggcgtgcccttctggggcggggcctgcttcatcatcagcggcagcctgtctgtggccgctgagaagaaccacaccagctgcctggtgcgcagcagcctgggcaccaacatcctgtctgtgatggccgcctttgctggaacagccatcctgctgatggactttggagtgaccaacagagatgtggaccggggctacctggccgtgctgaccatcttcaccgtgctggagttcttcaccgctgtgattgccatgcacttcggctgccaggccatccacgcccaggccagcgcccctgtgatcttcctgcccaatgccttctctgctgacttcaacatccccagccctgctgccagcgcccccccagcctatgacaacgtggcctatgcccagggcgtggtgtag

SEQ ID NO: 35712 - DNA, 723 bp, Artificial Sequence
  Description of Artificial Sequence: Synthetic coding sequence
atgtctgctgccccagccagcaatggagtgtttgtggtgattcctcccaacaatgccagcggcctgtgccccccaccagccatcctgcccacctccatgtgccagcccccaggcatcatgcagtttgaggagccccccctgggcgcccagaccccccgggccacccagcccccagacctgcggcctgtggagaccttcctgaccggggagcccaaggtgctgggcaccgtgcagatcctgattggcctcatccacctgggcttcggctctgtgctgctgatggtgcggcggggccacgtgggcatcttcttcattgaaggaggagtgcccttctggggcggggcctgcttcatcatcagcggcagcctgtctgtggccgctgagaagaaccacaccagctgcctggtgcgcagcagcctgggcaccaacatcctgtctgtgatggccgcctttgctggaacagccatcctgctgatggactttggagtgaccaacagagatgtggaccggggctacctggccgtgctgaccatcttcaccgtgctggagttcttcaccgctgtgattgccatgcacttcggctgccaggccatccacgcccaggccagcgcccctgtgatcttcctgcccaatgccttctctgctgacttcaacatccccagccctgctgccagcgcccccccagcctatgacaacgtggcctatgcccagggcgtggtgtag

SEQ ID NO: 35713 - DNA, 3162 bp, Artificial Sequence
  Description of Artificial Sequence: Synthetic coding sequence
atggaggtgtctggggaccccggcatcccagccctgcaccggctgtgcacccgggccctgagcgccagccctggccccacagccctgggccccagcaccttcctgccctgggatgtgtctgccaggatgaccagcgcccggcggaggacagatgtgggcccccgggtggccttcacctacccctgcacccagctgagccccacccgggcccaccgccacctgcctgtgcacacagtgacctacccctgcacccagctgagccccacccgggcccacagctgccacctgcccatgcacacagtgacctacccctgcacccccagccccacccgggcccacagctgccacctgcctgtgcacacagtgacctacacctgcaccctgagccccacccacgcctgcctgcacgccagcacagtgtcctgcctgtgctgcatccctgtgcacacagtgacctacccctgcaccctgagccccacctgtgcccactgccacctgcacatgagggcccggacccacccccagccccacgcctgtgctgtgtacctgtgcatcctgagccccacccgggcccactgccacctgcacgtgcacacagtgacctacatgtgtgtgcctgcctgcacccacagcatcacccctgtgcacgcccccccagacaccagctgtgcctgggcccaggccgtgcaccgctggcctgtgctgtggggcagccgcagcagctccatgagcagcggcctgaagcagacccccatggtgggcgtgacaggccccccctgggaccctgatgccccagccccagccccagctggcaccctgacagcccacctgatccctggggccctgcagagcagcggcctgaccctgctgctgagcctggccgcccactgcagcggcccccaggccaaggtgctgagccctgggggcctggatgccagcggggccaacctgtgggccagcgccaactgcagcctgctgcagggcttctggtgccagcctgccagccagctgccccgggaccagctgagcgccctgatccagaggctggccctgctgcaggtgcccctgcaggcctggcaggtgtctgggaaggaatgtagaggagctggcactggaggaagaggagatgaccccacctgtgggaagaggggccgggaggtgggcggggactggggcctgcggcccccccagaggggccgggcccccaccggctgccacggggagagccgggtgacccgggagaggagaagtgcccagctgagctgcctggccaacctggccagccgctgtggcctgcaggatgacttcaccctgcacccccccaacctgctgctcttctacaacctgagccaggtgcgggaggccgactgccgggccttcatccggcgggccgcccagggagatgtggagctgctgagccacctgcctgaccagagggtggccctgtggagggctgctgtggcctgcctggtgggcgccggctggggctgggcccgctgcattggaggcagcctgcccctgggcgctgacctgctggccctgcagggcgtggcccggctgcggctgagcgccagtgaccagcagctgctgggcgccctggtgtgtgacatggatgccagcagcatcggggctgctgacccccacatgctggagaacctgcggcgctgcccccggctgacagctgcccagagaattgccctgaacagcctgctggccggcggcaagaccagcctgggccccccaggctcctggaccctggagggcctgcaggccctgggccccctggccacctacatcagcccccacctgtgggcccaggtgcaggaggccgtgggcctgggcttcttccgctctgtggtggccagctgccaggtgggccgcctgggccagcgggaggcccgctgctttgtgaccagcttcctggagagcaagaccaagcctgtgagcagccggccccggctgagcacaggcaacatcacagctgccaccctgagagatgacctcttcctggtgcactatgactgtgccgagctggagagctgcctggatggctgcatcctgcggaccaacctggacaccctgctgcagcacctgctgcccacagagtgccagcacgtggtgaaggccaagctggcccagatctacccccagggcctgcctgaggaccagctgcggctcatcaccagcctggtgtacctgtacagcaggacagaaattggccagtggagcatcaccagccaggacacagtgatggccctgctggccagtgatgtggccctggagaaccagacagaggccgtgctgcagaagttcctggagcacaatggaacagtgtctggggccctgctgctggccatcggcggcacccggctgtgctggatgagcccccaccagatccagaccatccacccccaggagctgcggctggccggggccctggacctgagcagctgcccccagagcaggaaggatgtgctgtacaccaaggcccacgagaccttcggcagcagcggcaccctggccgcctactaccgcctgatgaggccctacctgggcggcagccctggaggagcccagccccccagccctgtgcccccaggaggagcccctgtggaggagctgcggcacctggcccacgccaacatctccatggacatcgacaccttcaccagcctgaaccccctggagctgcagagcctggatgtgggcaatgtgacagccctgctgggccacaacgtgggggacctgcagaaggcccggagccaccccaccgtgcgggcctggctgcggagcctgaacagcagcaccctgggccagctgggcctggatgccagccccaccagccccaccggccctgcccacggcacccggggcccccccagcaccacccaccaggtgctgcacctggtgcacaccagcggcctgcccaccaatgatgcccaggccagcaccagcggcagcctgtgggcccccctgggctacctgcccctggccatggccctgccctgcagcctgctgtgcctgctgcactggggcacctgcatcctggtgtctgtggacagcgtggccagcggctggctgggcagccagggcagcggggccggcaagacagaggtgctggacagcgctggccggcccctgggcctgaccggccagctgtag

SEQ ID NO: 35714 - DNA, 2109 bp, Artificial Sequence
  Description of Artificial Sequence: Synthetic coding sequence
atggctgctgctgtgaccatccctggcccccgcatcggggccctgcagagcagcggcctgaccctgctgctgagcctggccgcccactgcagcggcccccaggccaaggtgctgagccctgggggcctggatgccagcggggccaacctgtgggccagcgccaactgcagcctgctgcagggcttctggtgccagcctgccagccagctgccccgggaccagctgagcgccctgatccagaggctggccctgctgcaggtgcccctgcaggcctggcagctgagctgcctggccaacctggccagccgctgtggcctgcaggatgacttcaccctgcacccccccaacctgctgctcttctacaacctgagccaggtgcgggaggccgactgccgggccttcatccggcgggccgcccagggagatgtggagctgctgagccacctgcctgaccagagggtggccctgtggagggctgctgtggcctgcctggtgggcgccggcctgcggctgagcgccagtgaccagcagctgctgggcgccctggtgtgtgacatggatgccagcagcattggagctgctgacccccacatgctggagaacctgcggcgctgcccccggctgacagctgcccagagaattgccctgaacagcctgctggccggcggcaagaccagcctgggccccccaggctcctggaccctggagggcctgcaggccctgggccccctggccacctacatcagcccccacctgtgggcccaggtgcaggaggccgtgggcctgggcttcttccgctctgtggtggccagctgccaggtgggccgcctgggccagcgggaggcccgctgctttgtgaccagcttcctggagagcaagaccaagcctgtgagcagccggccccggctgagcactggaaacatcacagctgccaccctgagagatgacctcttcctggtgcactatgactgtgccgagctggagagctgcctggatggctgcatcctgcggaccaacctggacaccctgctgcagcacctgctgcccacagagtgccagcacgtggtgaaggccaagctggcccagatctacccccagggcctgcctgaggaccagctgcggctcatcaccagcctggtgtacctgtacagcaggacagagatcggccagtggagcatcaccagccaggacacagtgatggccctgctggccagtgatgtggccctggagaaccagacagaagctgtgctgcagaagttcctggagcacaacggcaccgtgtctggggccctgctgctggccatcggcggcacccggctgtgctggatgagcccccaccagatccagaccatccacccccaggagctgcggctggccggggccctggacctgagcagctgcccccagagcaggaaggatgtgctgtacaccaaggcccacgagaccttcggcagcagcggcaccctggccgcctactaccgcctgatgaggccctacctgggcggcagccctgggggcgcccagccccccagccctgtgcccccaggaggagcccctgtggaggagctgcggcacctggcccacgccaacatctccatggacatcgacaccttcaccagcctgaaccccctggagctgcagagcctggatgtgggcaatgtgacagccctgctgggccacaacgtgggggacctgcagaaggcccggagccaccccaccgtgcgggcctggctgcggagcctgaacagcagcaccctgggccagctgggcctggatgccagccccaccagccccactggacctgcccacggcacccggggcccccccagcaccacccaccaggtgctgcacctggtgcacaccagcggcctgcccaccaatgatgcccaggccagcaccagcggcagcctgtgggcccccctgggctacctgcccctggccatggccctgccctgcagcctgctgtgcctgctgcactggggcacctgcatcctggtgtctgtggacagcgtggccagcggctggctgggcagccagggcagcggggccggcaagacagaggtgctggacagcgctggccggcccctgggcctgaccggccagctgtag

SEQ ID NO: 35715 - DNA, 792 bp, Artificial Sequence
  Description of Artificial Sequence: Synthetic coding sequence
atgagcctggtggccgaggcctttgtgtcccagattgctgctgctgagccctggccagaaaatgccaccctgtaccagcagctgaagggggagcagatcctgctgagtgacaatgctgccagcctggccgtgcaggccttcctgcagatgtgcaacctgcccatcaaggtggtgtgccgggccaatgctgagtacatgagccccagcggcaaggtgcccttcatccacgtgggcaaccaggtggtgtctgagctgggccccatcgtgcagtttgtgaaggccaagggccacagcctgagtgatggcctggaggaggtgcagaaggccgagatgaaggcctacatggagctggtgaacaacatgctgctgacagctgagctgtacctgcagtggtgtgatgaggccaccgtgggggagatcacccacgcccgctatggcagcccctacccctggcccctgaaccacatcctggcctaccagaagcagtgggaggtgaagaggaagatgaaggccatcggctggggcaagaagaccctggaccaggtgctggaggatgtggaccagtgctgccaggccctgagccagaggctgggcacccagccctacttcttcaacaagcagcccacagagctggatgccctggtgtttggccacctgtacaccatcctgaccacccagctgaccaatgatgagctgtctgagaaggtgaagaactacagcaacctgctggccttctgcagaagaattgagcagcactactttgaagatcggggcaagggccgcctgtcctag

SEQ ID NO: 35716 - DNA, 762 bp, Artificial Sequence
  Description of Artificial Sequence: Synthetic coding sequence
atgtacatcgctgctgagccctggccagaaaatgccaccctgtaccagcagctgaagggggagcagatcctgctgagtgacaatgctgccagcctggccgtgcaggccttcctgcagatgtgcaacctgcccatcaaggtggtgtgccgggccaatgctgagtacatgagccccagcggcaaggtgcccttcatccacgtgggcaaccaggtggtgtctgagctgggccccatcgtgcagtttgtgaaggccaagggccacagcctgagtgatggcctggaggaggtgcagaaggccgagatgaaggcctacatggagctggtgaacaacatgctgctgacagctgagctgtacctgcagtggtgtgatgaggccaccgtgggggagatcacccacgcccgctatggcagcccctacccctggcccctgaaccacatcctggcctaccagaagcagtgggaggtgaagaggaagatgaaggccatcggctggggcaagaagaccctggaccaggtgctggaggatgtggaccagtgctgccaggccctgagccagaggctgggcacccagccctacttcttcaacaagcagcccacagagctggatgccctggtgtttggccacctgtacaccatcctgaccacccagctgaccaatgatgagctgtctgagaaggtgaagaactacagcaacctgctggccttctgcagaagaattgagcagcactactttgaagatcggggcaagggccgcctgtcctag

SEQ ID NO: 35717 - DNA, 477 bp, Artificial Sequence
  Description of Artificial Sequence: Synthetic coding sequence
atggccgcccccctggagctgagctgctggggcggcggctggggcctgcccagcgtgcacagcgagagcctggtggtgatggcctatgccaagttcagcggggcccccctgaaggtgaatgtcatcgacaacacctggaggggcagcagaggagatgtgcccatcctgaccacagaagatgacatggtgtcccagcctgccaagatcctgaacttcctgaggaagcagaagtacaatgctgactatgagctgagcgccaagcagggcgctgacaccctggcctacatcgccctgctggaggagaagctgctgcctgctgtgctgcacaccttctgggtggagagtgacaactacttcaccgtgaccaagccctggtttgccagccagatccccttccccctgagcctcatcctgcccggccgcatgagcaagcagatcctgagcagcagagctggcacccacatgctgaggaagtag

SEQ ID NO: 35718 - DNA, 747 bp, Artificial Sequence
  Description of Artificial Sequence: Synthetic coding sequence
atggccgcccccctggagctgagctgctggggcggcggctggggcctgcccagcgtgcacagcgagagcctggtggtgatggcctatgccaagttcagcggggcccccctgaaggtgaatgtcatcgacaacacctggaggggcagcagaggagatgtgcccatcctgaccacagaagatgacatggtgtcccagcctgccaagatcctgaacttcctgaggaagcagaagtacaatgctgactatgagctgagcgccaagcagggcgctgacaccctggcctacatcgccctgctggaggagaagctgctgcctgctgtgctgcacaccttctgggtggagagtgacaactacttcaccgtgaccaagccctggtttgccagccagatccccttccccctgagcctcatcctgcccggccgcatgagcaagggggccctgaaccgcatcctgctgacccggggccagccccccctgtaccacctgcgggaggtggaggcccagatctacagagatgccaaggaatgtctgaacctgctgagcaaccggctgggcaccagccagttcttctttggagacacccccagcaccctggatgcctacgtgtttggcttcctggcccccctgtacaaggtgcgcttccccaaggtgcagctgcaggagcacctgaagcagctgagcaacctgtgccgcttctgtgatgacatcctgagcagctacttccggctgagcctgggggagggctag

SEQ ID NO: 35719 - DNA, 747 bp, Artificial Sequence
  Description of Artificial Sequence: Synthetic coding sequence
atggccgcccccctggagctgagctgctggggcggcggctggggcctgcccagcgtgcacagcgagagcctggtggtgatggcctatgccaagttcagcggggcccccctgaaggtgaatgtcatcgacaacacctggaggggcagcagaggagatgtgcccatcctgaccacagaagatgacatggtgtcccagcctgccaagatcctgaacttcctgaggaagcagaagtacaatgctgactatgagctgagcgccaagcagggcgctgacaccctggcctacatcgccctgctggaggagaagctgctgcctgctgtgctgcacaccttctgggtggagagtgacaactacttcaccgtgaccaagccctggtttgccagccagatccccttccccctgagcctcatcctgcccggccgcatgagcaagggggccctgaaccgcatcctgctgacccggggccagccccccctgtaccacctgcgggaggtggaggcccagatctacagagatgccaaggaatgtctgaacctgctgagcaaccggctgggcaccagccagttcttctttggagacacccccagcaccctggatgcctacgtgtttggcttcctggcccccctgtacaaggtgcgcttccccaaggtgcagctgcaggagcacctgaagcagctgagcaacctgtgccgcttctgtgatgacatcctgagcagctacttccggctgagcctgggagatggatag

SEQ ID NO: 35720 - DNA, 939 bp, Artificial Sequence
  Description of Artificial Sequence: Synthetic coding sequence
atggccgcccccctggagctgagctgctggggcggcggctggggcctgcccagcgtgcacagcgagagcctggtggtgatggcctatgccaagttcagcggggcccccctgaaggtgaatgtcatcgacaacacctggaggggcagcagaggagatgtgcccatcctgaccacagaagatgacatggtgtcccagcctgccaagatcctgaacttcctgaggaagcagaagtacaatgctgactatgagctgagcgccaagcagggcgctgacaccctggcctacatcgccctgctggaggagaagctgctgcctgctgtgctgcacaccttctgggtggagagtgacaactacttcaccgtgaccaagccctggtttgccagccagatccccttccccctgagcctcatcctgcccggccgcatgagcaagggggccctgaaccgcatcctgctgacccggggccagccccccctgtaccacctgcgggaggtggaggcccagatctacagagatgccaaggaatgtctgaacctgctgagcaaccggctgggcaccagccagttcttctttggagacacccccagcaccctggatgcctacgtgtttggcttcctggcccccctgtacaaggtgcgcttccccaaggtgcagctgcaggagcacctgaagcagctgagcaacctgtgccgcttctgtgatgacatcctgagcagctacttccggctgagcctgggcggcatcagccctgctggccaggagaccgtggatgccaacctgcagaagctgacccagctggtgaacaaggagagcaacctgattgagaagatggatgacaacctgcggcagagcccccagctgccccccaggaagctgcccaccctgaagctgaccccagctgaggaggagaacaacagcttccagaggctgagcccctag

SEQ ID NO: 35721 - DNA, 756 bp, Artificial Sequence
  Description of Artificial Sequence: Synthetic coding sequence
atggtgtcccagcctgccaagatcctgaacttcctgaggaagcagaagtacaatgctgactatgagctgagcgccaagcagggcgctgacaccctggcctacatcgccctgctggaggagaagctgctgcctgctgtgctgcacaccttctgggtggagagtgacaactacttcaccgtgaccaagccctggtttgccagccagatccccttccccctgagcctcatcctgcccggccgcatgagcaaaggagccctgaaccgcatcctgctgacccggggccagccccccctgtaccacctgcgggaggtggaggcccagatctacagagatgccaaggagtgcctgaacctgctgagcaaccggctgggcaccagccagttcttcttcggggacacccccagcaccctggatgcctacgtgtttggcttcctggcccccctgtacaaggtgcgcttccccaaggtgcagctgcaggagcacctgaagcagctgagcaacctgtgccgcttctgtgatgacatcctgagcagctacttccggctgagcctgggcggcatcagccctgctggccaggagaccgtggatgccaacctgcagaagctgacccagctggtgaacaaggagagcaacctgattgagaagatggatgacaacctgcggcagagcccccagctgccccccaggaagctgcccaccctgaagctgaccccagctgaggaggagaacaacagcttccagaggctgagcccctag

SEQ ID NO: 35722 - DNA, 1008 bp, Artificial Sequence
  Description of Artificial Sequence: Synthetic coding sequence
atggccgcccccagcggcgtgcacctgctggtgcggcggggcagccaccgcatcttcagcagccccctgaaccacatctacctgcacaagcagagcagcagccagcagaggaggaacttcttcttccggcggcagagggacatcagccacagcatcgtgctgcctgctgctgtgagcagcgcccaccctgtgcccaagcacatcaagaagccagactatgtgaccaccggcatcgtgcctgactggggagacagcattgaggtgaagaatgaagaccagatccagggcctgcaccaggcctgccagctggcccggcacgtgctgctgctggccggcaagagcctgaaggtggacatgaccacagaggagattgatgccctggtgcaccgggagatcatcagccacaatgcctaccccagccccctgggctacggcggcttccccaagtctgtgtgcacctctgtgaacaacgtgctgtgccacggcatcccagacagccggcccctgcaggatggagacatcatcaacattgatgtgacagtgtactacaacggctaccatggagacaccagcgagaccttcctggtgggcaatgtggatgaatgtgggaagaagctggtggaggtggcccggcgctgcagagatgaggccatcgccgcctgcagagctggggcccccttcagcgtcatcggcaacaccatcagccacatcacccaccagaatggcttccaggtgtgcccccactttgtgggccacggcatcggcagctacttccacggccaccctgagatctggcaccacgccaatgacagcgacctgcccatggaggagggcatggccttcaccatcgagcccatcatcacagagggcagccctgagttcaaggtgctggaggatgcctggacagtggtgtccctggacaaccagaggtctgcccagtttgagcacacagtgctgatcaccagcagaggagcccagatcctgaccaagctgccccatgaggcctag

SEQ ID NO: 35723 - DNA, 747 bp, Artificial Sequence
  Description of Artificial Sequence: Synthetic coding sequence
atgaagccagccagcatcagcgaggaggagctgctgaacctgatcaacaagctgaacaatgatgacaacgtggatggcctgctggtgcagctgcccctgcctgagcacattgatgagcggcgcatctgcaatgctgtgtccccagacaaggatgtggatggcttccacgtgatcaacgtgggccgcatgtgcctggaccagtacagcatgctgcctgccaccccctggggcgtgtgggagatcatcaagaggacaggcatccccaccctgggcaagaatgtggtggtggccggccgcagcaagaatgtgggcatgcccatcgccatgctgctgcacacagatggagcccacgagaggcctggaggagatgccaccgtgaccatcagccaccgctacacccccaaggagcagctgaagaagcacaccatcctggccgacatcgtcatctctgctgctggcatccccaacctgatcacagctgacatgatcaaggagggcgctgctgtgattgatgtgggcatcaacagagtgcatgaccctgtgacagccaagcccaagctggtgggagatgtggactttgaaggagtgcggcagaaggccggctacatcacccctgtgcctggaggagtgggccccatgacagtggccatgctgatgaagaacaccatcatcgccgccaagaaggtgctgcggctggaggagcgggaggtgctgaagagcaaggagctgggcgtggccaccaactag

SEQ ID NO: 35724 - DNA, 561 bp, Artificial Sequence
  Description of Artificial Sequence: Synthetic coding sequence
atgtgcctggaccagtacagcatgctgcctgccaccccctggggcgtgtgggagatcatcaagaggacaggcatccccaccctgggcaagaatgtggtggtggccggccgcagcaagaatgtgggcatgcccatcgccatgctgctgcacacagatggagcccacgagaggcctggaggagatgccaccgtgaccatcagccaccgctacacccccaaggagcagctgaagaagcacaccatcctggccgacatcgtcatctctgctgctggcatccccaacctgatcacagctgacatgatcaaggagggcgctgctgtgattgatgtgggcatcaacagagtgcatgaccctgtgacagccaagcccaagctggtgggagatgtggactttgaaggagtgcggcagaaggccggctacatcacccctgtgcctggaggagtgggccccatgacagtggccatgctgatgaagaacaccatcatcgccgccaagaaggtgctgcggctggaggagcgggaggtgctgaagagcaaggagctgggcgtggccaccaactag

SEQ ID NO: 35725 - DNA, 1053 bp, Artificial Sequence
  Description of Artificial Sequence: Synthetic coding sequence
atggccgccaccagcctgatgtctgccctggccgcccggctgctgcagcctgcccacagctgcagcctgcggctgcggcccttccacctggccgctgtgagaaatgaagctgtggtgatcagcggcaggaagctggcccagcagatcaagcaggaggtgcggcaggaggtggaggagtgggtggccagcggcaacaagaggccccacctgagcgtcatcctggtgggagaaaatcctgccagccacagctatgtgctgaacaagaccagggctgctgctgtggtgggcatcaacagcgagaccatcatgaagccagccagcatcagcgaggaggagctgctgaacctgatcaacaagctgaacaatgatgacaacgtggatggcctgctggtgcagctgcccctgcctgagcacattgatgagcggcgcatctgcaatgctgtgtccccagacaaggatgtggatggcttccacgtgatcaacgtgggccgcatgtgcctggaccagtacagcatgctgcctgccaccccctggggcgtgtgggagatcatcaagaggacaggcatccccaccctgggcaagaatgtggtggtggccggccgcagcaagaatgtgggcatgcccatcgccatgctgctgcacacagatggagcccacgagaggcctggaggagatgccaccgtgaccatcagccaccgctacacccccaaggagcagctgaagaagcacaccatcctggccgacatcgtcatctctgctgctggcatccccaacctgatcacagctgacatgatcaaggagggcgctgctgtgattgatgtgggcatcaacagagtgcatgaccctgtgacagccaagcccaagctggtgggagatgtggactttgaaggagtgcggcagaaggccggctacatcacccctgtgcctggaggagtgggccccatgacagtggccatgctgatgaagaacaccatcatcgccgccaagaaggtgctgcggctggaggagcgggaggtgctgaagagcaaggagctgggcgtggccaccaactag

SEQ ID NO: 35726 - DNA, 882 bp, Artificial Sequence
  Description of Artificial Sequence: Synthetic coding sequence
atggccaccaatgaatctgtgtccatcttcagcagcgccagcctggccgtggagtatgtggacagcctgctgcctgagaaccccctgcaggagcccttcaagaatgcctggaactacatgctgaacaactacaccaagttccagatcgccacctggggcagcctcatcgtgcatgaggccctgtacttcctgttctgcctgcccggcttcctgttccagttcatcccctacatgaagaagtacaagatccagaaggacaagccagagacctgggagaaccagtggaagtgcttcaaggtgctgctcttcaaccacttctgcatccagctgcccctcatctgtggcacctactacttcacagagtacttcaacatcccctatgactgggagaggatgccccgctggtacttcctgctggcccgctgcttcggctgtgctgtgattgaggacacctggcactacttcctgcaccggctgctgcaccacaagaggatctacaagtacatccacaaggtgcaccacgagttccaggcccccttcggcatggaggccgagtatgcccaccccctggagaccctcatcctgggcaccggcttcttcatcggcatcgtgctgctgtgtgaccacgtgatcctgctgtgggcctgggtgaccatccggctgctggagaccattgatgtgcacagcggctatgacatccccctgaaccccctgaacctgatccccttctacgccggcagccgccaccacgacttccaccacatgaacttcatcggcaactatgccagcaccttcacctggtgggaccgcatcttcggcacagacagccagtacaatgcctacaatgagaagaggaagaagtttgagaagaagacagaatag

SEQ ID NO: 35727 - DNA, 489 bp, Artificial Sequence
  Description of Artificial Sequence: Synthetic coding sequence
atgccccgctggtacttcctgctggcccgctgcttcggctgtgctgtgattgaggacacctggcactacttcctgcaccggctgctgcaccacaagaggatctacaagtacatccacaaggtgcaccacgagttccaggcccccttcggcatggaggccgagtatgcccaccccctggagaccctcatcctgggcaccggcttcttcatcggcatcgtgctgctgtgtgaccacgtgatcctgctgtgggcctgggtgaccatccggctgctggagaccattgatgtgcacagcggctatgacatccccctgaaccccctgaacctgatccccttctacgccggcagccgccaccacgacttccaccacatgaacttcatcggcaactatgccagcaccttcacctggtgggaccgcatctttggaacagacagccagtacaatgcctacaatgagaagaggaagaagtttgagaagaagacagaatag

SEQ ID NO: 35728 - DNA, 258 bp, Artificial Sequence
  Description of Artificial Sequence: Synthetic coding sequence
atggccaccaatgaatctgtgtccatcttcagcagcgccagcctggccgtggagtatgtggacagcctgctgcctgagaaccccctgcaggagcccttcaagaatgcctggaactacatgctgaacaactacaccaagttccagatcgccacctggggcagcctcatcgtgcatgaggccctgtacttcctgttctgcctgcccggcttcctgttccagttcatcccctacatgaagaagtacaagatccagaagtag

SEQ ID NO: 35729 - DNA, 663 bp, Artificial Sequence
  Description of Artificial Sequence: Synthetic coding sequence
atggccaccaatgaatctgtgtccatcttcagcagcgccagcctggccgtggagtatgtggacagcctgctgcctgagaaccccctgcaggagcccttcaagaatgcctggaactacatgctgaacaactacaccaagttccagatcgccacctggggcagcctcatcgtgcatgaggccctgtacttcctgttctgcctgcccggcttcctgttccagttcatcccctacatgaagaagtacaagatccagaaggacaagccagagacctgggagaaccagtggaagtgcttcaaggtgctgctcttcaaccacttctgcatccagctgcccctcatctgtggcacctactacttcacagagtacttcaacatcccctatgactgggagaggatgccccgctggtacttcctgctggcccgctgcttcggctgtgctgtgattgaggacacctggcactacttcctgcaccggctgctgcaccacaagaggatctacaagtacatccacaaggtgcaccacgagttccaggcccccttcggcatggaggccgagtatgcccaccccctggagaccctcatcctgggcaccggcttcttcatcggcatcgtgctgctgtgtgaccacgtgatcctgctgtgggcctgggtgaccatcagatag

SEQ ID NO: 35730 - DNA, 723 bp, Artificial Sequence
  Description of Artificial Sequence: Synthetic coding sequence
atggccgccctgcggaggatgctgcacctgcccagcctgatgatgggcacctgccggccctttgctggcagcctggccgacagctgcctggccgaccgctgcctgtgggaccggctgcacgcccagccccggctgggcaccgtgcccacctttgactggttcttcggctatgatgaggtgcagggcctgctgctgcccctgctgcaggaggcccaggccgccagccccctgcgggtgctggatgtgggctgcggcaccagcagcctgtgcaccggcctgtacaccaagagcccccaccctgtggatgtgctgggcgtggacttcagccctgtggccgtggcccacatgaacagcctgctggagggcggccctggccagacccccctgtgccccggccacccagccagcagcctgcacttcatgcatgctgatgcccagaacctgggcgctgtggccagcagcggcagcttccagctgctgctggacaagggcacctgggatgctgtggcccggggcggcctgccccgggcctaccagctgctgtctgaatgtctgcgggtgctgaacccccagggcaccctcatccagttcagtgatgaggaccctgatgtgcggctgccctgcctggagcagggcagctatggctggacagtgacagtgcaggagctgggccccttccggggcatcacctactttgcctacctgatccagggcagccactag

SEQ ID NO: 35731 - DNA, 657 bp, Artificial Sequence
  Description of Artificial Sequence: Synthetic coding sequence
atggccctggtgccctatgaggagaccacagaatttggcctgcagaagttccacaagcccctggccaccttctcctttgccaaccacaccatccagatccggcaggactggaggcacctgggcgtggccgctgtggtgtgggatgctgccatcgtgctgagcacctacctggagatgggcgctgtggagctgcggggccgctctgctgtggagctgggcgccggcaccggcctggtgggcatcgtggccgccctgctgggcgcccacgtgaccatcacagacaggaaggtggccctggagttcctgaagagcaatgtgcaggccaacctgcccccccacatccagaccaagacagtggtgaaggagctgacctggggccagaacctgggcagcttcagccctggagaatttgacctgatcctgggcgctgacatcatctacctggaggagaccttcacagacctgctgcagaccctggagcacctgtgcagcaaccacagcgtcatcctgctggcctgccgcatccgctatgagcgggacaacaacttcctggccatgctggagcggcagttcaccgtgaggaaggtgcactatgaccctgagaaggatgtgcacatctatgaggcccagaagaggaaccagaaggaggacctgtag

SEQ ID NO: 35732 - DNA, 657 bp, Artificial Sequence; identical to SEQ ID NO: 35731
  Description of Artificial Sequence: Synthetic coding sequence

SEQ ID NO: 35733 - DNA, 273 bp, Artificial Sequence
  Description of Artificial Sequence: Synthetic coding sequence
atggccctggtgccctatgaggagaccacagaatttggcctgcagaagttccacaagcccctggccaccttctcctttgccaaccacaccatccagatccggcaggactggaggcacctgggcgtggccgctgtggtgtgggatgctgccatcgtgctgagcacctacctggagatgggcgctgtggagctgcggggccgctctgctgtggagctgggcgccggcaccggcctggtgggcatcgtggccgccctgctgggcggcggcatctag

SEQ ID NO: 35734 - DNA, 657 bp, Artificial Sequence; identical to SEQ ID NO: 35731
  Description of Artificial Sequence: Synthetic coding sequence

SEQ ID NO: 35735 - DNA, 657 bp, Artificial Sequence; identical to SEQ ID NO: 35731
  Description of Artificial Sequence: Synthetic coding sequence

SEQ ID NO: 35736 - DNA, 657 bp, Artificial Sequence; identical to SEQ ID NO: 35731
  Description of Artificial Sequence: Synthetic coding sequence

SEQ ID NO: 35737 - DNA, 273 bp, Artificial Sequence; identical to SEQ ID NO: 35733
  Description of Artificial Sequence: Synthetic coding sequence

SEQ ID NO: 35738 - DNA, 681 bp, Artificial Sequence
  Description of Artificial Sequence: Synthetic coding sequence
atggctgaccccggccctgaccctgagagcgagagcgagagcgtcttcccccgggaggtgggcctgtttgctgacagctacagcgagaagagccagttctgcttctgtggccacgtgctgaccatcacccagaactttggcagccggctgggcgtggccgcccgggtgtgggatgctgccctgagcctgtgcaactactttgagagccagaatgtggacttccggggcaagaaggtgattgagctgggcgccggcaccggcatcgtgggcatcctggccgccctgcagggcggagatgtgaccatcacagacctgcccctggccctggagcagatccagggcaatgtgcaggccaacgtgcctgctgggggccaggcccaggtgcgggccctgtcctggggcatcgaccaccacgtgtttcctgccaactatgacctggtgctgggcgctgacatcgtgtacctggagcccaccttccccctgctgctgggcaccctgcagcacctgtgccggccccacggcaccatctacctggccagcaagatgaggaaggagcacggcacagagagcttcttccagcacctgctgccccagcacttccagctggagctggcccagagagatgaagatgaaaatgtgaacatctaccgggcccggcaccgggagcccaggcctgcctag

SEQ ID NO: 35739 - DNA, 450 bp, Artificial Sequence
  Description of Artificial Sequence: Synthetic coding sequence
atggctgaccccggccctgaccctgagagcgagagcgagagcgtcttcccccgggaggtgggcctgtttgctgacagctacagcgagaagagccagttctgcttctgtggccacgtgctgaccatcacccagaactttggcagccggctgggcgtggccgcccgggtgtgggatgctgccctgagcctgtgcaactactttgagagccagaatgtggacttccggggcaagaaggtgattgagctgggcgccggcaccggcatcgtgggcatcctggccgccctgcagggcgcctacggcctggtgcgggagacagaagatgatgtgattgagcaggagctgtggaggggcatgagaggagcctgtggccacgccctgtccatgagcaccatgaccccctgggagagcatcaagggcagctctgtgcggggcggctgctaccaccactag

SEQ ID NO: 35740 - DNA, 810 bp, Artificial Sequence
  Description of Artificial Sequence: Synthetic coding sequence
gcccgctgccagttctgtgcctgtgagagcctgagcccctgcagcggcctgagcagcctggccgcccggcagggctaccaccagatctgggccttccccttcctgcccagcggggccacagccacctggccagctgccagccgcagccgcagcctggccgcccggagcctgcccaggagccctgcccggcccggccccaatgatgccctgctgggggagcatgacttccggggccagggcgtgcgggcccagcgcttccgcttcagcgaggagcccggccctggagcagatggagctgtgctggaggtgcacgtgccccagatcggggccggcgtgtccctgcccggcatcctggccgccaagtgtggggctgaggtgatcctgagtgacagcagcgagctgccccactgcctggaggtgtgccggcagagctgccagatgaacaacctgccccacctgcaggtggtgggcctgacctggggccacatctcctgggacctgctggccctgcccccccaggacatcatcctggccagtgatgtgttctttgagcctgaggactttgaggacatcctggccaccatctacttcctgatgcacaagaaccccaaggtgcagctgtggagcacctaccaggtgcgctctgctgactggagcctggaggccctgctgtacaagtgggacatgaagtgtgtgcacatccccctggagagctttgatgctgacaaggaggacattgctgagagcaccctgcccggccgccacacagtggagatgctggtgatcagctttgccaaggacagcctgtag

SEQ ID NO: 35741 - DNA, 573 bp, Artificial Sequence
  Description of Artificial Sequence: Synthetic coding sequence
atgtatgtgtggccctgtgctgtggtgctggcccagtacctgtggttccaccggcgcagcctgcccgggaaggccatcctggagattggagctggggtgtccctgcccggcatcctggccgccaagtgtggggctgaggtgatcctgagtgacagcagcgagctgccccactgcctggaggtgtgccggcagagctgccagatgaacaacctgccccacctgcaggtggtgggcctgacctggggccacatctcctgggacctgctggccctgcccccccaggacatcatcctggccagtgatgtgttctttgagccagaagattttgaggacatcctggccaccatctacttcctgatgcacaagaaccccaaggtgcagctgtggagcacctaccaggtgcgctctgctgactggagcctggaggccctgctgtacaagtgggacatgaagtgtgtgcacatccccctggagagctttgatgctgacaaggaggacattgctgagagcaccctgcccggccgccacacagtggagatgctggtgatcagctttgccaaggacagcctgtag

SEQ ID NO: 35742 - DNA, 372 bp, Artificial Sequence
  Description of Artificial Sequence: Synthetic coding sequence
atgaacaacctgccccacctgcaggtggtgggcctgacctggggccacatctcctgggacctgctggccctgcccccccaggacatcatcctggccagtgatgtgttctttgagcctgaggactttgaggacatcctggccaccatctacttcctgatgcacaagaaccccaaggtgcagctgtggagcacctaccaggtgcgctctgctgactggagcctggaggccctgctgtacaagtgggacatgaagtgtgtgcacatccccctggagagctttgatgctgacaaggaggacattgctgagagcaccctgcccggccgccacacagtggagatgctggtgatcagctttgccaaggacagcctgtag

SEQ ID NO: 35743 - DNA, 372 bp, Artificial Sequence; identical to SEQ ID NO: 35742
  Description of Artificial Sequence: Synthetic coding sequence

SEQ ID NO: 35744 - DNA, 372 bp, Artificial Sequence; identical to SEQ ID NO: 35742
  Description of Artificial Sequence: Synthetic coding sequence

SEQ ID NO: 35745 - DNA, 2715 bp, Artificial Sequence
  Description of Artificial Sequence: Synthetic coding sequence
atggccgccatccgggccctgcagcagtggtgccggcagcagtgtgagggctacagagatgtgaacatctgcaacatgaccaccagcttcagagatggcctggccttctgtgccatcctgcaccgccacaggccagacctgatcaacttcagcgccctgaagaaggagaacatctatgagaacaacaagctggccttccgggtggccgaggagcacctgggcatcccagccctgctggatgctgaggacatggtggccctgaaggtgcctgaccggctgagcatcctgacctacgtgtcccagtactacaactacttccacggccgcagccccatcggcggcatggccggcgtgaagagggcctctgaagattctgaggaggagcccagcggcaagaaggcccctgtgcaggccgccaagctgcccagccctgccccagccaggaagccacccctgagccctgcccagaccaaccctgtggtgcagaggagaaatgaaggagctgggggccccccacccaagacagaccaggccctggccggcagcctggtgagcagcacctgtggggtgtgtgggaagcacgtgcacctggtgcagaggcacctggctgatggccgcctgtaccacaggagctgcttccgctgcaagcagtgcagctgcaccctgcacagcggggcctacaaggccaccggggagcccggcacctttgtgtgcaccagccacctgcctgctgctgccagcgccagccccaagctgaccggcctggtgccccggcagcccggggccatgggcgtggacagcaggaccagctgcagcccccagaaggcccaggaggccaacaaggcccggcccagcgcctgggagcctgctgctggcaacagccctgcccgggcctctgtgcctgctgcccccaacccagctgccaccagcgccacctctgtgcacgtgcgcagccctgcccggcccagcgagagccggctggcccccacccccacagagggcaaggtgcggccccgggtgaccaacagcagccccatgggctggagcagcgctgccccctgcacagctgctgctgccagccaccctgctgtgcccccatctgccccagaccccaggcctgccaccccccagggcggcggggccccccgggtggccgccccccagaccaccctgagcagcagcagcaccagcgctgccaccgtggaccccccagcctggaccccatctgccagcaggacccagcaggccaggaacaagttcttccagaccagcgctgtgcccccaggcaccagcctgagcggccggggccccacccccagcctggtgctgagcaaggacagcagcaaggagcaggccaggaacttcctgaagcaggccctgagcgccctggaggaggccggggccccagcccctggccggcccagccctgccacagctgctgtgcccagcagccagcccaagacagaggccccccaggccagccccctggccaagcccctgcagagcagcagcccccgggtgctgggcctgcccagcaggatggagcccccagcccccctgagcaccagcagcaccagccaggccagcgccctgcccccagctggaagaagaaacctggccgagagcagtggagtgggccgggtgggcgccggcagccggcccaagccagaggcccccatggccaagggcaagagcaccaccctgacccaggacatgagcaccagcctgcaggagggccaggaggatggccctgctggctggagggccaacctgaagcctgtggaccggcgcagccctgctgagaggaccctgaagcccaaggagccccgggccctggccgagcccagggctggggaggcccccaggaaggtgtctggcagctttgctggctctgtgcacatcaccctgacccctgtgcggccagacaggacccccaggcctgccagccctggccccagcctgcctgcccggagccccagccccccaagaagaagaaggctggccgtgcctgccagcctggatgtgtgtgacaactggctgcggcctgagcccccaggccaggaggcccgggtgcagagctggaaggaggaggagaagaagccccacctgcagggcaagccaggccggcccctgagccctgccaacgtgcctgccctgcccggggagaccgtgaccagccctgtgcggctgcacccagactacctgagccctgaggagatccagaggcagctgcaggacattgaaagaaggctggatgccctggagctgcggggcgtggagctggagaagaggctgcgggctgctgaaggagatgatgctgaggacagcctgatggtggactggttctggctgatccacgagaagcagctgctgctgcggcaggagagcgagctgatgtacaagagcaaggcccagaggctggaggagcagcagctggacatcgagggggagctgcggcggctgatggccaagccagaggccctgaagagcctgcaggagaggagaagagagcaggagctgctggagcagtatgtgtccacagtgaatgacagaagtgacatcgtggacagcctggatgaggaccggctgcgggagcaggaggaggaccagatgctgcgggacatgattgagaagctgggcctgcagaggaagaagagcaagttccggctgagcaagatctggagccccaagagcaagagcagccccagccagtag

SEQ ID NO: 35746 - DNA, 2079 bp, Artificial Sequence
  Description of Artificial Sequence: Synthetic coding sequence
atggccgccatccgggccctgcagcagtggtgccggcagcagtgtgagggctacagagatgtgaacatctgcaacatgaccacccacctgcctgctgctgccagcgccagccccaagctgaccggcctggtgccccggcagcccggggccatgggcgtggacagcaggaccagctgcagcccccagaaggcccaggaggccaacaaggcccggcccagcgcctgggagcctgctgctggcaacagccctgcccgggcctctgtgcctgctgcccccaacccagctgccaccagcgccacctctgtgcacgtgcgcagccctgcccggcccagcgagagccggctggcccccacccccacagagggcaaggtgcggccccgggtgaccaacagcagccccatgggctggagcagcgctgccccctgcacagctgctgctgccagccaccctgctgtgcccccatctgccccagaccccaggcctgccaccccccagggcggcggggccccccgggtggccgccccccagaccaccctgagcagcagcagcaccagcgctgccaccgtggaccccccagcctggaccccatctgccagcaggacccagcaggccaggaacaagttcttccagaccagcgctgtgcccccaggcaccagcctgagcggccggggccccacccccagcctggtgctgagcaaggacagcagcaaggagcaggccaggaacttcctgaagcaggccctgagcgccctggaggaggccggggccccagcccctggccggcccagccctgccacagctgctgtgcccagcagccagcccaagacagaggccccccaggccagccccctggccaagcccctgcagagcagcagcccccgggtgctgggcctgcccagcaggatggagcccccagcccccctgagcaccagcagcaccagccaggccagcgccctgcccccagctggaagaagaaacctggccgagagcagtggagtgggccgggtgggcgccggcagccggcccaagccagaggcccccatggccaagggcaagagcaccaccctgacccaggacatgagcaccagcctgcaggagggccaggaggatggccctgctggctggagggccaacctgaagcctgtggaccggcgcagccctgctgagaggaccctgaagcccaaggagccccgggccctggccgagcccagggctggggaggcccccaggaaggtgtctggcagctttgctggctctgtgcacatcaccctgacccctgtgcggccagacaggacccccaggcctgccagccctggccccagcctgcctgcccggagccccagccccccaagaagaagaaggctggccgtgcctgccagcctggatgtgtgtgacaactggctgcggcctgagcccccaggccaggaggcccgggtgcagagctggaaggaggaggagaagaagccccacctgcagggcaagccaggccggcccctgagccctgccaacgtgcctgccctgcccggggagaccgtgaccagccctgtgcggctgcacccagactacctgagccctgaggagatccagaggcagctgcaggacattgaaagaaggctggatgccctggagctgcggggcgtggagctggagaagaggctgcgggctgctgaaggagatgatgctgaggacagcctgatggtggactggttctggctgatccacgagaagcagctgctgctgcggcaggagagcgagctgatgtacaagagcaaggcccagaggctggaggagcagcagctggacatcgagggggagctgcggcggctgatggccaagccagaggccctgaagagcctgcaggagaggagaagagagcaggagctgctggagcagtatgtgtccacagtgaatgacagaagtgacatcgtggacagcctggatgaggaccggctgcgggagcaggaggaggaccagatgctgcgggacatgattgagaagctgggcctgcagaggaagaagagcaagttccggctgagcaagatctggagccccaagagcaagagcagccccagccagtag

SEQ ID NO: 35747 - DNA, 1230 bp, Artificial Sequence
  Description of Artificial Sequence: Synthetic coding sequence
atggaccggctgaagagccacctgactgtgtgcttcctgcccagcgtgcccttcctgatcctggtgtccaccctggccacagccaagtctgtgaccaacagcaccctgaatggcaccaacgtggtgctgggctctgtgcctgtgatcatcgccaggacagaccacatcatcgtgaaggagggcaacagcgccctgatcaactgcagcgtgtatggcatcccagacccccagttcaagtggtacaacagcatcggcaagctgctgaaggaggaggaggatgagaaggagcggggcggcggcaagtggcagatgcatgattctggcctgctgaacatcaccaaggtgtccttcagtgaccggggcaagtacacctgtgtggccagcaacatctatggaacagtgaacaacacagtgaccctgcgggtcatcttcaccagcggggacatgggcgtgtactacatggtggtgtgcctggtggccttcaccatcgtgatggtgctgaacatcacccggctgtgcatgatgagcagccacctgaagaagacagagaaggccatcaatgagttcttcagaacagagggcgctgagaagctgcagaaggcctttgagatcgccaagaggatccccatcatcaccagcgccaagaccctggagctggccaaggtgacccagttcaagaccatggagtttgcccgctacatcgaggagctggcccggtctgtgcccctgcccccactcatcatgaactgcaggaccatcatggaggagatcatggaggtggtgggcctggaggagcagggccagaactttgtgcgccacaccccagagggccaggaggccgctgacagagatgaggtgtacaccatccccaacagcctgaagagaagtgacagccctgctgctgacagtgatgccagcagcctgcacgagcagccccagcagatcgccatcaaggtgtctgtgcacccccagagcaagaaggagcacgcagatgaccaggagggcggccagtttgaggtgaaggatgtggaggagacagagctgtctgctgagcacagccctgagacagctgagcccagcacagatgtgaccagcacagagctgaccagcgaggagcccacccctgtggaggtgcctgacaaggtgctgcccccagcctacctggaggccacagagcctgctgtgacccatgacaagaacacctgcatcatctatgagagccacgtgtag

SEQ ID NO: 35748 - DNA, 921 bp, Artificial Sequence
  Description of Artificial Sequence: Synthetic coding sequence
atgcatgacagcggcctgctgaacatcaccaaggtgtccttcagtgaccggggcaagtacacctgtgtggccagcaacatctacggcaccgtgaacaacacagtgaccctgcgggtcatcttcaccagcggggacatgggcgtgtactacatggtggtgtgcctggtggccttcaccatcgtgatggtgctgaacatcacccggctgtgcatgatgagcagccacctgaagaagacagagaaggccatcaatgagttcttcagaacagaaggagctgagaagctgcagaaggcctttgaaattgccaagaggatccccatcatcaccagcgccaagaccctggagctggccaaggtgacccagttcaagaccatggagtttgcccgctacatcgaggagctggcccggtctgtgcccctgcccccactcatcatgaactgcaggaccatcatggaggagatcatggaggtggtgggcctggaggagcagggccagaactttgtgcgccacaccccagagggccaggaggccgctgacagagatgaggtgtacaccatccccaacagcctgaagagaagtgacagccctgctgctgacagtgatgccagcagcctgcacgagcagccccagcagatcgccatcaaggtgtctgtgcacccccagagcaagaaggagcacgcagatgaccaggagggcggccagtttgaggtgaaggatgtggaggagacagagctgtctgctgagcacagccctgagacagctgagcccagcacagatgtgaccagcacagagctgaccagcgaggagcccacccctgtggaggtgcctgacaaggtgctgcccccagcctacctggaggccacagagcctgctgtgacccatgacaagaacacctgcatcatctatgagagccacgtgtag

SEQ ID NO: 35749 - DNA, 195 bp, Artificial Sequence
  Description of Artificial Sequence: Synthetic coding sequence
atgcatgacagcggcctgctgaacatcaccaaggtgtccttcagtgaccggggcaagtacacctgtgtggccagcaacatctacggcaccgtgaacaacacagtgaccctgcgggtcatcttcaccagcggggacatgggcgtgtactacatggtggtgtgcctggtggccttcaccatcgtgatggtgctgtag

SEQ ID NO: 35750 - DNA, 297 bp, Artificial Sequence
  Description of Artificial Sequence: Synthetic coding sequence
atggaccggctgaagagccacctgactgtgtgcttcctgcccagcgtgcccttcctgatcctggtgtccaccctggccacagccaagtctgtgaccaacagcaccctgaatggcaccaacgtggtgctgggctctgtgcctgtgatcatcgccaggacagaccacatcatcgtgaaggagggcaacagcgccctgatcaactgcagcgtgtatggcatcccagacccccagttcaagtggtacaacagcatcggcaagctgctgaaggaggaggaggatgagaaggagcggggctag

SEQ ID NO: 35751 - DNA, 273 bp, Artificial Sequence
  Description of Artificial Sequence: Synthetic coding sequence
atggaccggctgaagagccacctgactgtgtgcttcctgcccagcgtgcccttcctgatcctggtgtccaccctggccacagccaagtctgtgaccaacagcaccctgaatggcaccaacgtggtgctgggctctgtgcctgtgatcatcgccaggacagaccacatcatcgtgaaggagggcaacagcgccctgatcaactgcagcgtgtatggcatcccagacccccagttcaagtggtacaacagcatcggcaagctgctgaaggagtag

SEQ ID NO: 35752 - DNA, 222 bp, Artificial Sequence
  Description of Artificial Sequence: Synthetic coding sequence
atggaccggctgaagagccacctgactgtgtgcttcctgcccagcgtgcccttcctgatcctggtgtccaccctggccacagccaagtctgtgaccaacagcaccctgaatggcaccaacgtggtgctgggctctgtgcctgtgatcatcgccaggacagaccacatcatcgtgaaggagggcaacagcgccctgatcaactgcagcgtgtatggcatctag

SEQ ID NO: 35753 - DNA, 474 bp, Artificial Sequence
  Description of Artificial Sequence: Synthetic coding sequence
atgcatgacagcggcctgctgaacatcaccaaggtgtccttcagtgaccggggcaagtacacctgtgtggccagcaacatctacggcaccgtgaacaacacagtgaccctgcgggtcatcttcaccagcggggacatgggcgtgtactacatggtggtgtgcctggtggccttcaccatcgtgatggtgctgaacatcacccggctgtgcatgatgagcagccacctgaagaagacagagaaggccatcaatgagttcttcagaacagaaggagctgagaagctgcagaaggcctttgaaattgccaagaggatccccatcatcaccagcgccaagaccctggagctggccaaggtgacccagttcaagaccatggagtttgcccgctacatcgaggagctggcccggtctgtgcccctgcccccactcatcatgaactgcaggaccatcatggaggagatcatggaggtgtag

SEQ ID NO: 35754 - DNA, 366 bp, Artificial Sequence
  Description of Artificial Sequence: Synthetic coding sequence
atgcccagcgaccggcccttcaagcagaggaggagctttgctgaccgctgcaaggaggtgcagcagatccgggaccagcaccccagcaagatccctgtgatcatcgagcgctacaagggggagaagcagctgcctgtgctggacaagaccaagttcctggtgcctgaccacgtgaacatgtctgagctggtgaagatcatcagaagaaggctgcagctgaaccccacccaggccttcttcctgctggtgaaccagcacagcatggtgtctgtgtccacccccatcgctgacatctatgagcaggagaaggatgaagatggcttcctgtacatggtgtatgccagccaggagaccttcggcttctag

SEQ ID NO: 35755 - DNA, 366 bp, Artificial Sequence; identical to SEQ ID NO: 35754
  Description of Artificial Sequence: Synthetic coding sequence

SEQ ID NO: 35756 - DNA, 378 bp, Artificial Sequence
  Description of Artificial Sequence: Synthetic coding sequence
atgaagatgaggttcttcagcagcccctgtgggaaggctgctgtggaccctgctgaccgctgcaaggaggtgcagcagatccgggaccagcaccccagcaagatccctgtgatcatcgagcgctacaagggggagaagcagctgcctgtgctggacaagaccaagttcctggtgcctgaccacgtgaacatgtctgagctggtgaagatcatcagaagaaggctgcagctgaaccccacccaggccttcttcctgctggtgaaccagcacagcatggtgtctgtgtccacccccatcgctgacatctatgagcaggagaaggatgaagatggcttcctgtacatggtgtatgccagccaggagaccttcggcttctag

SEQ ID NO: 35757 - DNA, 378 bp, Artificial Sequence
  Description of Artificial Sequence: Synthetic coding sequence
atgcccagcgagaagaccttcaagcagaggaggacctttgagcagagggtggaggatgtgcggctcatccgggagcagcaccccaccaagatccctgtgatcatcgagcgctacaagggggagaagcagctgcctgtgctggacaagaccaagttcctggtgcctgaccacgtgaacatgtctgagctgatcaagatcatcagaagaaggctgcagctgaatgccaaccaggccttcttcctgctggtgaatggccacagcatggtgtctgtgtccacccccatcagcgaggtgtatgaaagtgagaaggatgaagatggcttcctgtacatggtgtatgccagccaggagaccttcggcatgaagctgtctgtgtag

SEQ ID NO: 35758 - DNA, 201 bp, Artificial Sequence
  Description of Artificial Sequence: Synthetic coding sequence
atgtctgagctgatcaagatcatcagaagaaggctgcagctgaatgccaaccaggccttcttcctgctggtgaatggccacagcatggtgtctgtgtccacccccatcagcgaggtgtatgagagcgagaaggatgaagatggcttcctgtacatggtgtatgccagccaggagaccttcggcatgaagctgtctgtgtag

SEQ ID NO: 35759 - DNA, 444 bp, Artificial Sequence
  Description of Artificial Sequence: Synthetic coding sequence
atgcccccaccccagaagatccccagcgtgcggcccttcaagcagaggaagagcctggccatccggcaggaggaggtggccggcatccgggccaagttccccaacaagatccctgtggtggtggagcgctacccccgggagaccttcctgccccccctggacaagaccaagttcctggtgccccaggagctgaccatgacccagttcctgagcatcatccgcagcaggatggtgctgcgggccacagaggccttctacctgctggtgaacaacaagagcctggtgtccatgtctgccaccatggccgagatctacagagactacaaggatgaagatggctttgtgtacatgacctacgccagccaggagaccttcggctgcctggagagcgctgcccccagagatggcagcagcctggaggaccggccctgcaaccccctgtag

SEQ ID NO: 35760 - DNA, 1968 bp, Artificial Sequence
  Description of Artificial Sequence: Synthetic coding sequence
atggccgagctgggcgctggaggagatggccacagaggaggagatggagctgtgcgctcagaaacagccccagacagctacaaggtgcaggacaagaagaatgccagcagcaggcctgccagcgccatcagcggccagaacaacaaccacagcggcaacaagccagaccccccacctgtgctgcgggtggatgaccggcagaggctggcccgggagcggcgggaggagcgggagaagcagctggaccctgacagaagatctgtgtccaccatgaacctgagcaaatatgtggaccctgtgatcagcaagaggctgagcagcagcagcgccaccctgctgaacagcccagaccgggcccggcggctgcagctgagcccctgggagagctctgtggtgaaccggctgctgacccccacccacagcttcctggcccggagcaagagcacagctgccctgtctggagaggccgccagctgcagccccatcatcatgccctacaaggccgcccacagcaggaacagcatggaccggcccaagctgtttgtgaccccacctgagggcagcagcagaagacgcatcatccatggaacagccagctacaagaaggagcgggagagagaaaatgtgctcttcctgaccagcggcaccaggagagctgtgagccccagcaaccccaaggcccggcagcctgcccggagccggctgtggctgcccagcaagagcctgccccacctgcccggcaccccccggcccaccagcagcctgcccccaggctctgtgaaggccgccccagcccaggtgcggccccccagccctggcaacatccggcctgtgaagcgggaggtgaaggtggagcctgagaagaaggaccctgagaaggagccccagaaggtggccaatgagcccagcctgaagggccgggcccccctggtgaaggtggaggaggccaccgtggaggagaggaccccagctgagcctgaggtgggccctgctgccccagccatggccccagccccagccagcgccccagccccagccagcgccccagccccagcccctgtgcccaccccagccatggtgtctgcccccagcagcacagtgaatgccagcgcctctgtgaagaccagcgctggcaccacagatcctgaggaggccacccggctgctggccgagaagaggcggctggcccgggagcagcgggagaaggaggagcgggagcggcgggagcaggaggagctggagcggcagaagcgggaggagctggcccagagggtggccgaggagaggaccacccggcgggaggaggagagccggcggctggaggccgagcaggcccgggagaaggaggagcagctgcagaggcaggccgaggagcgggccctgcgggagcgggaggaggccgagcgggcccagaggcagaaggaggaggaggcccgggtgcgggaggaggccgagcgggtgcggcaggagcgggagaagcacttccagcgggaggagcaggagcggctggagaggaagaagaggctggaggagatcatgaagaggaccaggagaacagaggccacagacaagaagaccagtgaccagagaaatggagacatcgccaagggggccctgaccggcggcacagaggtgtctgccctgccctgcaccaccaatgcccctggaaatggcaagcctgtgggcagcccccacgtggtgaccagccaccagagcaaggtgacagtggagagcaccccagacctggagaagcagcccaatgaaaatggagtgtctgtgcagaatgaaaattttgaggagatcatcaacctgcccatcggcagcaagcccagccggctggatgtgaccaacagcgagagccctgagatccccctgaaccccatcctggcctttgatgatgagggcaccctgggccccctgccccaggtggatggagtgcagacccagcagacagctgtggtgatctag

SEQ ID NO: 35761 - DNA, 2250 bp, Artificial Sequence
  Description of Artificial Sequence: Synthetic coding sequence
atggccgagctgggcgctggaggagatggccacagaggaggagatggagctgtgcgctcagaaacagccccagacagctacaaggtgcaggacaagaagaatgccagcagcaggcctgccagcgccatcagcggccagaacaacaaccacagcggcaacaagccagaccccccacctgtgctgcgggtggatgaccggcagaggctggcccgggagcggcgggaggagcgggagaagcagctggccgcccgggagatcgtgtggctggagcgggaggagcgggcccggcagcactatgagaagcacctggaggagaggaagaagaggctggaggagcagaggcagaaggaggagcggcggcgggctgctgtggaggagaagaggcggcagaggctggaggaggacaaggagagacatgaagctgtggtgcggaggaccatggagaggagccagaagcccaagcagaagcacaaccgctggagctggggcggcagcctgcacggcagccccagcatccacagcgctgaccctgacagaagatctgtgtccaccatgaacctgagcaaatatgtggaccctgtgatcagcaagaggctgagcagcagcagcgccaccctgctgaacagcccagaccgggcccggcggctgcagctgagcccctgggagagctctgtggtgaaccggctgctgacccccacccacagcttcctggcccggagcaagagcacagctgccctgtctggagaggccgccagctgcagccccatcatcatgccctacaaggccgcccacagcaggaacagcatggaccggcccaagctgtttgtgaccccacctgagggcagcagcagaagacgcatcatccatggaacagccagctacaagaaggagcgggagagagaaaatgtgctcttcctgaccagcggcaccaggagagctgtgagccccagcaaccccaaggcccggcagcctgcccggagccggctgtggctgcccagcaagagcctgccccacctgcccggcaccccccggcccaccagcagcctgcccccaggctctgtgaaggccgccccagcccaggtgcggccccccagccctggcaacatccggcctgtgaagcgggaggtgaaggtggagcctgagaagaaggaccctgagaaggagccccagaaggtggccaatgagcccagcctgaagggccgggcccccctggtgaaggtggaggaggccaccgtggaggagaggaccccagctgagcctgaggtgggccctgctgccccagccatggccccagccccagccagcgccccagccccagccagcgccccagccccagcccctgtgcccaccccagccatggtgtctgcccccagcagcacagtgaatgccagcgcctctgtgaagaccagcgctggcaccacagatcctgaggaggccacccggctgctggccgagaagaggcggctggcccgggagcagcgggagaaggaggagcgggagcggcgggagcaggaggagctggagcggcagaagcgggaggagctggcccagagggtggccgaggagaggaccacccggcgggaggaggagagccggcggctggaggccgagcaggcccgggagaaggaggagcagctgcagaggcaggccgaggagcgggccctgcgggagcgggaggaggccgagcgggcccagaggcagaaggaggaggaggcccgggtgcgggaggaggccgagcgggtgcggcaggagcgggagaagcacttccagcgggaggagcaggagcggctggagaggaagaagaggctggaggagatcatgaagaggaccaggagaacagaggccacagacaagaagaccagtgaccagagaaatggagacatcgccaagggggccctgaccggcggcacagaggtgtctgccctgccctgcaccaccaatgcccctggaaatggcaagcctgtgggcagcccccacgtggtgaccagccaccagagcaaggtgacagtggagagcaccccagacctggagaagcagcccaatgaaaatggagtgtctgtgcagaatgaaaattttgaggagatcatcaacctgcccatcggcagcaagcccagccggctggatgtgaccaacagcgagagccctgagatccccctgaaccccatcctggcctttgatgatgagggcaccctgggccccctgccccaggtggatggagtgcagacccagcagacagctgaggtgatctag

SEQ ID NO: 35762 - DNA, 1812 bp, Artificial Sequence
  Description of Artificial Sequence: Synthetic coding sequence
atggagaggagccagaagcccaagcagaagcacaaccgctggagctggggcggcagcctgcacggcagccccagcatccacagcgctgaccctgacagaagatctgtgtccaccatgaacctgagcaaatatgtggaccctgtgatcagcaagaggctgagcagcagcagcgccaccctgctgaacagcccagaccgggcccggcggctgcagctgagcccctgggagagctctgtggtgaaccggctgctgacccccacccacagcttcctggcccggagcaagagcacagctgccctgtctggagaggccgccagctgcagccccatcatcatgccctacaaggccgcccacagcaggaacagcatggaccggcccaagctgtttgtgaccccacctgagggcagcagcagaagacgcatcatccatggaacagccagctacaagaaggagcgggagagagaaaatgtgctcttcctgaccagcggcaccaggagagctgtgagccccagcaaccccaaggcccggcagcctgcccggagccggctgtggctgcccagcaagagcctgccccacctgcccggcaccccccggcccaccagcagcctgcccccaggctctgtgaaggccgccccagcccaggtgcggccccccagccctggcaacatccggcctgtgaagcgggaggtgaaggtggagcctgagaagaaggaccctgagaaggagccccagaaggtggccaatgagcccagcctgaagggccgggcccccctggtgaaggtggaggaggccaccgtggaggagaggaccccagctgagcctgaggtgggccctgctgccccagccatggccccagccccagccagcgccccagccccagccagcgccccagccccagcccctgtgcccaccccagccatggtgtctgcccccagcagcacagtgaatgccagcgcctctgtgaagaccagcgctggcaccacagatcctgaggaggccacccggctgctggccgagaagaggcggctggcccgggagcagcgggagaaggaggagcgggagcggcgggagcaggaggagctggagcggcagaagcgggaggagctggcccagagggtggccgaggagaggaccacccggcgggaggaggagagccggcggctggaggccgagcaggcccgggagaaggaggagcagctgcagaggcaggccgaggagcgggccctgcgggagcgggaggaggccgagcgggcccagaggcagaaggaggaggaggcccgggtgcgggaggaggccgagcgggtgcggcaggagcgggagaagcacttccagcgggaggagcaggagcggctggagaggaagaagaggctggaggagatcatgaagaggaccaggagaacagaggccacagacaagaagaccagtgaccagagaaatggagacatcgccaagggggccctgaccggcggcacagaggtgtctgccctgccctgcaccaccaatgcccctggaaatggcaagcctgtgggcagcccccacgtggtgaccagccaccagagcaaggtgacagtggagagcaccccagacctggagaagcagcccaatgaaaatggagtgtctgtgcagaatgaaaattttgaggagatcatcaacctgcccatcggcagcaagcccagccggctggatgtgaccaacagcgagagccctgagatccccctgaaccccatcctggcctttgatgatgagggcaccctgggccccctgccccaggtggatggagtgcagacccagcagacagctgaggtgatctag

SEQ ID NO: 35763 - DNA, 2205 bp, Artificial Sequence
  Description of Artificial Sequence: Synthetic coding sequence
atgcctggcagcgccacagccctgcggcatgagcggctgaagaagaccaatgcccggcccatccccctgggcctcttcaccatcaatgaagaagatgagcagcagaagaatggaaacagcagaagacccaaggccccagacagctacaaggtgcaggacaagaagaatgccagcagcaggcctgccagcgccatcagcggccagaacaacaaccacagcggcaacaagccagaccccccacctgtgctgcgggtggatgaccggcagaggctggcccgggagcggcgggaggagcgggagaagcagctggccgcccgggagatcgtgtggctggagcgggaggagcgggcccggcagcactatgagaagcacctggaggagaggaagaagaggctggaggagcagaggcagaaggaggagcggcggcgggctgctgtggaggagaagaggcggcagaggctggaggaggacaaggagagacatgaagctgtggtgcggaggaccatggagaggagccagaagcccaagcagaagcacaaccgctggagctggggcggcagcctgcacggcagccccagcatccacagcgctgcccggcggctgcagctgagcccctgggagagctctgtggtgaaccggctgctgacccccacccacagcttcctggcccggagcaagagcacagctgccctgagcggggaggccgccagctgcagccccatcatcatgccctacaaggccgcccacagcagaaattccatggaccggcccaagctgtttgtgaccccacctgagggcagcagcagaagacgcatcatccacggcacagccagctacaagaaggagcgggagcgggagaatgtgctcttcctgaccagcggcacccggcgggctgtgagccccagcaaccccaaggcccggcagcctgcccggagccggctgtggctgcccagcaagagcctgccccacctgcccggcaccccccggcccaccagcagcctgcccccaggctctgtgaaggccgccccagcccaggtgcggccccccagccctggcaacatccggcctgtgaagcgggaggtgaaggtggagcctgagaagaaggaccctgagaaggagccccagaaggtggccaatgagcccagcctgaagggccgggcccccctggtgaaggtggaggaggccaccgtggaggagaggaccccagctgagcctgaggtgggccctgctgccccagccatggccccagccccagccagcgccccagccccagccagcgccccagccccagcccctgtgcccaccccagccatggtgtctgcccccagcagcacagtgaatgccagcgcctctgtgaagaccagcgctggcaccacagatcctgaggaggccacccggctgctggccgagaagaggcggctggcccgggagcagcgggagaaggaggagcgggagcggcgggagcaggaggagctggagcggcagaagcgggaggagctggcccagagggtggccgaggagaggaccacccggcgggaggaggagagccggcggctggaggccgagcaggcccgggagaaggaggagcagctgcagaggcaggccgaggagcgggccctgcgggagcgggaggaggccgagcgggcccagaggcagaaggaggaggaggcccgggtgcgggaggaggccgagcgggtgcggcaggagcgggagaagcacttccagcgggaggagcaggagcggctggagaggaagaagaggctggaggagatcatgaagaggaccaggagaacagaggccacagacaagaagaccagtgaccagagaaatggagacatcgccaagggggccctgactggaggaacagaggtgtctgccctgccctgcaccaccaatgcccctggaaatggcaagcctgtgggcagcccccacgtggtgaccagccaccagagcaaggtgacagtggagagcaccccagacctggagaagcagcccaatgaaaatggagtgtctgtgcagaatgaaaattttgaggagatcatcaacctgcccatcggcagcaagcccagccggctggatgtgaccaacagcgagagccctgagatccccctgaaccccatcctggcctttgatgatgagggcaccctgggccccctgccccaggtggatggagtgcagacccagcagacagctgaggtgatctag

SEQ ID NO: 35764 - DNA, 2316 bp, Artificial Sequence
  Description of Artificial Sequence: Synthetic coding sequence
atgcctggcagcgccacagccctgcggcatgagcggctgaagaagaccaatgcccggcccatccccctgggcctcttcaccatcaatgaagaagatgagcagcagaagaatggaaacagcagaagacccaaggccccagacagctacaaggtgcaggacaagaagaatgccagcagcaggcctgccagcgccatcagcggccagaacaacaaccacagcggcaacaagccagaccccccacctgtgctgcgggtggatgaccggcagaggctggcccgggagcggcgggaggagcgggagaagcagctggccgcccgggagatcgtgtggctggagcgggaggagcgggcccggcagcactatgagaagcacctggaggagaggaagaagaggctggaggagcagaggcagaaggaggagcggcggcgggctgctgtggaggagaagaggcggcagaggctggaggaggacaaggagagacatgaagctgtggtgcggaggaccatggagaggagccagaagcccaagcagaagcacaaccgctggagctggggcggcagcctgcacggcagccccagcatccacagcgctgaccctgacagaagatctgtgtccaccatgaacctgagcaaatatgtggaccctgtgatcagcaagaggctgagcagcagcagcgccaccctgctgaacagcccagaccgggcccggcggctgcagctgagcccctgggagagctctgtggtgaaccggctgctgacccccacccacagcttcctggcccggagcaagagcacagctgccctgtctggagaggccgccagctgcagccccatcatcatgccctacaaggccgcccacagcaggaacagcatggaccggcccaagctgtttgtgaccccacctgagggcagcagcagaagacgcatcatccatggaacagccagctacaagaaggagcgggagagagaaaatgtgctcttcctgaccagcggcaccaggagagctgtgagccccagcaaccccaaggcccggcagcctgcccggagccggctgtggctgcccagcaagagcctgccccacctgcccggcaccccccggcccaccagcagcctgcccccaggctctgtgaaggccgccccagcccaggtgcggccccccagccctggcaacatccggcctgtgaagcgggaggtgaaggtggagcctgagaagaaggaccctgagaaggagccccagaaggtggccaatgagcccagcctgaagggccgggcccccctggtgaaggtggaggaggccaccgtggaggagaggaccccagctgagcctgaggtgggccctgctgccccagccatggccccagccccagccagcgccccagccccagccagcgccccagccccagcccctgtgcccaccccagccatggtgtctgcccccagcagcacagtgaatgccagcgcctctgtgaagaccagcgctggcaccacagatcctgaggaggccacccggctgctggccgagaagaggcggctggcccgggagcagcgggagaaggaggagcgggagcggcgggagcaggaggagctggagcggcagaagcgggaggagctggcccagagggtggccgaggagaggaccacccggcgggaggaggagagccggcggctggaggccgagcaggcccgggagaaggaggagcagctgcagaggcaggccgaggagcgggccctgcgggagcgggaggaggccgagcgggcccagaggcagaaggaggaggaggcccgggtgcgggaggaggccgagcgggtgcggcaggagcgggagaagcacttccagcgggaggagcaggagcggctggagaggaagaagaggctggaggagatcatgaagaggaccaggagaacagaggccacagacaagaagaccagtgaccagagaaatggagacatcgccaagggggccctgaccggcggcacagaggtgtctgccctgccctgcaccaccaatgcccctggaaatggcaagcctgtgggcagcccccacgtggtgaccagccaccagagcaaggtgacagtggagagcaccccagacctggagaagcagcccaatgaaaatggagtgtctgtgcagaatgaaaattttgaggagatcatcaacctgcccatcggcagcaagcccagccggctggatgtgaccaacagcgagagccctgagatccccctgaaccccatcctggcctttgatgatgagggcaccctgggccccctgccccaggtggatggagtgcagacccagcagacagctgaggtgatctag

SEQ ID NO: 35765 - DNA, 2205 bp, Artificial Sequence
  Description of Artificial Sequence: Synthetic coding sequence
atggaggacaccaagctgtacagcccagacagctacaaggtgcaggacaagaagaatgccagcagcaggcctgccagcgccatcagcggccagaacaacaaccacagcggcaacaagccagaccccccacctgtgctgcgggtggatgaccggcagaggctggcccgggagcggcgggaggagcgggagaagcagctggccgcccgggagatcgtgtggctggagcgggaggagcgggcccggcagcactatgagaagcacctggaggagaggaagaagaggctggaggagcagaggcagaaggaggagaggagaagagctgctgtggaggagaagaggcggcagaggctggaggaggacaaggagagacatgaggccgtggtgcggaggaccatggagaggagccagaagcccaagcagaagcacaaccgctggagctggggcggcagcctgcacggcagccccagcatccacagcgctgaccctgaccggcgctctgtgtccaccatgaacctgagcaaatatgtggaccccgtcatcagcaagaggctgagcagcagcagcgccaccctgctgaacagcccagaccgggcccggcggctgcagctgagcccctgggagagctctgtggtgaaccggctgctgacccccacccacagcttcctggcccggagcaagagcacagctgccctgagcggggaggccgccagctgcagccccatcatcatgccctacaaggccgcccacagcagaaattccatggaccggcccaagctgtttgtgaccccacctgagggcagcagcagaagacgcatcatccacggcacagccagctacaagaaggagcgggagcgggagaatgtgctcttcctgaccagcggcacccggcgggctgtgagccccagcaaccccaaggcccggcagcctgcccggagccggctgtggctgcccagcaagagcctgccccacctgcccggcaccccccggcccaccagcagcctgcccccaggctctgtgaaggccgccccagcccaggtgcggccccccagccctggcaacatccggcctgtgaagcgggaggtgaaggtggagcctgagaagaaggaccctgagaaggagccccagaaggtggccaatgagcccagcctgaagggccgggcccccctggtgaaggtggaggaggccaccgtggaggagaggaccccagctgagcctgaggtgggccctgctgccccagccatggccccagccccagccagcgccccagccccagccagcgccccagccccagcccctgtgcccaccccagccatggtgtctgcccccagcagcacagtgaatgccagcgcctctgtgaagaccagcgctggcaccacagatcctgaggaggccacccggctgctggccgagaagaggcggctggcccgggagcagcgggagaaggaggagcgggagcggcgggagcaggaggagctggagcggcagaagcgggaggagctggcccagagggtggccgaggagaggaccacccggcgggaggaggagagccggcggctggaggccgagcaggcccgggagaaggaggagcagctgcagaggcaggccgaggagcgggccctgcgggagcgggaggaggccgagcgggcccagaggcagaaggaggaggaggcccgggtgcgggaggaggccgagcgggtgcggcaggagcgggagaagcacttccagcgggaggagcaggagcggctggagaggaagaagaggctggaggagatcatgaagaggaccaggagaacagaggccacagacaagaagaccagtgaccagagaaatggagacatcgccaagggggccctgactggaggaacagaggtgtctgccctgccctgcaccaccaatgcccctggaaatggcaagcctgtgggcagcccccacgtggtgaccagccaccagagcaaggtgacagtggagagcaccccagacctggagaagcagcccaatgaaaatggagtgtctgtgcagaatgaaaattttgaggagatcatcaacctgcccatcggcagcaagcccagccggctggatgtgaccaacagcgagagccctgagatccccctgaaccccatcctggcctttgatgatgagggcaccctgggccccctgccccaggtggatggagtgcagacccagcagacagctgaggtgatctag

SEQ ID NO: 35766 - DNA, 3021 bp, Artificial Sequence
  Description of Artificial Sequence: Synthetic coding sequence
atgagcaacagcaggaacaacagagtgatggtggagggcgtgggcgcccgggtggtgcggggccctgactggaagtggggcaagcaggacggcggggagggccacgtgggcaccgtgcgcagctttgagagccctgaggaggtggtggtggtgtgggacaatggaacagctgccaactaccgctgcagcggggcctatgacctgcgcatcctggacagcgcccccaccggcatcaagcatgatggcaccatgtgtgacacctgccggcagcagcccatcatcggcatccgctggaagtgtgccgagtgcaccaactatgacctgtgcaccgtgtgctaccacggggacaagcaccacctgcggcaccgcttctaccgcatcaccaccccaggcagcgagcgggtgctgctggagagcaggaggaagagcaagaagatcacagcccggggcatctttgctggggcccgggtggtgcggggcgtggactggcagtgggaggaccaggacggcggcaatggccggcggggcaaggtgacagagatccaggactggagcgccagcagcccccacagcgctgcctacgtgctgtgggacaatggagccaagaacctgtacagagtgggctttgagggcatgtctgacctgaagtgtgtgcaggatgccaagggcggcagcttctacagagaccactgccctgtgctgggggagcagaatggaaacagaaatcctgggggcctgcagatcggggacctggtgaacatcgacctggacctggagatcgtgcagagcctgcagcacggccacggcggctggacagatggcatgtttgagaccctgaccaccaccggcaccgtgtgtggcattgatgaggaccatgacatcgtggtgcagtaccccagcggcaaccgctggaccttcaacccagctgtgctgaccaaggccaacatcgtgcgctctggagatgctgcccagggcgctgagggcggcaccagccagttccaggtgggggacctggtgcaggtgtgctatgacctggagcgcatcaagctgctgcagaggggccatggagagtgggccgaggccatgctgcccaccctgggcaaggtgggccgggtgcagcagatctacagcgacagcgacctgaaggtggaggtgtgtggcacctcctggacctacaacccagctgctgtgtccaaggtggccagcgctggcagcgccatcagcaatgccagcggggagcggctgagccagctgctgaagaagctgtttgagacccaggagagcggggacctgaatgaggagctggtgaaggctgctgccaatggagatgtggccaaggtggaggacctgctgaagaggccagatgtggatgtgaatggccagtgtgccggccacacagccatgcaggccgccagccagaatggccacgtggacatcctgaagctgctgctgaagcagaatgtggatgtggaggccgaggacaaggatggagacagagctgtgcaccacgccgcctttggagatgagggcgctgtgattgaggtgctgcaccggggcagcgctgacctgaatgccaggaacaagaggcggcagacccccctgcacatcgctgtgaacaagggccacctgcaggtggtgaagaccctgctggactttggctgccaccccagcctgcaggacagcgagggggacacccccctgcatgatgccatcagcaagaagagagatgacatcctggccgtgctgctggaggccggggctgatgtgaccatcaccaacaacaacggcttcaatgccctgcaccacgccgccctgcggggcaaccccagcgccatgagggtgctgctgagcaagctgccccggccctggatcgtggatgagaagaaggatgatggctacacagccctgcacctggccgccctgaacaaccacgtggaggtggccgagctgctggtgcaccagggcaatgccaacctggacatccagaatgtgaaccagcagacagccctgcacctggccgtggagcggcagcacacccagatcgtgcggctgctggtgcgggccggggccaagctggacatccaggacaaggatggagacacccccctgcacgaggccctgcggcaccacaccctgagccagctgcggcagctgcaggacatgcaggatgtgggcaaggtggatgctgcctgggagcccagcaagaacaccctcatcatgggcctgggcacccagggcgctgagaagaagtctgctgccagcatcgcctgcttcctggccgccaacggggctgacctgagcatccggaacaagaagggccagagccccctggacctgtgcccagaccccaacctgtgcaaggccctggccaagtgccacaaggagaaggtgtctggccaggtgggcagccgcagccccagcatgatcagcaatgattctgagaccctggaggagtgcatggtgtgcagcgacatgaagagggacaccctgtttggcccctgtggccacatcgccacctgcagcctgtgcagcccccgggtgaagaagtgcctgatctgcaaggagcaggtgcagagcaggaccaagattgaagaatgtgtggtgtgcagcgacaagaaggctgctgtgctcttccagccctgtggccacatgtgtgcctgtgagaactgtgccaacctgatgaagaagtgtgtgcagtgcagagctgtggtggagcggcgggtgcccttcatcatgtgctgcggcggcaagagcagtgaagatgccacagatgacatcagcagcggcaacatccctgtgctgcagaaggacaaggacaacaccaacgtgaatgctgatgtgcagaagctgcagcagcagctgcaggacatcaaggagcagaccatgtgccctgtgtgcctggaccggctgaagaacatgatcttcctgtgtggccacggcacctgccagctgtgtggggacaggatgtctgaatgtcccatctgcaggaaggccattgaaagacgcatcctgctgtactag

SEQ ID NO: 35767 - DNA, 750 bp, Artificial Sequence
  Description of Artificial Sequence: Synthetic coding sequence
atggccaagagcggcctgcggcaggacccccagagcacagctgctgccaccgtgctgaagagagctgtggagctggacagcgagagccgctacccccaggccctggtgtgctaccaggagggcatcgacctgctgctgcaggtgctgaagggcaccaaggacaacaccaagcgctgcaacctgcgggagaagatcagcaagtacatggacagagctgagaacatcaagaagtacctggaccaggagaaggaggatggcaagtaccacaagcagatcaagattgaggagaatgccaccggcttctcctatgagagcctcttccgggagtacctgaatgagaccgtgacagaggtgtggattgaggacccctacatccgccacacccaccagctgtacaacttcctgcgcttctgtgagatgctgatcaagaggccctgcaaggtgaagaccatccacctgctgaccagcctggatgagggcatcgagcaggtgcagcagagccggggcctgcaggagattgaggagagcctgcggagccacggcgtgctgctggaggtgcagtacagcagcagcatccatgaccgggagatccgcttcaacaacggctggatgatcaagattggccggggcctggactacttcaagaagccccagagccgcttcagcctgggctactgtgactttgacctgcggccctgccacgagaccaccgtggacatcttccacaagaagcacaccaagaacatctag

SEQ ID NO: 35768 - DNA, 696 bp, Artificial Sequence
  Description of Artificial Sequence: Synthetic coding sequence
ctgaagagagctgtggagctggacagcgagagccgctacccccaggccctggtgtgctaccaggagggcatcgacctgctgctgcaggtgctgaagggcaccaaggacaacaccaagcgctgcaacctgcgggagaagatcagcaagtacatggacagagctgagaacatcaagaagtacctggaccaggagaaggaggatggcaagtaccacaagcagatcaagattgaggagaatgccaccggcttctcctatgagagcctcttccgggagtacctgaatgagaccgtgacagaggtgtggattgaggacccctacatccgccacacccaccagctgtacaacttcctgcgcttctgtgagatgctgatcaagaggccctgcaaggtgaagaccatccacctgctgaccagcctggatgagggcatcgagcaggtgcagcagagccggggcctgcaggagattgaggagagcctgcggagccacggcgtgctgctggaggtgcagtacagcagcagcatccatgaccgggagatccgcttcaacaacggctggatgatcaagattggccggggcctggactacttcaagaagccccagagccgcttcagcctgggctactgtgactttgacctgcggccctgccacgagaccaccgtggacatcttccacaagaagcacaccaagaacatctag

SEQ ID NO: 35769 - DNA, 1431 bp, Artificial Sequence
  Description of Artificial Sequence: Synthetic coding sequence
atgttccggctgaacagcctgagcgccctggccgagctggccgtgggcagccgctggtaccatggaggcagccagcccatccagatcagaagaaggctgatgatggtggccttcctgggcgccagcgctgtgacagccagcacaggcctgctgtggaagagggcccatgctgagagccccccctgtgtggacaacctgaagagtgacatcggggacaagggcaagaacaaggatgaaggagatgtgtgcaaccacgagaagaagacagctgacctggccccccaccctgaggagaagaagaagaagaggagcggcttccgggacaggaaggtgatggagtatgaaaatcgcatccgggcctacagcaccccagacaagatcttccgctactttgccaccctgaaggtgatcagcgagcccggggaggccgaggtgttcatgaccccagaggactttgtgcgcagcatcaccccaaatgagaagcagcctgagcacctgggcctggaccagtacatcatcaagagatttgatggcaagaagatcagccaggagcgggagaagtttgctgatgagggcagcatcttctacaccctgggggagtgtggcctcatctccttcagtgactacatcttcctgaccaccgtgctgagcaccccccagaggaactttgaaattgccttcaagatgtttgacctgaatggagatggagaggtggacatggaggagtttgagcaggtgcagagcatcatccgcagccagacctccatgggcatgaggcaccgggaccggcccaccaccggcaacaccctgaagagcggcctgtgcagcgccctgaccacctacttctttggagctgacctgaagggcaagctgaccatcaagaacttcctggagttccagaggaagctgcagcatgatgtgctgaagctggagtttgaaagacatgaccctgtggatggccgcatcacagagcggcagtttggaggcatgctgctggcctacagcggcgtgcagagcaagaagctgacagccatgcagaggcagctgaagaagcacttcaaggagggcaagggcctgaccttccaggaggtggagaacttcttcaccttcctgaagaacatcaatgatgtggacacagccctgtccttctaccacatggccggggccagcctggacaaggtgaccatgcagcaggtggccaggacagtggccaaggtggagctgagtgaccacgtgtgtgatgtggtgtttgccctgtttgactgtgatggaaatggagagctgagcaacaaggagtttgtgtccatcatgaagcagaggctgatgaggggcctggagaagcccaaggacatgggcttcacccggctgatgcaggccatgtggaagtgtgcccaggagacagcctgggactttgccctgcccaagcagtag

SEQ ID NO: 35770 - DNA, 1437 bp, Artificial Sequence
  Description of Artificial Sequence: Synthetic coding sequence
atgttccggctgaacagcctgagcgccctggccgagctggccgtgggcagccgctggtaccatggaggcagccagcccatccagatcagaagaaggctgatgatggtggccttcctgggcgccagcgctgtgacagccagcacaggcctgctgtggaagagggcccatgctgagagccccccctgtgtggacaacctgaagagtgacatcggggacaagggcaagaacaaggatgaaggagatgtgtgcaaccacgagaagaagacagctgacctggccccccaccctgaggagaagaagaagaagaggagcggcttccgggacaggaaggtgatggagtatgaaaatcgcatccgggcctacagcaccccagacaagatcttccgctactttgccaccctgaaggtgatcagcgagcccggggaggccgaggtgttcatgaccccagaggactttgtgcgcagcatcaccccaaatgagaagcagcctgagcacctgggcctggaccagtacatcatcaagagatttgatggcaagaacaagaagatcagccaggagcgggagaagtttgctgatgagggcagcatcttctacaccctgggggagtgtggcctcatctccttcagtgactacatcttcctgaccaccgtgctgagcaccccccagaggaactttgaaattgccttcaagatgtttgacctgaatggagatggagaggtggacatggaggagtttgagcaggccatcagcatcatccgcagccagacctccatgggcatgaggcaccgggaccggcccaccaccggcaacaccctgaagagcggcctgtgcagcgccctgaccacctacttctttggagctgacctgaagggcaagctgaccatcaagaacttcctggagttccagaggaagctgcagcatgatgtgctgaagctggagtttgaaagacatgaccctgtggatggccgcatcacagagcggcagtttggaggcatgctgctggcctacagcggcgtgcagagcaagaagctgacagccatgcagaggcagctgaagaagcacttcaaggagggcaagggcctgaccttccaggaggtggagaacttcttcaccttcctgaagaacatcaatgatgtggacacagccctgtccttctaccacatggccggggccagcctggacaaggtgaccatgcagcaggtggccaggacagtggccaaggtggagctgagtgaccacgtgtgtgatgtggtgtttgccctgtttgactgtgatggaaatggagagctgagcaacaaggagtttgtgtccatcatgaagcagaggctgatgaggggcctggagaagcccaaggacatgggcttcacccggctgatgcaggccatgtggaagtgtgcccaggagacagcctgggactttgccctgcccaagcagtag

SEQ ID NO: 35771 - DNA, 837 bp, Artificial Sequence
  Description of Artificial Sequence: Synthetic coding sequence
atggtgtccctgaaggccaagctgaaccacctgcggcagagcatgctgaagcagaaggccccccagaggaactttgaaattgccttcaagatgtttgacctgaatggagatggagaggtggacatggaggagtttgagcaggtgcagagcatcatccgcagccagacctccatgggcatgaggcaccgggaccggcccaccaccggcaacaccctgaagagcggcctgtgcagcgccctgaccacctacttctttggagctgacctgaagggcaagctgaccatcaagaacttcctggagttccagaggaagctgcagcatgatgtgctgaagctggagtttgaaagacatgaccctgtggatggccgcatcacagagcggcagtttggaggcatgctgctggcctacagcggcgtgcagagcaagaagctgacagccatgcagaggcagctgaagaagcacttcaaggagggcaagggcctgaccttccaggaggtggagaacttcttcaccttcctgaagaacatcaatgatgtggacacagccctgtccttctaccacatggccggggccagcctggacaaggtgaccatgcagcaggtggccaggacagtggccaaggtggagctgagtgaccacgtgtgtgatgtggtgtttgccctgtttgactgtgatggaaatggagagctgagcaacaaggagtttgtgtccatcatgaagcagaggctgatgaggggcctggagaagcccaaggacatgggcttcacccggctgatgcaggccatgtggaagtgtgcccaggagacagcctgggactttgccctgcccaagcagtag

SEQ ID NO: 35772 - DNA, 1431 bp, Artificial Sequence
  Description of Artificial Sequence: Synthetic coding sequence
atgttccggctgaacagcctgagcgccctggccgagctggccgtgggcagccgctggtaccatggaggcagccagcccatccagatcagaagaaggctgatgatggtggccttcctgggcgccagcgctgtgacagccagcacaggcctgctgtggaagagggcccatgctgagagccccccctgtgtggacaacctgaagagtgacatcggggacaagggcaagaacaaggatgaaggagatgtgtgcaaccacgagaagaagacagctgacctggccccccaccctgaggagaagaagaagaagaggagcggcttccgggacaggaaggtgatggagtatgaaaatcgcatccgggcctacagcaccccagacaagatcttccgctactttgccaccctgaaggtgatcagcgagcccggggaggccgaggtgttcatgaccccagaggactttgtgcgcagcatcaccccaaatgagaagcagcctgagcacctgggcctggaccagtacatcatcaagagatttgatggcaagaagatcagccaggagcgggagaagtttgctgatgagggcagcatcttctacaccctgggggagtgtggcctcatctccttcagtgactacatcttcctgaccaccgtgctgagcaccccccagaggaactttgaaattgccttcaagatgtttgacctgaatggagatggagaggtggacatggaggagtttgagcaggccatcagcatcatccgcagccagacctccatgggcatgaggcaccgggaccggcccaccaccggcaacaccctgaagagcggcctgtgcagcgccctgaccacctacttctttggagctgacctgaagggcaagctgaccatcaagaacttcctggagttccagaggaagctgcagcatgatgtgctgaagctggagtttgaaagacatgaccctgtggatggccgcatcacagagcggcagtttggaggcatgctgctggcctacagcggcgtgcagagcaagaagctgacagccatgcagaggcagctgaagaagcacttcaaggagggcaagggcctgaccttccaggaggtggagaacttcttcaccttcctgaagaacatcaatgatgtggacacagccctgtccttctaccacatggccggggccagcctggacaaggtgaccatgcagcaggtggccaggacagtggccaaggtggagctgagtgaccacgtgtgtgatgtggtgtttgccctgtttgactgtgatggaaatggagagctgagcaacaaggagtttgtgtccatcatgaagcagaggctgatgaggggcctggagaagcccaaggacatgggcttcacccggctgatgcaggccatgtggaagtgtgcccaggagacagcctgggactttgccctgcccaagcagtag

SEQ ID NO: 35773 - DNA, 837 bp, Artificial Sequence
  Description of Artificial Sequence: Synthetic coding sequence
atgaagaggatctacacctaccgccgggccaaggagatcttcaaggacacccccaaggccccccagaggaactttgaaattgccttcaagatgtttgacctgaatggagatggagaggtggacatggaggagtttgagcaggtgcagagcatcatccgcagccagacctccatgggcatgaggcaccgggaccggcccaccaccggcaacaccctgaagagcggcctgtgcagcgccctgaccacctacttctttggagctgacctgaagggcaagctgaccatcaagaacttcctggagttccagaggaagctgcagcatgatgtgctgaagctggagtttgaaagacatgaccctgtggatggccgcatcacagagcggcagtttggaggcatgctgctggcctacagcggcgtgcagagcaagaagctgacagccatgcagaggcagctgaagaagcacttcaaggagggcaagggcctgaccttccaggaggtggagaacttcttcaccttcctgaagaacatcaatgatgtggacacagccctgtccttctaccacatggccggggccagcctggacaaggtgaccatgcagcaggtggccaggacagtggccaaggtggagctgagtgaccacgtgtgtgatgtggtgtttgccctgtttgactgtgatggaaatggagagctgagcaacaaggagtttgtgtccatcatgaagcagaggctgatgaggggcctggagaagcccaaggacatgggcttcacccggctgatgcaggccatgtggaagtgtgcccaggagacagcctgggactttgccctgcccaagcagtag

SEQ ID NO: 35774 - DNA, 1092 bp, Artificial Sequence
  Description of Artificial Sequence: Synthetic coding sequence
atggatggcggcagcggcggcctgggcagcggggacaatgcccccaccacagaggccctgtttgtggccctgggcgctggggtgacagccctgagccaccccctgctgtatgtgaagctgctgatccaggtgggccacgagcccatgccacccaccctgggcaccaacgtgctgggcaggaaggtgctgtacctgcccagcttcttcacctacgccaagtacatcgtgcaggtggatggcaagattggcctcttccggggcctgagcccccggctgatgagcaatgccctgagcacagtgacccggggctccatgaagaaggtgttccccccagatgaaattgagcaggtgagcaacaaggatgacatgaagaccagcctgaagaaggtggtgaaggagaccagctatgagatgatgatgcagtgtgtgtccaggatgctggcccaccccctgcacgtgatctccatgcgctgcatggtgcagtttgtgggccgggaggccaagtacagcggcgtgctgagcagcatcggcaagatcttcaaggaggagggcctgctgggcttctttgtgggcctcatcccccacctgctgggagatgtggtgttcctgtggggctgcaacctgctggcccacttcatcaatgcctacctggtggatgacagcttcagccaggccctggccatccgcagctacaccaagtttgtgatgggcattgctgtgtccatgctgacctaccccttcctgctggtgggggacctgatggctgtgaacaactgtggcctgcaggccggcctgcccccctacagccctgtgttcaagtcctggatccactgctggaagtacctgtctgtgcagggccagctgttccggggcagcagctgcttctctgctggctgccaccaggaccacgccctgccctggagcaacctgaaccacctgaagaacacagtgtccacctggccaccctgggtgcggccagaccacctgggcaccccagcccggcggctgcagcccaacaacaaccagatgtgcagcagccctgctggcctgcagttccacatctgccacgtgtctgtgcagatgtggggctag

SEQ ID NO: 35775 - DNA, 1074 bp, Artificial Sequence
  Description of Artificial Sequence: Synthetic coding sequence
atggatggcggcagcggcggcctgggcagcggggacaatgcccccaccacagaggccctgtttgtggccctgggcgctggggtgacagccctgagccaccccctgctgtatgtgaagctgctgatccaggtgggccacgagcccatgccacccaccctgggcaccaacgtgctgggcaggaaggtgctgtacctgcccagcttcttcacctacgccaagtacatcgtgcaggtggatggcaagattggcctcttccggggcctgagcccccggctgatgagcaatgccctgagcacagtgacccggggctccatgaagaaggtgttccccccagatgaaattgagcaggtgagcaacaaggatgacatgaagaccagcctgaagaaggtggtgaaggagaccagctatgagatgatgatgcagtgtgtgtccaggatgctggcccaccccctgcacgtgatctccatgcgctgcatggtgcagtttgtgggccgggaggccaagtacagcggcgtgctgagcagcatcggcaagatcttcaaggaggagggcctgctgggcttctttgtgggcctcatcccccacctgctgggagatgtggtgttcctgtggggctgcaacctgctggcccacttcatcaatgcctacctggtggatgattctgtcatccagcccggccctggccaccctgagctgtaccaggtgagagatggagactgcagcgagcacgccgacctgcccctgcctgcctcctggaggcctcatggctgtgagcagctgcgggccgcctcctgggccccacccctgctgcccagcgtgcagatcctggacagcctgctggaggtgcctgaatgtgccgcctgcttctctgctggctgccaccaggaccacgccctgccctggagcaacctgaaccacctgaagaacacagtgtccacctggccaccctgggtgcggccagaccacctgggcaccccagcccggcggctgcagcccaacaacaaccagatgtgcagcagccctgctggcctgcagttccacatctgccacgtgtctgtgcagatgtggggctag

SEQ ID NO: 35776 - DNA, 561 bp, Artificial Sequence
  Description of Artificial Sequence: Synthetic coding sequence
gctgtgtgtgtgccccacgtgggccccccaccagcctgccacctgaatgccctgcacggccctgtgtgtggcactggaggccaggtgcagctgagctgtggggccaccatccctggcagcagcgctgccatggtgccccactttggagtcatcaacgggaagctggcccacagccccaggctcatcatgtctggagtgctgagcagcatcggcaagatcttcaaggaggagggcctgctgggcttctttgtgggcctcatcccccacctgctgggagatgtggtgttcctgtggggctgcaacctgctggcccacttcatcaatgcctacctggtggatgacagcttcagccaggccctggccatccgcagctacaccaagtttgtgatgggcattgctgtgtccatgctgacctaccccttcctgctggtgggggacctgatggctgtgaacaactgtggcctgcaggccggcctgcccccctacagccctgtggccagcagcagcgaggccccagcctgcttctctgctggctgccaccaggaccacgccctgccctag

SEQ ID NO: 35777 - DNA, 1119 bp, Artificial Sequence
  Description of Artificial Sequence: Synthetic coding sequence
atgggcgccagtgaccctgaggtggccccctgggcccggggcggcgctgctggcatggccggggccggggccggggccggggcccggggcggcgctgctgctggggtggaggcccgggcccgggaccccccaccagcccaccgggcccaccccaggcaccccaggcctgctgcccagcccagcgcccggaggatggatggcggcagcggcggcctgggcagcggggacaatgcccccaccacagaggccctgtttgtggccctgggcgctggggtgacagccctgagccaccccctgctgtatgtgaagctgctgatccaggtgggccacgagcccatgccacccaccctgggcaccaacgtgctgggcaggaaggtgctgtacctgcccagcttcttcacctacgccaagtacatcgtgcaggtggatggcaagattggcctcttccggggcctgagcccccggctgatgagcaatgccctgagcacagtgacccggggctccatgaagaaggtgttccccccagatgaaattgagcaggtgagcaacaaggatgacatgaagaccagcctgaagaaggtggtgaaggagaccagctatgagatgatgatgcagtgtgtgtccaggatgctggcccaccccctgcacgtgatctccatgcgctgcatggtgcagtttgtgggccgggaggccaagtacagcggcgtgctgagcagcatcggcaagatcttcaaggaggagggcctgctgggcttctttgtgggcctcatcccccacctgctgggagatgtggtgttcctgtggggctgcaacctgctggcccacttcatcaatgcctacctggtggatgacagcttcagccaggccctggccatccgcagctacaccaagtttgtgatgggcattgctgtgtccatgctgacctaccccttcctgctggtgggggacctgatggctgtgaacaactgtggcctgcaggccggcctgcccccctacagccctgtgttcaagtcctggatccactgctggaagtacctgtctgtgcagggccagctgttccggggcagcagcctgctcttcagaagagtgagcagcggcagctgctttgccctggagtag

SEQ ID NO: 35778 - DNA, 1170 bp, Artificial Sequence
  Description of Artificial Sequence: Synthetic coding sequence
atgggcgccagtgaccctgaggtggccccctgggcccggggcggcgctgctggcatggccggggccggggccggggccggggcccggggcggcgctgctgctggggtggaggcccgggcccgggaccccccaccagcccaccgggcccaccccaggcaccccaggcctgctgcccagcccagcgcccggaggatggatggcggcagcggcggcctgggcagcggggacaatgcccccaccacagaggccctgtttgtggccctgggcgctggggtgacagccctgagccaccccctgctgtatgtgaagctgctgatccaggtgggccacgagcccatgccacccaccctgggcaccaacgtgctgggcaggaaggtgctgtacctgcccagcttcttcacctacgccaagtacatcgtgcaggtggatggcaagattggcctcttccggggcctgagcccccggctgatgagcaatgccctgagcacagtgacccggggctccatgaagaaggtgttccccccagatgaaattgagcaggtgagcaacaaggatgacatgaagaccagcctgaagaaggtggtgaaggagaccagctatgagatgatgatgcagtgtgtgtccaggatgctggcccaccccctgcacgtgatctccatgcgctgcatggtgcagtttgtgggccgggaggccaagtacagcggcgtgctgagcagcatcggcaagatcttcaaggaggagggcctgctgggcttctttgtgggcctcatcccccacctgctgggagatgtggtgttcctgtggggctgcaacctgctggcccacttcatcaatgcctacctggtggatgattctgtgtctgacacccctgggggcctgggcaatgaccagaaccctggcagccagttcagccaggccctggccatccgcagctacaccaagtttgtgatgggcattgctgtgtccatgctgacctaccccttcctgctggtgggggacctgatggctgtgaacaactgtggcctgcaggccggcctgcccccctacagccctgtgttcaagtcctggatccactgctggaagtacctgtctgtgcagggccagctgttccggggcagcagcctgctcttccggcgggtgagcagcggcagctgctttgccctggagtag

SEQ ID NO: 35779 - DNA, 606 bp, Artificial Sequence
  Description of Artificial Sequence: Synthetic coding sequence
tgagctgtgtgtgtgccccacgtgggccccccaccagcctgccacctgaatgccctgcacggccctgtgtgtggcaccggcggccaggtgcagctgagctgtggggccaccatccctggcagcagcgctgccatggtgccccactttggagtcatcaatggcaagctggcccacagccccaggctcatcatgtctggagtgctgagcagcatcggcaagatcttcaaggaggagggcctgctgggcttctttgtgggcctcatcccccacctgctgggagatgtggtgttcctgtggggctgcaacctgctggcccacttcatcaatgcctacctggtggatgacagcttcagccaggccctggccatccgcagctacaccaagtttgtgatgggcattgctgtgtccatgctgacctaccccttcctgctggtgggggacctgatggctgtgaacaactgtggcctgcaggccggcctgcccccctacagccctgtgttcaagtcctggatccactgctggaagtacctgtctgtgcagggccagctgttccggggcagcagcctgctcttccggcgggtgagcagcggcagctgctttgcctag

SEQ ID NO: 35780 - DNA, 1185 bp, Artificial Sequence
  Description of Artificial Sequence: Synthetic coding sequence
gctggcatggccggggccggggccggggccggggcccggggcggcgctgctgctggggtggaggcccgggcccgggaccccccaccagcccaccgggcccaccccaggcaccccaggcctgctgcccagcccagcgcccggaggatggatggcggcagcggcggcctgggcagcggggacaatgcccccaccacagaggccctgtttgtggccctgggcgctggggtgacagccctgagccaccccctgctgtatgtgaagctgctgatccaggtgggccacgagcccatgccacccaccctgggcaccaacgtgctgggcaggaaggtgctgtacctgcccagcttcttcacctacgccaagtacatcgtgcaggtggatggcaagattggcctcttccggggcctgagcccccggctgatgagcaatgccctgagcacagtgacccggggctccatgaagaaggtgttccccccagatgaaattgagcaggtgagcaacaaggatgacatgaagaccagcctgaagaaggtggtgaaggagaccagctatgagatgatgatgcagtgtgtgtccaggatgctggcccaccccctgcacgtgatctccatgcgctgcatggtgcagtttgtgggccgggaggccaagtacagcggcgtgctgagcagcatcggcaagatcttcaaggaggagggcctgctgggcttctttgtgggcctcatcccccacctgctgggagatgtggtgttcctgtggggctgcaacctgctggcccacttcatcaatgcctacctggtggatgacagcttcagccaggccctggccatccgcagctacaccaagtttgtgatgggcattgctgtgtccatgctgacctaccccttcctgctggtgggggacctgatggctgtgaacaactgtggcctgcaggccggcctgcccccctacagccctgtgttcaagtcctggatccactgctggaagtacctgtctgtgcaggtgtccaagcactggacagctgaggccttccctgtgctgtgctacatcctgcagctgaagtggttctgtggctgcttcatcgcctgcaaggacaagtggttccacggcatccagtactgtgaggagatcctgggcatctacaaggccttcaagttcagcagctacatcatcagcgagcgcatctag

SEQ ID NO: 35781 - DNA, 765 bp, Artificial Sequence
  Description of Artificial Sequence: Synthetic coding sequence
atgagcaatgccctgagcacagtgacccggggctccatgaagaaggtgttccccccagatgaaattgagcaggtgagcaacaaggatgacatgaagaccagcctgaagaaggtggtgaaggagaccagctatgagatgatgatgcagtgtgtgtccaggatgctggcccaccccctgcacgtgatctccatgcgctgcatggtgcagtttgtgggccgggaggccaagtacagcggcgtgctgagcagcatcggcaagatcttcaaggaggagggcctgctgggcttctttgtgggcctcatcccccacctgctgggagatgtggtgttcctgtggggctgcaacctgctggcccacttcatcaatgcctacctggtggatgacagcttcagccaggccctggccatccgcagctacaccaagtttgtgatgggcattgctgtgtccatgctgacctaccccttcctgctggtgggggacctgatggctgtgaacaactgtggcctgcaggccggcctgcccccctacagccctgtgttcaagtcctggatccactgctggaagtacctgtctgtgcaggtgtccaagcactggacagctgaggccttccctgtgctgtgctacatcctgcagctgaagtggttctgtggctgcttcatcgcctgcaaggacaagtggttccacggcatccagtactgtgaggagatcctgggcatctacaaggccttcaagttcagcagctacatcatcagcgagcgcatctag

SEQ ID NO: 35782 - DNA, 894 bp, Artificial Sequence
  Description of Artificial Sequence: Synthetic coding sequence
atgatggacagcgaggcccacgagaagaggcctcccatcctgaccagcagcaagcaggacatcagcccccacatcaccaacgtgggggagatgaagcactacctgtgtggctgctgtgccgccttcaacaacgtggccatcaccttccccatccagaaggtgctcttccggcagcagctgtatggcatcaagaccagagatgccatcctgcagctgcggagagatggcttcaggaacctgtaccggggcatcctgccccccctgatgcagaagaccaccaccctggccctgatgtttggcctgtatgaggacctgagctgcctgctgcacaagcacgtgtctgcccctgagtttgccaccagcggcgtggccgctgtgctggccggcaccacagaggccatcttcacccccctggagcgggtgcagaccctgctgcaggaccacaagcaccacgacaagttcaccaacacctaccaggccttcaaggccctgaagtgccacggcattggagagtactaccggggcctggtgcccatcctcttcagaaatggcctgagcaatgtgctcttcttcggcctgcggggccccatcaaggagcacctgcccacagccaccacccacagcgcccacctggtgaatgacttcatctgtggcggcctgctgggcgccatgctgggcttcctgttcttccccatcaacgtggtgaagacccgcatccagagccagattggaggagagttccagagcttccccaaggtgttccagaagatctggctggagcgggacaggaagctgatcaacctcttccggggggcccacctgaactaccacaggagcctcatctcctggggcatcatcaatgccacctatgagttcctgctgaaggtgatctag

SEQ ID NO: 35783 - DNA, 894 bp, Artificial Sequence; identical to SEQ ID NO: 35782
  Description of Artificial Sequence: Synthetic coding sequence

SEQ ID NO: 35784 - DNA, 894 bp, Artificial Sequence; identical to SEQ ID NO: 35782
  Description of Artificial Sequence: Synthetic coding sequence

SEQ ID NO: 35785 - DNA, 924 bp, Artificial Sequence
  Description of Artificial Sequence: Synthetic coding sequence
atgcccttcatgaggaagatcctgagcaacatgattgacagcgaggcccacgagaagaggcctcccatcctgaccagcagcaagcaggacatcagcccccacatcaccaacgtgggggagatgaagcactacctgtgtggctgctgtgccgccttcaacaacgtggccatcacctaccccatccagaaggtgctcttccggcagcagctgtatggcatcaagaccagagatgctgtgctgcagctgcggagagatggcttcaggaacctgtaccggggcatcctgccccccctgatgcagaagaccaccaccctggccctgatgtttggcctgtatgaggacctgagctgcctgctgaggaagcacgtgcgggcccctgagtttgccacccatggagtggccgctgtgctggccggcacagctgaggccatcttcacccccctggagcgggtgcagaccctgctgcagaaccacaagcaccacgacaagttcaccaacacctaccaggccttcaaggccctgaagtgccacggcattggagagtactaccggggcctggtgcccatcctcttcagaaatggcctgagcaatgtgctcttcttcggcctgcggggccccatcaaggagcacctgcccacagccaccacccacagcgcccacctggtgaatgacttcatcggcggcggcctgctgggcgccatgctgggcttcctgtgcttccccatcaacgtggtgaagacccggctgcagagccagattggaggagagttccagagcttccccaaggtgttccagaagatctggctggagcgggacaggaagctgatcaacctcttccggggggcccacctgaactaccacaggagcctcatctcctggggcatcatcaatgccacctatgagttcctgctgaagttcatctag

SEQ ID NO: 35786 - DNA, 894 bp, Artificial Sequence
  Description of Artificial Sequence: Synthetic coding sequence
atgattgacagcgaggcccacgagaagaggcctcccatcctgaccagcagcaagcaggacatcagcccccacatcaccaacgtgggggagatgaagcactacctgtgtggctgctgtgccgccttcaacaacgtggccatcacctaccccatccagaaggtgctcttccggcagcagctgtatggcatcaagaccagagatgctgtgctgcagctgcggagagatggcttcaggaacctgtaccggggcatcctgccccccctgatgcagaagaccaccaccctggccctgatgtttggcctgtatgaggacctgagctgcctgctgaggaagcacgtgcgggcccctgagtttgccacccatggagtggccgctgtgctggccggcacagctgaggccatcttcacccccctggagcgggtgcagaccctgctgcagaaccacaagcaccacgacaagttcaccaacacctaccaggccttcaaggccctgaagtgccacggcattggagagtactaccggggcctggtgcccatcctcttcagaaatggcctgagcaatgtgctcttcttcggcctgcggggccccatcaaggagcacctgcccacagccaccacccacagcgcccacctggtgaatgacttcatcggcggcggcctgctgggcgccatgctgggcttcctgtgcttccccatcaacgtggtgaagacccggctgcagagccagattggaggagagttccagagcttccccaaggtgttccagaagatctggctggagcgggacaggaagctgatcaacctcttccggggggcccacctgaactaccacaggagcctcatctcctggggcatcatcaatgccacctatgagttcctgctgaagttcatctag

SEQ ID NO: 35787 - DNA, 924 bp, Artificial Sequence
  Description of Artificial Sequence: Synthetic coding sequence
atgggagagcagaaccacagccctgggaaggagctgcagcacaggaccagggctgaggcccctgggaagaagtcctggcacagccaggcctatgccctgggcgctgtgagcaacttcatgagcaccttcctgaccttccccatctacaaggtggtgttccggcagcagatccacgccatggctgtgtctgaggccgtgcggcagctgtggcatgagggcccccagtacttctaccggggcatctacccacccctgctgagcaagaccctgcagggcaccctgctgtttggcacctatgacagcctgctgtgcttcctgagccctgtgggcccccacaccctgggccaccgctgggccgccggcctgatgtctggagtggtggaggccgtggccctgagcccctttgagcgggtgcagaatgtgctgcaggacggcaggaagcaggcccgcttccccagcaccttcagcatcctgaaggagttcaacagctatggcctgtggggccgcctgagcctgggctactaccggggcttctggcctgtgctggccaggaacagcctgggcagcgccctgtacttctccttcaaggaccccatccaggacggcctggccgagcagggcctgccccactgggtgcctgccctggtgtctggctctgtgaatggcaccatcacctgcctggtgctgtaccccctgattgtgctggtggccaacatgcagagccacatcggctggcagaacatgcccagcctgtgggccagcgcccaggatgtgtggaacacccggggcaggaagctgctgctgatctaccggggcggcagcctggtgatcctgcggagctctgtgacctggggcctgaccacagccatccatgacttcctgcagaggaagagccacagcaggaaggagctgaagacagactag

SEQ ID NO: 35788 - DNA, 876 bp, Artificial Sequence
  Description of Artificial Sequence: Synthetic coding sequence
atggccgagatcagccgcatccagtatgagatggagtacacagagggcatcagccagaggatgagggtgcctgagaagctgaaggtggcccccccaaatgctgacctggagcagggcttccaggagggcgtgcccaatgccagcgtcatcatgcaggtgcctgagagaattgtggtggccggcaacaatgaagatgtgtccttcagcaggcctgctgacctggacctgatccagagcacccccttcaagcccctggccctgaagaccccaccccgggtgctgaccctgtctgagcggcccctggacttcctggacctggagaggcctcccaccaccccccagaatgaggagatccgggctgtgggccgcctgaagcgggagaggtccatgtctgaaaatgctgtgcggcagaatggccagctggtgagaaatgacagcctggtgacccccagcccccagcaggcccgggtgtgccccccccacatgctgcctgaagatggagccaacctgagcagcgcccggggcatcctgagcctcatccagagcagcacccggcgggcctaccagcagatcctggatgtgctggatgaaaatagaagacctgtgctgcggggcggcagcgctgctgccaccagcaacccccaccacgacaacgtgcgctatggcatcagcaacatcgacaccaccatcgagggcaccagtgatgacctgactgtggtggatgctgccagcctgcggcggcagatcatcaagctgaacagaaggctgcagctgctggaggaggagaacaaggagcgggccaagcgggagatggtgatgtacagcatcaccgtggccttctggctgctgaacagctggctgtggttcagaagatag

SEQ ID NO: 35789 - DNA, 732 bp, Artificial Sequence
  Description of Artificial Sequence: Synthetic coding sequence
atggccgagatcagccgcatccagtatgagatggagtacacagagggcatcagccagaggatgagggtgcctgagaagctgaaggtggcccccccaaatgctgacctggagcagggcttccaggagggcgtgcccaatgccagcgtcatcatgcaggtgcctgagagaattgtggtggccggcaacaatgaagatgtgtccttcagcaggcctgctgacctggacctgatccagagcacccccttcaagcccctggccctgaagaccccaccccgggtgctgaccctgtctgagcggcccctggacttcctggacctggagaggcctcccaccaccccccagaatgaggagatccgggctgtgggccgcctgaagcgggagaggtccatgtctgaaaatgctgtgcggcagaatggccagctggtgagaaatgacagcctgtggcacagaagtgacagcgcccccaggaacaagatcagccgcttccaggcccccatcagcgcccctgagtacacctacggcatcagcaacatcgacaccaccatcgagggcaccagtgatgacctgactgtggtggatgctgccagcctgcggcggcagatcatcaagctgaacagaaggctgcagctgctggaggaggagaacaaggagcgggccaagcgggagatggtgatgtacagcatcaccgtggccttctggctgctgaacagctggctgtggttcagaagatag

SEQ ID NO: 35790 - DNA, 717 bp, Artificial Sequence
  Description of Artificial Sequence: Synthetic coding sequence
atggccgagatcagccgcatccagtatgagatggagtacacagagggcatcagccagaggatgagggtgcctgagaagctgaaggtggcccccccaaatgctgacctggagcagggcttccaggagggcgtgcccaatgccagcgtcatcatgcaggtgcctgagagaattgtggtggccggcaacaatgaagatgtgtccttcagcaggcctgctgacctggacctgatccagagcacccccttcaagcccctggccctgaagaccccaccccgggtgctgaccctgtctgagcggcccctggacttcctggacctggagaggcctcccaccaccccccagaatgaggagatccgggctgtgggccgcctgaagcgggagaggtccatgtctgaaaatgctgtgcggcagaatggccagctggtgagaaatgacagcctgcctgtgctgcggggcggcagcgctgctgccaccagcaacccccaccacgacaacgtgcgctatggcatcagcaacatcgacaccaccatcgagggcaccagtgatgacctgactgtggtggatgctgccagcctgcggcggcagatcatcaagctgaacagaaggctgcagctgctggaggaggagaacaaggagcgggccaagcgggagatggtgatgtacagcatcaccgtggccttctggctgctgaacagctggctgtggttcagaagatag

SEQ ID NO: 35791 - DNA, 1029 bp, Artificial Sequence
  Description of Artificial Sequence: Synthetic coding sequence
atgagcaagggcaccagcagtgacaccagcctgggccgggtgtccagagctgccttccccagccccacagctgctgagatggccgagatcagccgcatccagtatgagatggagtacacagagggcatcagccagaggatgagggtgcctgagaagctgaaggtggcccccccaaatgctgacctggagcagggcttccaggagggcgtgcccaatgccagcgtcatcatgcaggtgcctgagagaattgtggtggccggcaacaatgaagatgtgtccttcagcaggcctgctgacctggacctgatccagagcacccccttcaagcccctggccctgaagaccccaccccgggtgctgaccctgtctgagcggcccctggacttcctggacctggagaggcctcccaccaccccccagaatgaggagatccgggctgtgggccgcctgaagcgggagaggtccatgtctgaaaatgctgtgcggcagaatggccagctggtgagaaatgacagcctgtggcacagaagtgacagcgcccccaggaacaagatcagccgcttccaggcccccatcagcgcccctgagtacacagtgacccccagcccccagcaggcccgggtgtgccccccccacatgctgcctgaagatggagccaacctgagcagcgcccggggcatcctgagcctcatccagagcagcacccggcgggcctaccagcagatcctggatgtgctggatgagaacagaagacctgtgctgcggggcggcagcgctgctgccaccagcaacccccaccacgacaacgtgcgctatggcatcagcaacatcgacaccaccatcgagggcaccagtgatgacctgactgtggtggatgctgccagcctgcggcggcagatcatcaagctgaacagaaggctgcagctgctggaggaggagaacaaggagcgggccaagcgggagatggtgatgtacagcatcaccgtggccttctggctgctgaacagctggctgtggttcagaagatag

SEQ ID NO: 35792 - DNA, 657 bp, Artificial Sequence
  Description of Artificial Sequence: Synthetic coding sequence
atggccgagatcagccgcatccagtatgagatggagtacacagagggcatcagccagaggatgagggtgcctgagaagctgaaggtggcccccccaaatgctgacctggagcagggcttccaggagggcgtgcccaatgccagcgtcatcatgcaggtgcctgagagaattgtggtggccggcaacaatgaagatgtgtccttcagcaggcctgctgacctggacctgatccagagcacccccttcaagcccctggccctgaagaccccaccccgggtgctgaccctgtctgagcggcccctggacttcctggacctggagaggcctcccaccaccccccagaatgaggagatccgggctgtgggccgcctgaagcgggagaggtccatgtctgaaaatgctgtgcggcagaatggccagctggtgagaaatgacagcctgtatggcatcagcaacatcgacaccaccatcgagggcaccagtgatgacctgactgtggtggatgctgccagcctgcggcggcagatcatcaagctgaacagaaggctgcagctgctggaggaggagaacaaggagcgggccaagcgggagatggtgatgtacagcatcaccgtggccttctggctgctgaacagctggctgtggttcagaagatag

SEQ ID NO: 35793 - DNA, 1029 bp, Artificial Sequence; identical to SEQ ID NO: 35791
  Description of Artificial Sequence: Synthetic coding sequence

SEQ ID NO: 35794 - DNA, 657 bp, Artificial Sequence; identical to SEQ ID NO: 35792
  Description of Artificial Sequence: Synthetic coding sequence

SEQ ID NO: 35795 - DNA, 717 bp, Artificial Sequence; identical to SEQ ID NO: 35790
  Description of Artificial Sequence: Synthetic coding sequence

SEQ ID NO: 35796 - DNA, 183 bp, Artificial Sequence
  Description of Artificial Sequence: Synthetic coding sequence
atggccgagatcagccgcatccagtatgagatggagtacacagagggcatcagccagaggatgagggtgcctgagaagctgaaggtggcccccccaaatgctgacctggagcagggcttccaggagggcgtgcccaatgccagcgtcatcatgcaggtgcctgagagaattgtggtggcctag

SEQ ID NO: 35797 - DNA, 99 bp, Artificial Sequence
  Description of Artificial Sequence: Synthetic coding sequence
atggccgagatcagccgcatccagtatgagatggagtacacagagggcatcagccagaggatgagggtgcctgagaagctgaaggtggcccctccttag

SEQ ID NO: 35798 - DNA, 105 bp, Artificial Sequence
  Description of Artificial Sequence: Synthetic coding sequence
atgagcaagggcaccagcagtgacaccagcctgggccgggtgtccagagctgccttccccagccccacagctgctgagatggccgagatcagccgcatccagtag

SEQ ID NO: 35799 - DNA, 216 bp, Artificial Sequence
  Description of Artificial Sequence: Synthetic coding sequence
atgagcaagggcaccagcagtgacaccagcctgggccgggtgtccagagctgccttccccagccccacagctgctgagatggccgagatcagccgcatccagtatgagatggagtacacagagggcatcagccagaggatgagggtgcctgagaagctgaaggtggcccccccaaatgctgacctggagcagggcttccaggagggcgtgccctag

SEQ ID NO: 35800 - DNA, 417 bp, Artificial Sequence
  Description of Artificial Sequence: Synthetic coding sequence
atggccgagatcagccgcatccagtatgagatggagtacacagagggcatcagccagaggatgagggtgcctgagaagctgaaggtggcccccccaaatgctgacctggagcagggcttccaggagggcgtgcccaatgccagcgtcatcatgcaggtgcctgagagaattgtggtggccggcaacaatgaagatgtgtccttcagcaggcctgctgacctggacctgatccagagcacccccttcaagcccctggccctgaagaccccaccccgggtgctgaccctgtctgagcggcccctggacttcctggacctggagaggcctcccaccaccccccagaatgaggagatccgggctgtgggccgcctgaagcgggagaggtccatgtctgaaaatgctgtgcggcagaactag

SEQ ID NO: 35801 - DNA, 159 bp, Artificial Sequence
  Description of Artificial Sequence: Synthetic coding sequence
atggccgagatcagccgcatccagtatgagatggagtacacagagggcatcagccagaggatgagggtgcctgagaagctgaaggtggcccccccaaatgctgacctggagcagggcttccaggagggcgtgcccaatgccagcgtcatcatgcagtag

SEQ ID NO: 35802 - DNA, 501 bp, Artificial Sequence
  Description of Artificial Sequence: Synthetic coding sequence
atgtctgagccccagcccagaggagctgagcgggacctgtacagagacacctgggtgcgctacctgggctacgccaatgaggtgggggaggccttccgcagcctggtgcctgctgctgtggtgtggctgtcctatggagtggccagcagctatgtgctggctgatgccatcgacaagggcaagaaggccggggaggtgcccagccctgaggccggccgcagcgcccgggtgacagtggccgtggtggacacctttgtgtggcaggccctggcctctgtggccatccctggcttcaccatcaacagagtgtgtgccgccagcctgtatgtgctgggcacagccacccgctggcccctggccgtgaggaagtggaccaccacagccctgggcctgctgaccatccccatcatcatccaccccatcgacagatctgtggacttcctgctggacagcagcctgaggaagctgtaccccaccgtgggcaagcccagcagcagctag

SEQ ID NO: 35803 - DNA, 408 bp, Artificial Sequence
  Description of Artificial Sequence: Synthetic coding sequence
atgtctgagccccagcccagaggagctgagcgggacctgtacagagacacctgggtgcgctacctgggctacgccaatgaggtgggggaggccttccgcagcctggtgcctgctgctgtggtgtggctgtcctatggagtggccagcagctatgtgctggctgatgccatcgacaagggcaagaaggccggggaggtgggcggcttccccccaggcctgcagcctgcccaggccctgcccaacagcggggaggcccagctgctgctgatcatcctgtggtacctggcctgtgccagcgccagctgcttcatgagcaccagctacagctgccagggcatgtggaccccaggcagcctggtgtccaaggaccccggcacctgggtgggcctgtcctggacagaggcctag

SEQ ID NO: 35804 - DNA, 1002 bp, Artificial Sequence
  Description of Artificial Sequence: Synthetic coding sequence
atgctgggctggatcaagaggctcatccgcatggtgttccagcaggtgggcgtgtccatgcagagcgtgctgtggagcaggaagccctacggcagcagccgcagcatcgtgaggaagattggcaccaacctgagcctcatccagtgcccccgggtgcagttccagatcaacagccacgccacagagtggagccccagccaccctggagaagatgctgtggccagctttgctgatgtgggctgggtggccaaggaggagggggagtgcagcgcccggctgaggacagaggtgcgcagcaggcctcccctgcaggatgacctgctcttctttgagaaggcccccagccggcagatcagcctgcctgacctgagccaggaggagccccagctgaagaccccagccctggccaatgaggaggccctgcagaagatctgtgccctggagaatgagctggccgccctgcgggcccagatcgccaagatcgtgacccagcaggagcagcagaacctgacagctggggacctggacagcaccaccttcggcaccatccccccccaccccccacctcctcctccacccctgcccccaccagccctgggcctgcaccagagcaccagcgctgtggacctgatcaaggagcggcgggagaagagggccaatgccggcaagaccctggtgaagaacaaccccaagaagccagagatgcccaacatgctggagatcctgaaggagatgaacagcgtgaagctgcggtctgtgaagaggtctgagcaggatgtgaagcccaagcctgtggatgccacagatcctgctgccctgattgctgaggccctgaagaagaagtttgcctaccgctacagaagtgacagccaggatgaggtggagaagggcatccccaagtctgagagcgaggccaccagcgagcgggtgctgtttggcccccacatgctgaagcccaccgggaagatgaaggccctgattgaaaatgtgtctgacagctag

SEQ ID NO: 35805 - DNA, 903 bp, Artificial Sequence
  Description of Artificial Sequence: Synthetic coding sequence
atgctgggctggatcaagaggctcatccgcatggtgttccagcaggtgggcgtgtccatgcagagcatcaacagccacgccacagagtggagccccagccaccctggagaagatgctgtggccagctttgctgatgtgggctgggtggccaaggaggagggagaatgttctgcccggctgaggacagaggtgcgcagccggccccccctgcaggatgacctgctcttctttgagaaggcccccagccggcagatcagcctgcctgacctgagccaggaggagccccagctgaagaccccagccctggccaatgaggaggccctgcagaagatctgtgccctggagaatgagctggccgccctgcgggcccagatcgccaagatcgtgacccagcaggagcagcagaacctgacagctggggacctggacagcaccaccttcggcaccatccccccccaccccccacctcctcctccacccctgcccccaccagccctgggcctgcaccagagcaccagcgctgtggacctgatcaaggagcggcgggagaagagggccaatgctgggaagaccctggtgaagaacaaccccaagaagccagagatgcccaacatgctggagatcctgaaggagatgaacagcgtgaagctgcggtctgtgaagaggtctgagcaggatgtgaagcccaagcctgtggatgccacagatcctgctgccctgattgctgaggccctgaagaagaagtttgcctaccgctacagaagtgacagccaggatgaggtggagaagggcatccccaagtctgagagcgaggccaccagcgagcgggtgctgtttggcccccacatgctgaagcccaccgggaagatgaaggccctgattgaaaatgtgtctgacagctag

SEQ ID NO: 35806 - DNA, 1005 bp, Artificial Sequence
  Description of Artificial Sequence: Synthetic coding sequence
atgaggctgaccccccgggccctgtgcagcgctgcccaggccgcctggagggagaacttccccctgtgtggcagagatgtggcccgctggttccctggccacatggccaagggcctgaagaagatgcagagcagcctgaagctggtggactgcatcatcgaggtgcatgatgcccgcatccccctgtctggaagaaaccccctcttccaggagaccctgggcctgaagccccacctgctggtgctgaacaagatggacctggccgacctgacagagcagcagaagatcatgcagcacctggagggggagggcctgaagaatgtcatcttcaccaactgtgtgaaggatgaaaatgtgaagcagatcatccccatggtgacagagctgattggccgcagccaccgctaccacaggaaggagaacctggagtactgcatcatggtgattggagtgcccaacgtgggcaagagcagcctcatcaacagcctgcggcggcagcacctgaggaagggcaaggccaccagggtgggcggggagcccggcatcaccagggctgtgatgagcaagatccaggtgtctgagcggcccctgatgttcctgctggacaccccaggagtgctggcccccagaattgaatctgtggagaccggcctgaagctggccctgtgtggcaccgtgctggaccacctggtgggggaggagaccatggctgactacctgctgtacaccctgaacaagcaccagcgcttcggctacgtgcagcactacggcctgggcagcgcctgtgacaacgtggagcgggtgctgaagtctgtggccgtgaagctgggcaagacccagaaggtgaaggtgctgaccggcactggaaatgtgaacatcatccagcccaactacccagctgctgcccgggacttcctgcagaccttccggcggggcctgctgggctctgtgatgctggacctggatgtgctgcggggccaccccccagctgagaccctgccctag

SEQ ID NO: 35807 - DNA, 852 bp, Artificial Sequence
  Description of Artificial Sequence: Synthetic coding sequence
atgaggctgaccccccgggccctgtgcagcgctgcccaggccgcctggagggagaacttccccctgtgtggcagagatgtggcccgctggttccctggccacatggccaagggcctgaagaagatgcagagcagcctgaagctggtggactgcatcatcgaggtgcatgatgcccgcatccccctgtctggaagaaaccccctcttccaggagaccctgggcctgaagccccacctgctggtgctgaacaagatggacctggccgacctgacagagcagcagaagatcatgcagcacctggagggggagggcctgaagaatgtcatcttcaccaactgtgtgaaggatgaaaatgtgaagcagatcatccccatggtgacagagctgattggccgcagccaccgctaccacaggaaggaggtgtctgagcggcccctgatgttcctgctggacaccccaggagtgctggccccccgcatcgagagcgtggagaccggcctgaagctggccctgtgtggcaccgtgctggaccacctggtgggggaggagaccatggctgactacctgctgtacaccctgaacaagcaccagagatttggctacgtgcagcactacggcctgggcagcgcctgtgacaacgtggagcgggtgctgaagtctgtggccgtgaagctgggcaagacccagaaggtgaaggtgctgactggaactggaaatgtgaacatcatccagcccaactacccagctgctgcccgggacttcctgcagaccttcagaagaggcctgctgggctctgtgatgctggacctggatgtgctgcggggccaccccccagctgagaccctgccctag

SEQ ID NO: 35808 - DNA, 681 bp, Artificial Sequence
  Description of Artificial Sequence: Synthetic coding sequence
atgcagagcagcctgaagctggtggactgcatcatcgaggtgcatgatgcccgcatccccctgagcggcaggaaccccctcttccaggagaccctgggcctgaagccccacctgctggtgctgaacaagatggacctggccgacctgacagagcagcagaagatcatgcagcacctggagggggagggcctgaagaatgtcatcttcaccaactgtgtgaaggatgaaaatgtgaagcagatcatccccatggtgacagagctgattggccgcagccaccgctaccacaggaaagaaaacctggagtactgcatcatggtgattggagtgcccaacgtgggcaagagcagcctcatcaacagcctgcggcggcagcacctgaggaagggcaaggccaccagggtgggcggggagcccggcatcaccagggctgtgatgagcaagatccaggtggagagcagcggggcccggcccagcaccctgagccgggccctgcaggccagcggcacctgccggcccctgtgtggcttccggctgctgaccaccctgcccagcccccccctgtctgtgcctgctgagcacccccggggccgccactgcccctgcccctacagcacagtggtgattgtgtttgcccccaacctgtggggcagacatgctgtgttccccatcagcaggtag

SEQ ID NO: 35809 - DNA, 237 bp, Artificial Sequence
  Description of Artificial Sequence: Synthetic coding sequence
atgtctgagagcgagctgggcaggaagtgggaccgctgcctggctgatgctgtggtgaagattggaactggatttggcctgggcatcgtgttcagcctgaccttcttcaagaggaggatgtggcccctggcctttggaagtggcatgggcctgggcatggcctacagcaactgccagcacgacttccaggccccctacctgctgcacggcaagtatgtgaaggagcaggagcagtag

SEQ ID NO: 35810 - DNA, 1467 bp, Artificial Sequence
  Description of Artificial Sequence: Synthetic coding sequence
atgaacagccagacagaggaccacgccctggcccctgtgaggaacaccatccagctgcccacccagcccctgaacagcgaggagtgggacaagctgaaggaggacctgaaggagaacacaggcaagaccagctttgagagctggatcatcagccagatggccggctgccacagcagcattgatgtggccaagagcctgctggcctgggtggccgccaagaacaatggaattgtgtcctatgacctgctggtgaagtacctgtacctgtgtgtgttccacatgcagaccagcgaggtgattgatgtgtttgagatcatgaaggcccgctacaagaccctggagccccggggctacagcctgctgatccggggcctcatccacagcgaccgctggagggaggccctgctgctgctggaggacatcaagaaggtgatcacccccagcaagaagaactacaatgactgcatccagggcgccctgctgcaccaggatgtgaacacagcctggaacctgtaccaggagctgctgggccatgacatcgtgcccatgctggagaccctgaaggccttctttgattttgggaaggacatcaaggatgacaactacagcaacaagctgctggacatcctgagctacctgaggaacaaccagctgtacccaggagagagctttgcccacagcatcaagacctggtttgagagcgtgcctgggaagcagtggaagggccagttcaccaccgtgaggaagagcggccagtgcagcggctgtgggaagaccatcgagagcatccagctgagccctgaggagtatgaatgtctgaagggcaagatcatgagagatgtgattgatggaggagaccagtacaggaagaccaccccccaggagctgaagagatttgagaacttcatcaagagccggcccccatttgatgtggtgattgatggcctgaatgtggccaagatgttccccaaggtgcgggagagccagctgctgctgaatgtggtgtcccagctggccaagaggaacctgcggctgctggtgctgggcaggaagcacatgctgcggcgcagcagccagtggagcagagatgagatggaggaggtgcagaagcaggccagctgcttctttgctgatgacatcagtgaagatgaccccttcctgctgtatgccaccctgcacagcggcaaccactgccgcttcatcacccgggacctgatgagggaccacaaggcctgcctgcctgatgccaagacccagaggctcttcttcaagtggcagcagggccaccagctggccatcgtgaaccgcttccctggcagcaagctgaccttccagaggatcctgtcctatgacacagtggtgcagaccactggagacagctggcacatcccctatgatgaggacctggtggagcgctgcagctgtgaggtgcccaccaagtggctgtgcctgcaccagaagacctag

SEQ ID NO: 35811 - DNA, 1704 bp, Artificial Sequence
  Description of Artificial Sequence: Synthetic coding sequence
atgaccttctacctgtttggcatccgctccttccccaagctgtggaagagcccctacctgggcctgggccctggccacagctatgtgtccctcttcctggccgacagatgtggcatccggaaccagcagaggctcttcagcctgaagaccatgagcccccagaacaccaaggccaccaacctgattgccaaggcccgctacctgaggaaggatgagggcagcaacaagcaggtgtacagcgtgccccacttcttcctggccggggccgccaaggagaggagccagatgaacagccagacagaagatcatgccctggcccctgtgaggaacaccatccagctgcccacccagcccctgaacagcgaggagtgggacaagctgaaggaggacctgaaggaaaatacaggcaagaccagctttgagagctggatcatcagccagatggccggctgccacagcagcattgatgtggccaagagcctgctggcctgggtggccgccaagaacaacggcatcgtgtcctatgacctgctggtgaagtacctgtacctgtgtgtgttccacatgcagaccagcgaggtgattgatgtgtttgagatcatgaaggcccgctacaagaccctggagccccggggctacagcctgctgatccggggcctcatccacagcgaccgctggagggaggccctgctgctgctggaggacatcaagaaggtgatcacccccagcaagaagaactacaatgactgcatccagggcgccctgctgcaccaggatgtgaacacagcctggaacctgtaccaggagctgctgggccatgacatcgtgcccatgctggagaccctgaaggccttctttgattttgggaaggacatcaaggatgacaactacagcaacaagctgctggacatcctgagctacctgaggaacaaccagctgtacccaggagagagctttgcccacagcatcaagacctggtttgaaagtggccagtgcagcggctgcggcaagaccatcgagagcatccagctgagccctgaggagtatgagtgcctgaagggcaagatcatgagagatgtgattgatggaggagaccagtacaggaagaccaccccccaggagctgaagagatttgagaacttcatcaagagccggcccccatttgatgtggtgattgatggcctgaatgtggccaagatgttccccaaggtgcgggagagccagctgctgctgaatgtggtgtcccagctggccaagaggaacctgcggctgctggtgctgggcaggaagcacatgctgcggcgcagcagccagtggagcagagatgagatggaggaggtgcagaagcaggccagctgcttctttgctgatgacatcagtgaagatgaccccttcctgctgtatgccaccctgcacagcggcaaccactgccgcttcatcacccgggacctgatgagggaccacaaggcctgcctgcctgatgccaagacccagaggctcttcttcaagtggcagcagggccaccagctggccatcgtgaaccgcttccctggcagcaagctgaccttccagaggatcctgtcctatgacacagtggtgcagaccaccggggacagctggcacatcccctatgatgaggacctggtggagcgctgcagctgtgaggtgcccaccaagtggctgtgcctgcaccagaagacctag

SEQ ID NO: 35812 - DNA, 1752 bp, Artificial Sequence
  Description of Artificial Sequence: Synthetic coding sequence
atgaccttctacctgtttggcatccgctccttccccaagctgtggaagagcccctacctgggcctgggccctggccacagctatgtgtccctcttcctggccgacagatgtggcatccggaaccagcagaggctcttcagcctgaagaccatgagcccccagaacaccaaggccaccaacctgattgccaaggcccgctacctgaggaaggatgagggcagcaacaagcaggtgtacagcgtgccccacttcttcctggccggggccgccaaggagaggagccagatgaacagccagacagaagatcatgccctggcccctgtgaggaacaccatccagctgcccacccagcccctgaacagcgaggagtgggacaagctgaaggaggacctgaaggaaaatacaggcaagaccagctttgagagctggatcatcagccagatggccggctgccacagcagcattgatgtggccaagagcctgctggcctgggtggccgccaagaacaacggcatcgtgtcctatgacctgctggtgaagtacctgtacctgtgtgtgttccacatgcagaccagcgaggtgattgatgtgtttgagatcatgaaggcccgctacaagaccctggagccccggggctacagcctgctgatccggggcctcatccacagcgaccgctggagggaggccctgctgctgctggaggacatcaagaaggtgatcacccccagcaagaagaactacaatgactgcatccagggcgccctgctgcaccaggatgtgaacacagcctggaacctgtaccaggagctgctgggccatgacatcgtgcccatgctggagaccctgaaggccttctttgattttgggaaggacatcaaggatgacaactacagcaacaagctgctggacatcctgagctacctgaggaacaaccagctgtacccaggagagagctttgcccacagcatcaagacctggtttgaatctgtgcctgggaagcagtggaagggccagttcaccaccgtgaggaagagcggccagtgcagcggctgcggcaagaccatcgagagcatccagctgagccctgaggagtatgagtgcctgaagggcaagatcatgagagatgtgattgatggaggagaccagtacaggaagaccaccccccaggagctgaagagatttgagaacttcatcaagagccggcccccatttgatgtggtgattgatggcctgaatgtggccaagatgttccccaaggtgcgggagagccagctgctgctgaatgtggtgtcccagctggccaagaggaacctgcggctgctggtgctgggcaggaagcacatgctgcggcgcagcagccagtggagcagagatgagatggaggaggtgcagaagcaggccagctgcttctttgctgatgacatcagtgaagatgaccccttcctgctgtatgccaccctgcacagcggcaaccactgccgcttcatcacccgggacctgatgagggaccacaaggcctgcctgcctgatgccaagacccagaggctcttcttcaagtggcagcagggccaccagctggccatcgtgaaccgcttccctggcagcaagctgaccttccagaggatcctgtcctatgacacagtggtgcagaccaccggggacagctggcacatcccctatgatgaggacctggtggagcgctgcagctgtgaggtgcccaccaagtggctgtgcctgcaccagaagacctag

SEQ ID NO: 35813 - DNA, 105 bp, Artificial Sequence
  Description of Artificial Sequence: Synthetic coding sequence
atgaccttctacctgtttggcatccgctccttccccaagctgtggaagagcccctacctgggcctgggccctggccacagctatgtgtccctcttcctggcctag

SEQ ID NO: 35814 - DNA, 63 bp, Artificial Sequence
  Description of Artificial Sequence: Synthetic coding sequence
atgaccttctacctgtttggcatccgctccttccccaagctgtggaagagcccctacctgtag

SEQ ID NO: 35815 - DNA, 1467 bp, Artificial Sequence; identical to SEQ ID NO: 35810
  Description of Artificial Sequence: Synthetic coding sequence

SEQ ID NO: 35816 - DNA, 72 bp, Artificial Sequence
  Description of Artificial Sequence: Synthetic coding sequence
atgaccttctacctgtttggcatccgctccttccccaagctgtggaagagcccctacctgggcctgggctag

SEQ ID NO: 35817 - DNA, 1704 bp, Artificial Sequence; identical to SEQ ID NO: 35811
  Description of Artificial Sequence: Synthetic coding sequence

SEQ ID NO: 35818 - DNA, 636 bp, Artificial Sequence
  Description of Artificial Sequence: Synthetic coding sequence
atgagagatgtgattgatggaggagaccagtacaggaagaccaccccccaggagctgaagagatttgagaacttcatcaagagccggcccccatttgatgtggtgattgatggcctgaatgtggccaagatgttccccaaggtgcgggagagccagctgctgctgaatgtggtgtcccagctggccaagaggaacctgcggctgctggtgctgggcaggaagcacatgctgcggcgcagcagccagtggagcagagatgagatggaggaggtgcagaagcaggccagctgcttctttgctgatgacatcagtgaagatgaccccttcctgctgtatgccaccctgcacagcggcaaccactgccgcttcatcacccgggacctgatgagggaccacaaggcctgcctgcctgatgccaagacccagaggctcttcttcaagtggcagcagggccaccagctggccatcgtgaaccgcttccctggcagcaagctgaccttccagaggatcctgtcctatgacacagtggtgcagaccaccggggacagctggcacatcccctatgatgaggacctggtggagcgctgcagctgtgaggtgcccaccaagtggctgtgcctgcaccagaagacctag

SEQ ID NO: 35819 - DNA, 633 bp, Artificial Sequence
  Description of Artificial Sequence: Synthetic coding sequence
atggccctgggcctgaagtgcttcaggatggtgcaccccaccttcaggaactacctggccgccagcatccggcctgtgtctgaggtgaccctgaagacagtgcatgagcggcagcacggccaccggcagtacatggcctacagcgctgtgcctgtgcgccactttgccaccaagaaggccaagggcagcctggacaagattgctgtggtgacagcagatggcaagctggccctgaaccagatcagccagatctccatgaagagcccccagctgatcctggtgaacatggccagcttcccagaatgtacagctgctgccatcaaggccatccgggagagcggcatgaacctgaaccctgaggtggagggcaccctcatccgggtgcccatcccccaggtgacccgggagcaccgggagatgctggtgaagctggccaagcagaacaccaacaaggccaaggacagcctgaggaaggtgaggaccaacagcatgaacaagctgaagaagagcaaggacacagtgtctgaggacaccatccgcctcatcgagaagcagatcagccagatggctgatgacacagtggccgagctggacagacacctggccgtgaagaccaaggagctgctgggctag

SEQ ID NO: 35820 - DNA, 789 bp, Artificial Sequence
  Description of Artificial Sequence: Synthetic coding sequence
atggccctgggcctgaagtgcttcaggatggtgcaccccaccttcaggaactacctggccgccagcatccggcctgtgtctgaggtgaccctgaagacagtgcatgagcggcagcacggccaccggcagtacatggcctacagcgctgtgcctgtgcgccactttgccaccaagaaggccaaggccaagggcaagggccagagccagaccagggtgaacatcaatgctgccctggtggaggacatcatcaacctggaggaggtgaatgaggagatgaagagcgtcatcgaggccctgaaggacaacttcaacaagaccctgaacatccgcaccagccctggcagcctggacaagattgctgtggtgacagcagatggcaagctggccctgaaccagatcagccagatctccatgaagagcccccagctgatcctggtgaacatggccagcttcccagaatgtacagctgctgccatcaaggccatccgggagagcggcatgaacctgaaccctgaggtggagggcaccctcatccgggtgcccatcccccaggtgacccgggagcaccgggagatgctggtgaagctggccaagcagaacaccaacaaggccaaggacagcctgaggaaggtgaggaccaacagcatgaacaagctgaagaagagcaaggacacagtgtctgaggacaccatccgcctcatcgagaagcagatcagccagatggctgatgacacagtggccgagctggacagacacctggccgtgaagaccaaggagctgctgggctag

SEQ ID NO: 35821 - DNA, 606 bp, Artificial Sequence
  Description of Artificial Sequence: Synthetic coding sequence
atggccctgggcctgaagtgcttcaggatggtgcaccccaccttcaggaactacctggccgccagcatccggcctgtgtctgaggtgaccctgaagacagtgcatgagcggcagcacggccaccggcagtacatggcctacagcgctgtgcctgtgcgccactttgccaccaagaaggccaaggccaagggcaagggccagagccagaccagggtgaacatcaatgctgccctggtggaggacatcatcaacctggaggaggtgaatgaggagatgaagagcgtcatcgaggccctgaaggacaacttcaacaagaccctgaacatccgcaccagccctggcagcctggacaagattgctgtggtgacagcagatggcaagctggccctgaaccagatcagccagatctccatgaagagcccccagctgatcctggtgaacatggccagcttcccagaatgtacagctgctgccatcaaggccatccgggagagcggcatgaacctgaaccctgaggtggagggcaccctcatccgggtgcccatcccccagagcgccaagtggcccatgacccagtggcagaactggacaggcatctggcagtag

SEQ ID NO: 35822 - DNA, 375 bp, Artificial Sequence
  Description of Artificial Sequence: Synthetic coding sequence
atggcctacagcgctgtgcctgtgcgccactttgccaccaagaaggccaaggccaagggcaagggccagagccagaccagggtgaacatcaatgctgccctggtggaggacatcatcaacctggaggaggtgaatgaggagatgaagagcgtcatcgaggccctgaaggacaacttcaacaagaccctgaacatccgcaccagccctggcagcctggacaagattgctgtggtgacagcagatggcaagctggccctgaaccagatcagccagatctccatgaagagcccccagctgatcctggtgaacatggccagcttccctgagaccatgaagcagatcaagcagtacttcaacggccccaacgtggcctag

SEQ ID NO: 35823 - DNA, 477 bp, Artificial Sequence
  Description of Artificial Sequence: Synthetic coding sequence
atggccctgggcctgaagtgcttcaggatggtgcaccccaccttcaggaactacctggccgccagcatccggcctgtgtctgaggtgaccctgaagacagtgcatgagcggcagcacggccaccggcagtacatggcctacagcgctgtgcctgtgcgccactttgccaccaagaaggccaaggccaagggcaagggccagagccagaccagggtgaacatcaatgctgccctggtggaggacatcatcaacctggaggaggtgaatgaggagatgaagagcgtcatcgaggccctgaaggacaacttcaacaagaccctgaacatccgcaccagccctggcagcctggacaagattgctgtggtgacagcagatggcaagctggccctgaaccagatcagccagatctccatgaagagcccccagctgatcctggtgaacatggccagcttccctgaggtgcgctggccctgctag

SEQ ID NO: 35824 - DNA, 477 bp, Artificial Sequence; identical to SEQ ID NO: 35823
  Description of Artificial Sequence: Synthetic coding sequence

SEQ ID NO: 35825 - DNA, 657 bp, Artificial Sequence
  Description of Artificial Sequence: Synthetic coding sequence
atggcctacagcgctgtgcctgtgcgccactttgccaccaagaaggccaaggccaagggcaagggccagagccagaccagggtgaacatcaatgctgccctggtggaggacatcatcaacctggaggaggtgaatgaggagatgaagagcgtcatcgaggccctgaaggacaacttcaacaagaccctgaacatccgcaccagccctggcagcctggacaagattgctgtggtgacagcagatggcaagctggccctgaaccagatcagccagatctccatgaagagcccccagctgatcctggtgaacatggccagcttcccagaatgtacagctgctgccatcaaggccatccgggagagcggcatgaacctgaaccctgaggtggagggcaccctcatccgggtgcccatcccccaggtgacccgggagcaccgggagatgctggtgaagctggccaagcagaacaccaacaaggccaaggacagcctgaggaaggtgaggaccaacagcatgaacaagctgaagaagagcaaggacacagtgtctgaggacaccatccgcctcatcgagaagcagatcagccagatggctgatgacacagtggccgagctggacagacacctggccgtgaagaccaaggagctgctgggctag

SEQ ID NO: 35826 - DNA, 531 bp, Artificial Sequence
  Description of Artificial Sequence: Synthetic coding sequence
atggccctgggcctgaagtgcttcaggatggtgcaccccaccttcaggaactacctggccgccagcatccggcctgtgtctgaggtgaccctgaagacagtgcatgagcggcagcacggccaccggcagtacatggcctacagcgctgtgcctgtgcgccactttgccaccaagaaggccaaggccaagggcaagggccagagccagaccagggtgaacatcaatgctgccctggtggaggacatcatcaacctggaggaggtgaatgaggagatgaagagcgtcatcgaggccctgaaggacaacttcaacaagaccctgaacatccgcaccagccctggcagcctggacaagattgctgtggtgacagcagatggcaagctggccctgaaccagatcagccagatctccatgaagagcccccagctgatcctggtgaacatggccagcttccctgaggagctggcctggatccgcagcctgcgggtgcccggcatccgcagccacctgtaccaccagctggccgtgtag

SEQ ID NO: 35827 - DNA, 606 bp, Artificial Sequence; identical to SEQ ID NO: 35821
  Description of Artificial Sequence: Synthetic coding sequence

SEQ ID NO: 35828 - DNA, 462 bp, Artificial Sequence
  Description of Artificial Sequence: Synthetic coding sequence
atggccctgggcctgaagtgcttcaggatggtgcaccccaccttcaggaactacctggccgccagcatccggcctgtgtctgaggtgaccctgaagacagtgcatgagcggcagcacggccaccggcagtacatggcctacagcgctgtgcctgtgcgccactttgccaccaagaaggccaaggccaagggcaagggccagagccagaccagggtgaacatcaatgctgccctggtggaggacatcatcaacctggaggaggtgaatgaggagatgaagagcgtcatcgaggccctgaaggacaacttcaacaagaccctgaacatccgcaccagccctggcagcctggacaagattgctgtggtgacagcagatggcaagctggccctgaaccagatcagccagatctccatgaagagcccccagctgatcctggtgaacatggccagcttccctgagtag

SEQ ID NO: 35829 - DNA, 507 bp, Artificial Sequence
  Description of Artificial Sequence: Synthetic coding sequence
atggccctgggcctgaagtgcttcaggatggtgcaccccaccttcaggaactacctggccgccagcatccggcctgtgtctgaggtgaccctgaagacagtgcatgagcggcagcacggccaccggcagtacatggcctacagcgctgtgcctgtgcgccactttgccaccaagaaggccaaggccaagggcaagggccagagccagaccagggtgaacatcaatgctgccctggtggaggacatcatcaacctggaggaggtgaatgaggagatgaagagcgtcatcgaggccctgaaggacaacttcaacaagaccctgaacatccgcaccagccctggcagcctggacaagattgctgtggtgacagcagatggcaagctggccctgaaccagatcagccagatctccatgaagagcccccagctgatcctggtgaacatggccagcttccctgagaccatgaagcagatcaagcagtacttcaacggccccaacgtggcctag

SEQ ID NO: 35830 - DNA, 1062 bp, Artificial Sequence
  Description of Artificial Sequence: Synthetic coding sequence
atggccctgctgagcacagtgcggggggccacctggggccgcctggtgaccaggcacttcagccatgctgcccggcacggggagaggcctggaggagaggagctgagccggctgctgctggatgacctggtgcccaccagccggctggagctgctgtttggcatgaccccctgcctgctggccctgcaggccgcccggcgctctgtggcccggctgctgctgcaggccggcaaggccggcctgcagggcaagagagctgagctgctgaggatggccgaggcccgggacatccctgtgctgcggccccggcggcagaagctggacaccatgtgccgctaccaggtgcaccagggcgtgtgcatggaggtgagccccctgcggccccggccctggagggaggccggggaggccagccctggagatgacccccagcagctgtggctggtgctggatggcatccaggaccccaggaactttggagctgtgctgcggagcgcccacttcctgggcgtggacaaggtgatcaccagcagaagaaacagctgccccctgacccctgtggtgtccaagagcagcgctggggccatggaggtgatggatgtgttcagcacagatgacctgaccggcttcctgcagaccaaggcccagcagggctggctggtggccggcaccgtgggctgccccagcacagaggacccccagagcagcgagatccccatcatgagctgcctggagttcctgtgggagcggcccaccctgctggtgctgggcaatgaaggcagcggcctgagccaggaggtgcaggccagctgccagctgctgctgaccatcctgccccggcggcagctgcccccaggcctggagagcctgaatgtgtctgtggccgccggcatcctgctgcacagcatctgcagccagaggaagggcttccccacagaaggagagcggcggcagctgctgcaggacccccaggagcccagcgcccggtctgagggcctgtccatggcccagcaccctggcctgagcagcggccctgagaaggagcggcagaatgaaggatag

SEQ ID NO: 35831 - DNA, 837 bp, Artificial Sequence
  Description of Artificial Sequence: Synthetic coding sequence
atggccgccctcttcctgaagaggctgaccctgcagacagtgaagtctgagaacagctgcatccgctgcttcggcaagcacatcctgcagaagacagccccagcccagctgagccccatcgccagcgccccccggctgtccttcctgattcatgccaaggccttcagcacagctgaggacacccagaatgaaggcaagaagaccaagaagaacaagacagccttcagcaatgtgggcaggaagatcagccagagggtcatccacctgtttgatgagaagggaaatgacctgggcaacatgcaccgggccaacgtcatccggctgatggatgagcgggacctgcggctggtgcagaggaacaccagcacagagcctgctgagtaccagctgatgacaggcctgcagatcctgcaggagcggcagaggctgcgggagatggagaaggccaaccccaagacaggccccaccctgaggaaggagctgatcctgagcagcaacatcggccagcacgacctggacaccaagaccaagcagatccagcagtggatcaagaagaagcacctggtgcagatcaccatcaagaagggcaagaatgtggatgtgtctgaaaatgagatggaggagatcttccaccagatcctgcagaccatgcctggcatcgccaccttcagcagccggccccaggccgtgcagggcggcaaggccctgatgtgtgtgctgcgggccttcagcaagaatgaggagaaggcctacaaggagacccaggagacccaggagcgggacaccctgaacaaggaccatggaaatgacaaggagagcaatgtgctgcaccagtag

SEQ ID NO: 35832 - DNA, 837 bp, Artificial Sequence; identical to SEQ ID NO: 35831
  Description of Artificial Sequence: Synthetic coding sequence

SEQ ID NO: 35833 - DNA, 837 bp, Artificial Sequence; identical to SEQ ID NO: 35831
  Description of Artificial Sequence: Synthetic coding sequence

SEQ ID NO: 35834 - DNA, 837 bp, Artificial Sequence; identical to SEQ ID NO: 35831
  Description of Artificial Sequence: Synthetic coding sequence

SEQ ID NO: 35835 - DNA, 681 bp, Artificial Sequence
  Description of Artificial Sequence: Synthetic coding sequence
atgaatgaaaacctgtttgccagcttcatcgcccccaccatcctgggcctgcctgctgctgtgctgatcatcctcttcccccccctgctgatccccaccagcaagtacctgatcaacaacagactcatcaccacccagcagtggctgatcaagctgaccagcaagcagatgatgaccatgcacaacaccaagggccgcacctggagcctgatgctggtgtccctcatcatcttcatcgccaccaccaacctgctgggcctgctgccccacagcttcacccccaccacccagctgtccatgaacctggccatggccatccccctgtgggccggcaccgtcatcatgggcttccgcagcaagatcaagaatgccctggcccacttcctgccccagggcacccccacccccctcatccccatgctggtgatcatcgagaccatcagcctgctgatccagcccatggccctggccgtgcggctgacagccaacatcacagctggccacctgctgatgcacctgattggcagcgccaccctggccatgagcaccatcaacctgcccagcaccctcatcatcttcaccatcctgatcctgctgaccatcctggagattgctgtggccctgatccaggcctacgtgttcaccctgctggtgtccctgtacctgcatgacaacacctag

SEQ ID NO: 35836 - DNA, 1143 bp, Artificial Sequence
  Description of Artificial Sequence: Synthetic coding sequence
atgacccccatgaggaagaccaaccccctgatgaagctgatcaaccacagcttcatcgacctgcccacccccagcaacatcagcgcctggtggaactttggcagcctgctgggcgcctgcctgatcctgcagatcaccaccggcctcttcctggccatgcactacagcccagatgccagcacagccttcagcagcatcgcccacatcaccagagatgtgaactacggctggatcatccgctacctgcacgccaatggagcctccatgttcttcatctgcctcttcctgcacatcggccggggcctgtactacggcagcttcctgtacagcgagacctggaacatcggcatcatcctgctgctggccaccatggccacagccttcatgggctacgtgctgccctggggccagatgtccttctggggcgccaccgtcatcaccaacctgctgagcgccatcccctacatcggcacagacctggtgcagtggatctggggcggctacagcgtggacagccccaccctgacccgcttcttcaccttccacttcatcctgcccttcatcatcgccgccctggccaccctgcacctgctcttcctgcatgaaacaggcagcaacaaccccctgggcatcaccagccacagcgacaagatcaccttccacccctactacaccatcaaggatgccctgggcctgctgctcttcctgctgagcctgatgaccctgaccctcttctccccagacctgctgggggaccctgacaactacaccctggccaaccccctgaacaccccaccccacatcaagccagagtggtacttcctgtttgcctacaccatcctgcggtctgtgcccaacaagctgggcggcgtgctggccctgctgctgagcatcctgatcctggccatgatccccatcctgcacatgagcaagcagcagagcatgatgttccggcccctgagccagagcctgtactggctgctggccgctgacctgctgatcctgacctggattggaggccagcctgtgtcctaccccttcaccatcatcggccaggtggcctctgtgctgtacttcaccaccatcctgatcctgatgcccaccatcagcctgattgagaacaagatgctgaagtgggcctag

SEQ ID NO: 35837 - DNA, 1542 bp, Artificial Sequence
  Description of Artificial Sequence: Synthetic coding sequence
atgtttgctgaccgctggctgttcagcaccaaccacaaggacatcggcaccctgtacctgctgtttggagcctgggccggcgtgctgggcacagccctgagcctgctgatccgggcagagctgggccagcccggcaacctgctgggcaatgaccacatctacaacgtgattgtgacagcccacgcctttgtgatgatcttcttcatggtgatgcccatcatgattggaggcttcggcaactggctggtgcccctgatgattggagccccagacatggccttccccaggatgaacaacatgtccttctggctgctgccccccagcctgctgctgctgctggccagcgccatggtggaggccggggccggcaccggctggacagtgtacccacccctggccggcaactacagccaccctggggcctctgtggacctgaccatcttcagcctgcacctggccggcgtgagcagcatcctgggcgccatcaacttcatcaccaccatcatcaacatgaagcccccagccatgacccagtaccagacccccctgtttgtgtggagcgtgctgatcacagctgtgctgctgctgctgagcctgcctgtgctggccgccggcatcaccatgctgctgacagacaggaacctgaacaccaccttctttgatcctgctgggggcggggaccccatcctgtaccagcacctgttctggttcttcggccaccctgaggtgtacatcctgatcctgcccggcttcggcatgatcagccacatcgtgacctactacagcggcaagaaggagcccttcggctacatgggcatggtgtgggccatgatgagcatcggcttcctgggcttcatcgtgtgggcccaccacatgttcaccgtgggcatggatgtggacacccgggcctacttcaccagcgccaccatgatcatcgccatccccaccggggtgaaggtgttctcctggctggccaccctgcacggcagcaacatgaagtggagcgctgctgtgctgtgggccctgggcttcatcttcctgttcaccgtgggcggcctgaccggcatcgtgctggccaacagcagcctggacatcgtgctgcatgacacctactacgtggtggcccacttccactacgtgctgtccatgggcgctgtgtttgccatcatgggcggcttcatccactggttccccctcttcagcggctacaccctggaccagacctacgccaagatccacttcaccatcatgtttattggagtgaacctgaccttcttcccccagcacttcctgggcctgagcggcatgccccggcgctacagcgactacccagatgcctacaccacctggaacatcctgagctctgtgggcagcttcatcagcctgacagctgtgatgctgatgatcttcatgatctgggaggcctttgccagcaagaggaaggtgctgatggtggaggagcccagcatgaacctggagtggctgtatggctgccccccaccctaccacacctttgaggagcctgtgtacatgaagagctag

SEQ ID NO: 35838 - DNA, 684 bp, Artificial Sequence
  Description of Artificial Sequence: Synthetic coding sequence
atggcccacgccgcccaggtgggcctgcaggatgccaccagccccatcatggaggagctgatcaccttccatgaccacgccctgatgatcatcttcctgatctgcttcctggtgctgtatgccctcttcctgaccctgaccaccaagctgaccaacaccaacatcagtgatgcccaggagatggagaccgtgtggaccatcctgcctgccatcatcctggtgctgattgccctgcccagcctgcgcatcctgtacatgacagatgaggtgaatgaccccagcctgaccatcaagagcatcggccaccagtggtactggacctatgagtacacagattatggaggcctcatcttcaacagctacatgctgcccccactcttcctggagcccggggacctgcggctgctggatgtggacaacagagtggtgctgcccatcgaggcccccatccgcatgatgatcaccagccaggatgtgctgcacagctgggccgtgcccaccctgggcctgaagacagatgccatccctggccgcctgaaccagaccaccttcaccgccaccaggcctggggtgtactacggccagtgcagcgagatctgtggggccaaccacagcttcatgcccatcgtgctggagctgatccccctgaagatctttgagatgggccctgtgttcaccctgtag

SEQ ID NO: 35839 - DNA, 786 bp, Artificial Sequence
  Description of Artificial Sequence: Synthetic coding sequence
atgacccaccagagccacgcctaccacatggtgaagcccagcccctggcccctgactggagccctgagcgccctgctgatgaccagcggcctggccatgtggttccacttccacagcatgaccctgctgatgctgggcctgctgaccaacaccctgaccatgtaccagtggtggagagatgtgacccgggagagcacctaccagggccaccacaccccacctgtgcagaagggcctgcgctatggcatgatcctcttcatcaccagcgaggtgttcttctttgctggcttcttctgggccttctaccacagcagcctggcccccaccccccagctgggcggccactggcccccaacaggcatcacccccctgaaccccctggaggtgcccctgctgaacacctctgtgctgctggccagcggcgtgtccatcacctgggcccaccacagcctgatggagaacaacagaaaccagatgatccaggccctgctgatcaccatcctgctgggcctgtacttcaccctgctgcaggccagcgagtactttgagagccccttcaccatcagtgatggcatctacggcagcaccttctttgtggccaccggcttccacggcctgcacgtgatcatcggcagcaccttcctgaccatctgcttcatccggcagctgatgttccacttcaccagcaagcaccactttggatttgaagctgctgcctggtactggcactttgtggatgtggtgtggctgttcctgtatgtgtccatctactggtggggcagctag

SEQ ID NO: 35840 - DNA, 957 bp, Artificial Sequence
  Description of Artificial Sequence: Synthetic coding sequence
atgcccatggccaacctgctgctgctgattgtgcccatcctgattgccatggccttcctgatgctgacagagaggaagatcctgggctacatgcagctgaggaagggccccaacgtggtgggcccctacggcctgctgcagccctttgctgatgccatgaagctgttcaccaaggagcccctgaagccagccaccagcaccatcaccctgtacatcacagcccccaccctggccctgaccatcgccctgctgctgtggacccccctgcccatgcccaaccccctggtgaacctgaacctgggcctgctcttcatcctggccaccagcagcctggccgtgtacagcatcctgtggagcggctgggccagcaacagcaactatgccctgattggagccctgcgggctgtggcccagaccatctcctatgaggtgaccctggccatcatcctgctgagcaccctgctgatgagcggcagcttcaacctgagcaccctcatcaccacccaggagcacctgtggctgctgctgcccagctggcccctggccatgatgtggttcatcagcaccctggccgagaccaacagaacaccatttgacctggccgagggggagagcgagctggtgtctggcttcaacattgaatatgctgctggcccctttgccctcttcttcatggccgagtacaccaacatcatcatgatgaacaccctgaccaccaccatcttcctgggcaccacctatgatgccctgagccctgagctgtacaccacctactttgtgaccaagaccctgctgctgaccagcctcttcctgtggatcagaacagcctacccccgcttccgctatgaccagctgatgcacctgctgtggaagaacttcctgcccctgaccctggccctgctgatgtggtacgtgtccatgcccatcaccatcagcagcatccccccccagacctag

SEQ ID NO: 35841 - DNA, 1044 bp, Artificial Sequence
  Description of Artificial Sequence: Synthetic coding sequence
atcaaccccctggcccagcctgtgatctacagcaccatctttgctggcaccctcatcacagccctgagcagccactggttcttcacctgggtgggcctggagatgaacatgctggccttcatccctgtgctgaccaagaagatgaaccccaggagcacagaagctgccatcaagtacttcctgacccaggccacagcctccatgatcctgctgatggccatcctcttcaacaacatgctgagcggccagtggaccatgaccaacaccaccaaccagtacagcagcctgatgatcatgatggccatggccatgaagctgggcatggcccccttccacttctgggtgcctgaggtgacccagggcacccccctgaccagcggcctgctgctgctgacctggcagaagctggcccccatcagcatcatgtaccagatcagccccagcctgaatgtgtccctgctgctgaccctgagcatcctgagcatcatggccggctcctggggcggcctgaaccagacccagctgaggaagatcctggcctacagcagcatcacccacatgggctggatgatggctgtgctgccctacaaccccaacatgaccatcctgaacctgaccatctacatcatcctgaccaccacagccttcctgctgctgaacctgaacagcagcaccaccaccctgctgctgagcaggacctggaacaagctgacctggctgacccccctcatccccagcaccctgctgagcctgggcggcctgccccccctgaccggcttcctgcccaagtgggccatcatcgaggagttcaccaagaacaacagcctcatcatccccaccatcatggccaccatcaccctgctgaacctgtacttctacctgcggctcatctacagcaccagcatcaccctgctgcccatgagcaacaacgtgaagatgaagtggcagtttgagcacaccaagcccacccccttcctgcccaccctcatcgccctgaccaccctgctgctgcccatcagccccttcatgctgatgatcctgtag

SEQ ID NO: 35842 - DNA, 348 bp, Artificial Sequence
  Description of Artificial Sequence: Synthetic coding sequence
atgaactttgccctgatcctgatgatcaacaccctgctggccctgctgctgatgatcatcaccttctggctgccccagctgaatggctacatggagaagagcaccccctatgaatgtggctttgaccccatgagccctgcccgggtgcccttctccatgaagttcttcctggtggccatcaccttcctgctgtttgacctggagatcgccctgctgctgcccctgccctgggccctgcagaccaccaacctgcccctgatggtgatgagcagcctgctgctgatcatcatcctggccctgagcctggcctatgagtggctgcagaagggcctggactggacagaatag

SEQ ID NO: 35843 - DNA, 1380 bp, Artificial Sequence
  Description of Artificial Sequence: Synthetic coding sequence
atgctgaagctgattgtgcccaccatcatgctgctgcccctgacctggctgagcaagaagcacatgatctggatcaacaccaccacccacagcctcatcatcagcatcatccccctgctcttcttcaaccagatcaacaacaacctcttcagctgcagccccaccttcagcagtgaccccctgaccacccccctgctgatgctgaccacctggctgctgcccctgaccatcatggccagccagaggcacctgagcagcgagcccctgagcaggaagaagctgtacctgtccatgctgatcagcctgcagatcagcctcatcatgaccttcaccgccacagagctgatcatgttctacatcttctttgagaccaccctcatccccaccctggccatcatcacccgctggggcaaccagcctgagcggctgaatgccggcacctacttcctgttctacaccctggtgggcagcctgcccctgctgattgccctgatctacacccacaacaccctgggcagcctgaacatcctgctgctgaccctgacagcccaggagctgagcaacagctgggccaacaacctgatgtggctggcctacaccatggccttcatggtgaagatgcccctgtatggcctgcacctgtggctgcccaaggcccacgtggaggcccccatcgccggctccatggtgctggccgctgtgctgctgaagctgggcggctacggcatgatgaggctgaccctcatcctgaaccccctgaccaagcacatggcctaccccttcctggtgctgagcctgtggggcatgatcatgaccagcagcatctgcctgcggcagacagacctgaagagcctcatcgcctacagcagcatcagccacatggccctggtggtgacagccatcctgatccagaccccctggagcttcaccggggccgtcatcctgatgattgcccacggcctgaccagcagcctgctcttctgcctggccaacagcaactatgaaagaacccacagccgcatcatgatcctgagccagggcctgcagaccctgctgcccctgatggccttctggtggctgctggccagcctggccaacctggccctgccccccaccatcaacctgctgggggagctgtctgtgctggtgaccaccttctcctggagcaacatcaccctgctgctgaccggcctgaacatgctggtgacagccctgtacagcctgtacatgttcaccaccacccagtggggcagcctgacccaccacatcaacaacatgaagcccagcttcacccgggagaacaccctgatgttcatgcacctgagccccatcctgctgctgagcctgaacccagacatcatcaccggcttcagcagctag

SEQ ID NO: 35844 - DNA, 297 bp, Artificial Sequence
  Description of Artificial Sequence: Synthetic coding sequence
atgcccctcatctacatgaacatcatgctggccttcaccatcagcctgctgggcatgctggtgtaccgcagccacctgatgagcagcctgctgtgcctggagggcatgatgctgagcctcttcatcatggccaccctgatgaccctgaacacccacagcctgctggccaacatcgtgcccatcgccatgctggtgtttgctgcctgtgaggccgctgtgggcctggccctgctggtgtccatcagcaacacctacggcctggactatgtgcacaacctgaacctgctgcagtgctag

SEQ ID NO: 35845 - DNA, 1812 bp, Artificial Sequence
  Description of Artificial Sequence: Synthetic coding sequence
atgaccatgcacaccaccatgaccaccctgaccctgaccagcctcatcccccccatcctgaccaccctggtgaaccccaacaagaagaacagctacccccactacgtgaagagcatcgtggccagcaccttcatcatcagcctcttccccaccaccatgttcatgtgcctggaccaggaggtgatcatcagcaactggcactgggccaccacccagaccacccagctgagcctgtccttcaagctggactacttctccatgatgttcatccctgtggccctgtttgtgacctggagcatcatggagttcagcctgtggtacatgaacagcgaccccaacatcaaccagttcttcaagtacctgctgatcttcctgatcaccatgctgatcctggtgacagccaacaacctcttccagctgttcatcggctgggagggcgtgggcatcatgtccttcctgctgatctcctggtggtacgcccgggcagatgccaacacagctgccatccaggccatcctgtacaacagaattggagacatcggcttcatcctggccctggcctggttcatcctgcacagcaacagctgggacccccagcagatggccctgctgaatgccaaccccagcctgacccccctgctgggcctgctgctggccgctgctgggaagagcgcccagctgggcctgcacccctggctgcccagcgccatggagggccccacccctgtgtctgccctgctgcacagcagcaccatggtggtggccggcatcttcctgctgatccgcttccaccccctggccgagaacagccccctcatccagaccctgaccctgtgcctgggcgccatcaccaccctgtttgctgctgtgtgtgccctgacccagaatgacatcaagaagatcgtggccttcagcaccagcagccagctgggcctgatgatggtgaccatcggcatcaaccagccccacctggccttcctgcacatctgcacccacgccttcttcaaggccatgctgttcatgtgcagcggcagcatcatccacaacctgaacaatgagcaggacatcaggaagatgggcggcctgctgaagaccatgcccctgaccagcaccagcctgaccatcggcagcctggccctggccggcatgcccttcctgaccggcttctacagcaaggaccacatcatcgagacagccaacatgagctacaccaatgcctgggccctgagcatcaccctcatcgccaccagcctgaccagcgcctacagcaccaggatgatcctgctgaccctgaccggccagccccgcttccccaccctgaccaacatcaatgaaaacaaccccaccctgctgaaccccatcaagaggctggccgccggcagcctgtttgctggcttcctgatcaccaacaacatcagccctgccagccccttccagaccaccatccccctgtacctgaagctgacagccctggccgtgaccttcctgggcctgctgacagccctggacctgaactacctgaccaacaagctgaagatgaagagccccctgtgcaccttctacttcagcaacatgctgggcttctaccccagcatcacccacaggaccatcccctacctgggcctgctgaccagccagaacctgcccctgctgctgctggacctgacctggctggagaagctgctgcccaagaccatcagccagcaccagatcagcaccagcatcatcaccagcacccagaagggcatgatcaagctgtacttcctgtccttcttcttccccctcatcctgaccctgctgctgatcacctag

SEQ ID NO: 35846 - DNA, 525 bp, Artificial Sequence
  Description of Artificial Sequence: Synthetic coding sequence
atgatgtatgccctcttcctgctgtctgtgggcctggtgatgggctttgtgggcttcagcagcaagcccagccccatctatggaggcctggtgctgattgtgtctggagtggtgggctgcgtcatcatcctgaactttggaggcggctacatgggcctgatggtgttcctgatctacctgggcggcatgatggtggtgtttggctacaccacagccatggccatcgaggagtacccagaggcctggggcagcggcgtggaggtgctggtgtctgtgctggtgggcctggccatggaggtgggcctggtgctgtgggtgaaggagtatgatggagtggtggtggtggtgaacttcaacagcgtgggctcctggatgatctatgaaggagagggcagcggcctcatccgggaggaccccatcggggccggggccctgtatgactatggccgctggctggtggtggtgacaggctggaccctgtttgtgggcgtgtacatcgtcatcgagatcgcccggggcaactag

SEQ ID NO: 35847 - DNA, 2226 bp, Artificial Sequence
  Description of Artificial Sequence: Synthetic coding sequence
atggccgagcctgtgagccccctgaagcactttgtgctggccaagaaggccatcacagccatctttgaccagctgctggagtttgtgacagagggcagccactttgtggaggccacctacaagaaccctgagctggaccgcatcgccacagaagatgacctggtggagatgcagggctacaaggacaagctgagcatcattggagaggtgctgagcagaagacacatgaaggtggccttctttggaagaaccagcagcggcaagagcagcgtcatcaatgccatgctgtgggacaaggtgctgcccagcggcatcggccacatcaccaactgcttcctgtctgtggagggcacagatggagacaaggcctacctgatgacagagggcagtgatgagaagaagtctgtgaagacagtgaaccagctggcccacgccctgcacatggacaaggacctgaaggccggctgcctggtgcgggtcttctggcccaaggccaagtgtgccctgctgagagatgacctggtgctggtggacagccctggaacagatgtgaccacagagctggacagctggattgacaagttctgcctggatgctgatgtgtttgtgctggtggccaacagcgagagcaccctgatgaacacagagaagcacttcttccacaaggtgaatgaaaggctgagcaagcccaacatcttcatcctgaacaaccgctgggatgccagcgccagcgagcctgagtacatggaggatgtgcggcggcagcacatggagcgctgcctgcacttcctggtggaggagctgaaggtggtgaatgccctggaggcccagaaccgcatcttctttgtgtctgccaaggaggtgctgagcgccaggaagcagaaggcccagggcatgcctgagagcggcgtggccctggccgagggcttccacgcccggctgcaggagttccagaactttgagcagatctttgaggagtgcatcagccagagcgctgtgaagaccaagtttgagcagcacaccatccgggccaagcagatcctggccaccgtgaagaacatcatggattctgtgaacctggccgctgaggacaagaggcactacagcgtggaggagcgggaggaccagattgaccggctggacttcatccggaaccagatgaacctgctgaccctggatgtgaagaagaagatcaaggaggtgacagaggaggtggccaacaaggtgtcctgtgccatgacagatgagatctgccgcctgtctgtgctggtggatgagttctgcagcgagttccaccccaacccagatgtgctgaagatctacaagtctgagctgaacaagcacattgaagatggcatgggcaggaacctggccgaccgctgcacagatgaggtgaatgccctggtgctgcagacccagcaggagatcatcgagaacctgaagcccctgctgcctgctggcatccaggacaagctgcacaccctcatcccctgcaagaagtttgacctgagctacaacctgaactaccacaagctgtgcagcgacttccaggaggacatcgtgttccccttcagcctgggctggagcagcctggtgcaccgcttcctgggccccagaaatgcccagagggtgctgctgggcctgtctgagcccatcttccagctgcccaggagcctggccagcacccccacagcccccaccaccccagccaccccagacaatgccagccaggaggagctgatgatcaccctggtgacaggcctggcctctgtgaccagcaggacctccatgggcatcatcatcgtgggcggcgtcatctggaagaccatcggctggaagctgctgtctgtgtccctgaccatgtacggggccctgtacctgtatgaaaggctgtcctggaccacccacgccaaggagcgggccttcaagcagcagtttgtgaactatgccacagagaagctgaggatgattgtgagcagcaccagcgccaactgcagccaccaggtgaagcagcagatcgccaccacctttgcccggctgtgccagcaggtggacatcacccagaagcagctggaggaggagatcgcccggctgcccaaggagattgaccagctggagaagatccagaacaacagcaagctgctgaggaacaaggctgtgcagctggagaatgagctggagaacttcaccaagcagttcctgcccagcagcaatgaggagagctag

SEQ ID NO: 35848 - DNA, 1893 bp, Artificial Sequence
  Description of Artificial Sequence: Synthetic coding sequence
atggccgagcctgtgagccccctgaagcactttgtgctggccaagaaggccatcacagccatctttgaccagctgctggagtttgtgacagagggcagccactttgtggaggccacctacaagaaccctgagctggaccgcatcgccacagaagatgacctggtggagatgcagggctacaaggacaagctgagcatcattggagaggtgctgagcagaagacacatgaaggtggccttctttggaagaaccagcagcggcaagagcagcgtcatcaatgccatgctgtgggacaaggtgctgcccagcggcatcggccacatcaccaactgcttcctgtctgtggagggcacagatggagacaaggcctacctgatgacagagggcagtgatgagaagaagtctgtgaagacagtgaaccagctggcccacgccctgcacatggacaaggacctgaaggccggctgcctggtgcgggtcttctggcccaaggccaagtgtgccctgctgagagatgacctggtgctggtggacagccctggaacagatgtgaccacagagctggacagctggattgacaagttctgcctggatgctgatgtgtttgtgctggtggccaacagcgagagcaccctgatgaacacagagaagcacttcttccacaaggtgaatgaaaggctgagcaagcccaacatcttcatcctgaacaaccgctgggatgccagcgccagcgagcctgagtacatggaggatgtgcggcggcagcacatggagcgctgcctgcacttcctggtggaggagctgaaggtggtgaatgccctggaggcccagaaccgcatcttctttgtgtctgccaaggaggtgctgagcgccaggaagcagaaggcccagggcatgcctgagagcggcgtggccctggccgagggcttccacgcccggctgcaggagttccagaactttgagcagatctttgaggagtgcatcagccagagcgctgtgaagaccaagtttgagcagcacaccatccgggccaagcagatcctggccaccgtgaagaacatcatggattctgtgaacctggccgctgaggacaagaggcactacagcgtggaggagcgggaggaccagattgaccggctggacttcatccggaaccagatgaacctgctgaccctggatgtgaagaagaagatcaaggaggtgacagaggaggtggccaacaaggtgtcctgtgccatgacagatgagatctgccgcctgtctgtgctggtggatgagttctgcagcgagttccaccccaacccagatgtgctgaagatctacaagagcctgcccaggagcctggccagcacccccacagcccccaccaccccagccaccccagacaatgccagccaggaggagctgatgatcaccctggtgacaggcctggcctctgtgaccagcaggacctccatgggcatcatcatcgtgggcggcgtcatctggaagaccatcggctggaagctgctgtctgtgtccctgaccatgtatggagccctgtacctgtatgagcggctgtcctggaccacccacgccaaggagcgggccttcaagcagcagtttgtgaactatgccacagagaagctgaggatgattgtgagcagcaccagcgccaactgcagccaccaggtgaagcagcagatcgccaccacctttgcccggctgtgccagcaggtggacatcacccagaagcagctggaggaggagatcgcccggctgcccaaggagattgaccagctggagaagatccagaacaacagcaagctgctgaggaacaaggctgtgcagctggagaatgagctggagaacttcaccaagcagttcctgcccagcagcaatgaggagagctag

SEQ ID NO: 35849 - DNA, 468 bp, Artificial Sequence
  Description of Artificial Sequence: Synthetic coding sequence
atggccgagcctgtgagccccctgaagcactttgtgctggccaagaaggccatcacagccatctttgaccagctgctggagtttgtgacagagggcagccactttgtggaggccacctacaagaaccctgagctggaccgcatcgccacagaagatgacctggtggagatgcagggctacaaggacaagctgagcatcattggagaggtgctgagcagaagacacatgaaggtggccttctttggaagaaccagcagcggcaagagcagcgtcatcaatgccatgctgtgggacaaggtgctgcccagcggcatcggccacatcaccaactgcttcctgtctgtggagggcacagatggagacaaggcctacctgatgacagagggcagtgatgagaagaagtctgtgaagacagtgaaccagctggcccacgccctgcacatggacaaggacctgaaggccggctag

SEQ ID NO: 35850 - DNA, 2226 bp, Artificial Sequence; identical to SEQ ID NO: 35847
  Description of Artificial Sequence: Synthetic coding sequence

SEQ ID NO: 35851 - DNA, 1344 bp, Artificial Sequence
  Description of Artificial Sequence: Synthetic coding sequence
atggccgagcctgtgagccccctgaagcactttgtgctggccaagaaggccatcacagccatctttgaccagctgctggagtttgtgacagagggcagccactttgtggaggccacctacaagaaccctgagctggaccgcatcgccacagaagatgacctggtggagatgcagggctacaaggacaagctgagcatcattggagaggtgctgagcagaagacacatgaaggtggccttctttggaagaaccagcagcggcaagagcagcgtcatcaatgccatgctgtgggacaaggtgctgcccagcggcatcggccacatcaccaactgcttcctgtctgtggagggcacagatggagacaaggcctacctgatgacagagggcagtgatgagaagaagtctgtgaagacagtgaaccagctggcccacgccctgcacatggacaaggacctgaaggccggctgcctggtgcgggtcttctggcccaaggccaagtgtgccctgctgagagatgacctggtgctggtggacagccctggaacagatgtgaccacagagctggacagctggattgacaagttctgcctggatgctgatgtgtttgtgctggtggccaacagcgagagcaccctgatgaacacagagaagcacttcttccacaaggtgaatgaaaggctgagcaagcccaacatcttcatcctgaacaaccgctgggatgccagcgccagcgagcctgagtacatggaggatgtgcggcggcagcacatggagcgctgcctgcacttcctggtggaggagctgaaggtggtgaatgccctggaggcccagaaccgcatcttctttgtgtctgccaaggaggtgctgagcgccaggaagcagaaggcccagggcatgcctgagagcggcgtggccctggccgagggcttccacgcccggctgcaggagttccagaactttgagcagatctttgaggagtgcatcagccagagcgctgtgaagaccaagtttgagcagcacaccatccgggccaagcagatcctggccaccgtgaagaacatcatggattctgtgaacctggccgctgaggacaagaggcactacagcgtggaggagcgggaggaccagattgaccggctggacttcatccggaaccagatgaacctgctgaccctggatgtgaagaagaagatcaaggaggtgacagaggaggtggccaacaaggtgtcctgtgccatgacagatgagatctgccgcctgtctgtgctggtggatgagttctgcagcgagttccaccccaacccagatgtgctgaagatctacaagagcaagaagaagaagtag

SEQ ID NO: 35852 - DNA, 4011 bp, Artificial Sequence
  Description of Artificial Sequence: Synthetic coding sequence
atgatggagatccagatggatgaaggaggaggagtggtggtgtaccaggatgactactgcagcggctctgtgatgtctgagcgggtgtctggcctggccggcagcatctaccgggagtttgagcggctcatccactgctatgatgaggaggtggtgaaggagctgatgcccctggtggtgaatgtgctggagaacctggacagcgtgctgtctgagaaccaggagcacgaggtggagctggagctgctgagagaagataatgagcagctgctgacccagtatgaaagagagaaggccctgcggcggcaggccgaggagaagttcattgaatttgaagatgccctggagcaggagaagaaggagctgcagatccaggtggagcactatgagttccagacccggcagctggagctgaaggccaagaactatgctgaccagatcagccggctggaggagcgggagagcgagatgaagaaggagtacaatgccctgcaccagaggcacacagagatgatccagacctacgtggagcacatcgagaggagcaagatgcagcaggtgggcggcaacagccagacagagagcagcctgcccggccgcaggaaggagcggcccaccagcctgaatgtgttccccctggctgatggcaccgtgcgggcccagatcggcggcaagctggtgcctgctggggaccactggcacctgagtgacctgggccagctgcagagcagcagcagctaccagtgcccccaggatgagatgtctgagagcggccagagcagcgctgctgccacccccagcaccaccggcaccaagagcaacacccccaccagctctgtgcccagcgctgctgtgacccccctgaatgaaagcctgcagcccctgggggactatggagtgggcagcaagaacagcaagagggcccgggagaagagggacagcaggaacatggaggtgcaggtgacccaggagatgagaaatgtgtccatcggcatgggcagcagtgatgagtggagcgatgtgcaggacatcatcgacagcaccccagagctggacatgtgcccagagacccggctggacagaacaggcagcagccccacccagggcatcgtgaacaaggccttcggcatcaacacagacagcctgtaccacgagctgagcacagctggcagcgaggtgattggagatgtggatgagggcgctgacctgctgggggagttctctgtgagagatgacttcttcggcatgggcaaggaggtgggcaacctgctgctggagaacagccagctgctggagaccaagaatgccctgaatgtggtgaagaatgacctgattgccaaggtggaccagctgagcggggagcaggaggtgctgcggggggagctggaggccgccaagcaggccaaggtgaagctggagaaccgcatcaaggagctggaggaggagctgaagagggtgaagtctgaggccatcatcgcccggcgggagcccaaggaggaggccgaggatgtgagcagctacctgtgcacagaaagtgacaagatccccatggcccagaggcggcgcttcaccagggtggagatggcccgggtgctgatggagaggaaccagtacaaggagcggctgatggagctgcaggaggccgtgcgctggacagagatgatccgggccagccgggagcaccccagcgtgcaggagaagaagaagagcaccatctggcagttcttcagccgcctcttcagcagcagcagcagccccccaccagccaagaggccctaccccagcgtgaacatccactacaagagccccaccacagctggcttcagccagaggaggaaccacgccatgtgccccatctctgctggcagccggcccctggagttcttcccagatgatgactgcaccagcagcgcccggcgggagcagaagcgggagcagtaccggcaggtgcgggagcacgtgagaaatgatgatggccgcctgcaggcctgtggctggagcctgcctgccaagtacaagcagctgagccccaacggcggccaggaggacaccaggatgaagaatgtgcctgtgcctgtgtactgccggcccctggtggagaaggaccccaccatgaagctgtggtgtgccgccggcgtgaacctgagcggctggaggcccaatgaagatgatgctggaaatggagtgaagccagcccctggccgggaccccctgacctgtgaccgggagggagatggagagcccaagagcgcccacaccagccctgagaagaagaaggccaaggagctgcctgagatggatgccaccagcagccgggtgtggatcctgaccagcaccctgaccaccagcaaggtggtgatcattgatgccaaccagcccggcaccgtggtggaccagttcaccgtgtgcaatgcccacgtgctgtgcatcagcagcatcccagctgccagtgacagcgactacccacctggagagatgttcctggacagtgatgtgaacccagaagatcctggagcagatggagtgctggccggcatcaccctggtgggctgtgccacccgctgcaatgtgcccaggagcaactgcagcagcagaggagacacccctgtgctggacaagggccagggcgaggtggccaccatcgccaacgggaaggtgaaccccagccagagcacagaggaggccacagaggccacagaggtgcctgaccccggccccagcgagcctgagacagccaccctgcggcccggccccctgacagagcacgtgttcacagatcctgcccccacccccagcagcggcccccagcccggctctgaaaatggacctgagccagacagcagcagcaccaggcctgagcctgagcccagcggggaccccactggagctggcagcagcgctgcccccaccatgtggctgggcgcccagaatggctggctgtatgtgcacagcgctgtggccaactggaagaagtgcctgcacagcatcaagctgaaggacagcgtgctgagcctggtgcacgtgaagggccgggtgctggtggccctggctgatggcaccctggccatcttccacagaggagaagatggccagtgggacctgagcaactaccacctgatggacctgggccacccccaccacagcatccgctgcatggctgtggtgtatgacagagtgtggtgtggctacaagaacaaggtgcacgtgatccagcccaagaccatgcagatcgagaagagctttgatgcccacccccggcgggagagccaggtgcggcagctggcctggattggagatggagtgtgggtgtccatccggctggacagcaccctgcggctgtaccacgcccacacccaccagcacctgcaggatgtggacatcgagccctacgtgtccaagatgctgggcaccgggaagctgggcttctcctttgtgcgcatcacagccctgctggtggccggcagccggctgtgggtgggcactggaaatggagtggtgatcagcatccccctgacagagaccgtggtgctgcaccggggccagctgctgggcctgcgggccaacaagaccagccccaccagcggggagggcgcccggcctgggggcatcatccacgtgtatggagatgacagcagtgacagagctgccagcagcttcatcccctactgcagcatggcccaggcccagctgtgcttccacggccacagagatgctgtgaagttctttgtgtctgtgcctggaaatgtgctggccaccctgaatggatctgtgctggacagccctgctgagggccctggccctgctgccccagccagcgaggtggagggccagaagctgagaaatgtgctggtgctgagcggcggggagggctacatcgacttcagaattggagatggagaagatgatgaaacagaggagggcgctggggacatgagccaggtgaagcctgtgctgagcaaggccgagaggagccacatcatcgtgtggcaggtgtcctacaccccagagtag

SEQ ID NO: 35853 - DNA, 3993 bp, Artificial Sequence
  Description of Artificial Sequence: Synthetic coding sequence
atgatggagatccagatggatgaaggaggaggagtggtggtgtaccaggatgactactgcagcggctctgtgatgtctgagcgggtgtctggcctggccggcagcatctaccgggagtttgagcggctcatccactgctatgatgaggaggtggtgaaggagctgatgcccctggtggtgaatgtgctggagaacctggacagcgtgctgtctgagaaccaggagcacgaggtggagctggagctgctgagagaagataatgagcagctgctgacccagtatgaaagagagaaggccctgcggcggcaggccgaggagaagttcattgaatttgaagatgccctggagcaggagaagaaggagctgcagatccaggtggagcactatgagttccagacccggcagctggagctgaaggccaagaactatgctgaccagatcagccggctggaggagcgggagagcgagatgaagaaggagtacaatgccctgcaccagaggcacacagagatgatccagacctacgtggagcacatcgagaggagcaagatgcagcaggtgggcggcaacagccagacagagagcagcctgcccggccgcaggaaggagcggcccaccagcctgaatgtgttccccctggctgatggcaccgtgcgggcccagatcggcggcaagctggtgcctgctggggaccactggcacctgagtgacctgggccagctgcagagcagcagcagctaccagtgcccccaggatgagatgtctgagagcggccagagcagcgctgctgccacccccagcaccaccggcaccaagagcaacacccccaccagctctgtgcccagcgctgctgtgacccccctgaatgaaagcctgcagcccctgggggactatggagtgggcagcaagaacagcaagagggcccgggagaagagggacagcaggaacatggaggtgcaggtgacccaggagatgagaaatgtgtccatcggcatgggcagcagtgatgagtggagcgatgtgcaggacatcatcgacagcaccccagagctggacatgtgcccagagacccggctggacagaacaggcagcagccccacccagggcatcgtgaacaaggccttcggcatcaacacagacagcctgtaccacgagctgagcacagctggcagcgaggtgattggagatgtggatgagggcgctgacctgctgggggagttcagcggcatgggcaaggaggtgggcaacctgctgctggagaacagccagctgctggagaccaagaatgccctgaatgtggtgaagaatgacctgattgccaaggtggaccagctgagcggggagcaggaggtgctgcggggggagctggaggccgccaagcaggccaaggtgaagctggagaaccgcatcaaggagctggaggaggagctgaagagggtgaagtctgaggccatcatcgcccggcgggagcccaaggaggaggccgaggatgtgagcagctacctgtgcacagaaagtgacaagatccccatggcccagaggcggcgcttcaccagggtggagatggcccgggtgctgatggagaggaaccagtacaaggagcggctgatggagctgcaggaggccgtgcgctggacagagatgatccgggccagccgggagcaccccagcgtgcaggagaagaagaagagcaccatctggcagttcttcagccgcctcttcagcagcagcagcagccccccaccagccaagaggccctaccccagcgtgaacatccactacaagagccccaccacagctggcttcagccagaggaggaaccacgccatgtgccccatctctgctggcagccggcccctggagttcttcccagatgatgactgcaccagcagcgcccggcgggagcagaagcgggagcagtaccggcaggtgcgggagcacgtgagaaatgatgatggccgcctgcaggcctgtggctggagcctgcctgccaagtacaagcagctgagccccaacggcggccaggaggacaccaggatgaagaatgtgcctgtgcctgtgtactgccggcccctggtggagaaggaccccaccatgaagctgtggtgtgccgccggcgtgaacctgagcggctggaggcccaatgaagatgatgctggaaatggagtgaagccagcccctggccgggaccccctgacctgtgaccgggagggagatggagagcccaagagcgcccacaccagccctgagaagaagaaggccaaggagctgcctgagatggatgccaccagcagccgggtgtggatcctgaccagcaccctgaccaccagcaaggtggtgatcattgatgccaaccagcccggcaccgtggtggaccagttcaccgtgtgcaatgcccacgtgctgtgcatcagcagcatcccagctgccagtgacagcgactacccacctggagagatgttcctggacagtgatgtgaacccagaagatcctggagcagatggagtgctggccggcatcaccctggtgggctgtgccacccgctgcaatgtgcccaggagcaactgcagcagcagaggagacacccctgtgctggacaagggccagggcgaggtggccaccatcgccaacgggaaggtgaaccccagccagagcacagaggaggccacagaggccacagaggtgcctgaccccggccccagcgagcctgagacagccaccctgcggcccggccccctgacagagcacgtgttcacagatcctgcccccacccccagcagcggcccccagcccggctctgaaaatggacctgagccagacagcagcagcaccaggcctgagcctgagcccagcggggaccccactggagctggcagcagcgctgcccccaccatgtggctgggcgcccagaatggctggctgtatgtgcacagcgctgtggccaactggaagaagtgcctgcacagcatcaagctgaaggacagcgtgctgagcctggtgcacgtgaagggccgggtgctggtggccctggctgatggcaccctggccatcttccacagaggagaagatggccagtgggacctgagcaactaccacctgatggacctgggccacccccaccacagcatccgctgcatggctgtggtgtatgacagagtgtggtgtggctacaagaacaaggtgcacgtgatccagcccaagaccatgcagatcgagaagagctttgatgcccacccccggcgggagagccaggtgcggcagctggcctggattggagatggagtgtgggtgtccatccggctggacagcaccctgcggctgtaccacgcccacacccaccagcacctgcaggatgtggacatcgagccctacgtgtccaagatgctgggcaccgggaagctgggcttctcctttgtgcgcatcacagccctgctggtggccggcagccggctgtgggtgggcactggaaatggagtggtgatcagcatccccctgacagagaccgtggtgctgcaccggggccagctgctgggcctgcgggccaacaagaccagccccaccagcggggagggcgcccggcctgggggcatcatccacgtgtatggagatgacagcagtgacagagctgccagcagcttcatcccctactgcagcatggcccaggcccagctgtgcttccacggccacagagatgctgtgaagttctttgtgtctgtgcctggaaatgtgctggccaccctgaatggatctgtgctggacagccctgctgagggccctggccctgctgccccagccagcgaggtggagggccagaagctgagaaatgtgctggtgctgagcggcggggagggctacatcgacttcagaattggagatggagaagatgatgaaacagaggagggcgctggggacatgagccaggtgaagcctgtgctgagcaaggccgagaggagccacatcatcgtgtggcaggtgtcctacaccccagagtag

SEQ ID NO: 35854 - DNA, 1569 bp, Artificial Sequence
  Description of Artificial Sequence: Synthetic coding sequence
atggccttcctggacaaccccaccatcatcctggcccacatccggcagagccacgtgaccagtgatgacaccggcatgtgtgagatggtgctgattgaccatgatgtggacctggagaagatccaccccccatccatgcctggggacagcggcagcgagatccagggcagcaatggagagacccagggctacgtgtatgcccagagcgtggacatcaccagctcctgggactttggcatcagaagaagaagcaacacagcccagaggctggagcggctgaggaaggagcggcagaaccagatcaagtgcaagaacatccagtggaaggagaggaacagcaagcagagcgcccaggagctgaagagcctgtttgagaagaagagcctgaaggagaagccacccatcagcggcaagcagagcatcctgtctgtgcggctggagcagtgccccctgcagctgaacaaccccttcaatgagtacagcaagtttgatggcaagggccacgtgggcaccacagccaccaagaagattgatgtgtacctgcccctgcacagcagccaggaccggctgctgcccatgacagtggtgaccatggccagcgcccgggtgcaggacctgattggcctcatctgctggcagtacaccagcgagggccgggagcccaagctgaatgacaacgtgtctgcctactgcctgcacatcgccgaggatgatggagaggtggacacagacttcccccccctggacagcaatgagcccatccacaagtttggcttcagcaccctggccctggtggagaagtacagcagccctggcctgaccagcaaggagagcctgtttgtgcgcatcaatgctgcccacggcttcagcctcatccaggtggacaacaccaaggtgaccatgaaggagatcctgctgaaggctgtgaagaggaggaagggcagccagaaggtgtctggcccccagtaccgcctggagaagcagagcgagcccaacgtggccgtggacctggacagcaccctggagagccagagcgcctgggagttctgcctggtgcgggagaacagcagcagagcagatggagtgtttgaggaggacagccagattgatattgccaccgtgcaggacatgctgagcagccaccactacaagagcttcaaggtgtccatgatccaccggctgcgcttcaccacagatgtgcagctgggcatcagcggggacaaggtggagattgatcctgtgaccaaccagaaggccagcaccaagttctggatcaagcagaagcccatcagcattgacagcgacctgctgtgtgcctgtgacctggccgaggagaagagccccagccacgccatcttcaagctgacctacctgagcaaccacgactacaagcacctgtactttgaaagtgatgctgccaccgtgaatgagatcgtgctgaaggtgaactacatcctggagagccgggccagcacagcccgggctgactactttgcccagaagcagaggaagctgaacagaaggaccagcttctccttccagaaggagaagaagagcggccagcagtag

SEQ ID NO: 35855 - DNA, 1461 bp, Artificial Sequence
  Description of Artificial Sequence: Synthetic coding sequence
atggccttcctggacaaccccaccatcatcctggcccacatccggcagagccacgtgaccagtgatgacaccggcatgtgtgagatggtgctgattgaccatgatgtggacctggagaagatccaccccccatccatgcctggggacagcggcagcgagatccagggcagcaatggagagacccagggctacgtgtatgcccagagcgtggacatcaccagctcctgggactttggcatcagaagaagaagcaacacagcccagaggctggagcggctgaggaaggagcggcagaaccagatcaagtgcaagaacatccagtggaaggagaggaacagcaagcagagcgcccaggagctgaagagcctgtttgagaagaagagcctgaaggagaagccacccatcagcggcaagcagagcatcctgtctgtgcggctggagcagtgccccctgcagctgaacaaccccttcaatgagtacagcaagtttgatggcaagggccacgtgggcaccacagccaccaagaagattgatgtgtacctgcccctgcacagcagccaggaccggctgctgcccatgacagtggtgaccatggccagcgcccgggtgcaggacctgattggcctcatctgctggcagtacaccagcgagggccgggagcccaagctgaatgacaacgtgtctgcctactgcctgcacatcgccgaggatgatggagaggtggacacagacttcccccccctggacagcaatgagcccatccacaagtttggcttcagcaccctggccctggtggagaagtacagcagccctggcctgaccagcaaggagagcctgtttgtgcgcatcaatgctgcccacggcttcagcctcatccaggtggacaacaccaaggtgaccatgaaggagatcctgctgaaggctgtgaagaggaggaagggcagccagaaggtgtctggcagcagagcagatggagtgtttgaggaggacagccagattgatattgccaccgtgcaggacatgctgagcagccaccactacaagagcttcaaggtgtccatgatccaccggctgcgcttcaccacagatgtgcagctgggcatcagcggggacaaggtggagattgatcctgtgaccaaccagaaggccagcaccaagttctggatcaagcagaagcccatcagcattgacagcgacctgctgtgtgcctgtgacctggccgaggagaagagccccagccacgccatcttcaagctgacctacctgagcaaccacgactacaagcacctgtactttgaaagtgatgctgccaccgtgaatgagatcgtgctgaaggtgaactacatcctggagagccgggccagcacagcccgggctgactactttgcccagaagcagaggaagctgaacagaaggaccagcttctccttccagaaggagaagaagagcggccagcagtag

SEQ ID NO: 35856 - DNA, 399 bp, Artificial Sequence
  Description of Artificial Sequence: Synthetic coding sequence
atggccttcctggacaaccccaccatcatcctggcccacatccggcagagccacgtgaccagtgatgacaccggcatgtgtgagatggtgctgattgaccatgatgtggacctggagaagatccaccccccatccatgcctggggacagcggcagcgagatccagggcagcaatgcccagaggctggagcggctgaggaaggagcggcagaaccagatcaagtgcaagaacatccagtggaaggagaggaacagcaagcagagcgcccaggagctgaagagcctgtttgagaagaagagcctgaaggagaagccacccatcagcggcaagcagagcatcctgtctgtgcggctggagcagtgccccctgcagctgaacaaccccttcaatgagtactag

SEQ ID NO: 35857 - DNA, 708 bp, Artificial Sequence
  Description of Artificial Sequence: Synthetic coding sequence
atgacagtggtgaccatggccagcgcccgggtgcaggacctgattggcctcatctgctggcagtacaccagcgagggccgggagcccaagctgaagaatgctgcccacggcttcagcctcatccaggtggacaacaccaaggtgaccatgaaggagatcctgctgaaggctgtgaagaggaggaagggcagccagaaggtgtctggcagcagagcagatggagtgtttgaggaggacagccagattgacatcgccaccgtgcaggacatgctgagcagccaccactacaagagcttcaaggtgtccatgatccaccggctgcgcttcaccacagatgtgcagctgggcatcagcggggacaaggtggagattgatcctgtgaccaaccagaaggccagcaccaagttctggatcaagcagaagcccatcagcattgacagcgacctgctgtgtgcctgtgacctggccgaggagaagagccccagccacgccatcttcaagctgacctacctgagcaaccacgactacaagcacctgtactttgaaagtgatgctgccaccgtgaatgaaattgtgctgaaggtgaactacatcctggagagccgggccagcacagcccgggctgactactttgcccagaagcagaggaagctgaacagaaggaccagcttctccttccagaaggagaagaagagcggccagcagtag

SEQ ID NO: 35858 - DNA, 1569 bp, Artificial Sequence; identical to SEQ ID NO: 35854
  Description of Artificial Sequence: Synthetic coding sequence

SEQ ID NO: 35859 - DNA, 993 bp, Artificial Sequence
  Description of Artificial Sequence: Synthetic coding sequence
atgacagtggtgaccatggccagcgcccgggtgcaggacctgattggcctcatctgctggcagtacaccagcgagggccgggagcccaagctgaatgacaacgtgtctgcctactgcctgcacatcgccgaggatgatggagaggtggacacagacttcccccccctggacagcaatgagcccatccacaagtttggcttcagcaccctggccctggtggagaagtacagcagccctggcctgaccagcaaggagagcctgtttgtgcgcatcaatgctgcccacggcttcagcctcatccaggtggacaacaccaaggtgaccatgaaggagatcctgctgaaggctgtgaagaggaggaagggcagccagaaggtgtctggcccccagtaccgcctggagaagcagagcgagcccaacgtggccgtggacctggacagcaccctggagagccagagcgcctgggagttctgcctggtgcgggagaacagcagcagagcagatggagtgtttgaggaggacagccagattgatattgccaccgtgcaggacatgctgagcagccaccactacaagagcttcaaggtgtccatgatccaccggctgcgcttcaccacagatgtgcagctgggcatcagcggggacaaggtggagattgatcctgtgaccaaccagaaggccagcaccaagttctggatcaagcagaagcccatcagcattgacagcgacctgctgtgtgcctgtgacctggccgaggagaagagccccagccacgccatcttcaagctgacctacctgagcaaccacgactacaagcacctgtactttgaaagtgatgctgccaccgtgaatgagatcgtgctgaaggtgaactacatcctggagagccgggccagcacagcccgggctgactactttgcccagaagcagaggaagctgaacagaaggaccagcttctccttccagaaggagaagaagagcggccagcagtag

SEQ ID NO: 35860 - DNA, 678 bp, Artificial Sequence
  Description of Artificial Sequence: Synthetic coding sequence
atgcctggggacagcggcagcgagatccagggcagcaatggagagacccagggctacgtgtatgcccagagcgtggacatcaccagctcctgggactttggcatcagaagaagaagcaacacagcccagaggctggagcggctgaggaaggagcggcagaaccagatcaagtgcaagaacatccagtggaaggagaggaacagcaagcagagcgcccaggagctgaagagcctgtttgagaagaagagcctgaaggagaagccacccatcagcggcaagcagagcatcctgtctgtgcggctggagcagtgccccctgcagctgaacaaccccttcaatgagtacagcaagtttgatggcaagcactgcagcagcctgtgccgcatcatcatgaacaagtgcttcctgcagagcctggccctgaacagcagcctgcagaggaagagcctgaagaccctgcagaagtccatgaagcccccaagaaatgtggccaacagcgagaagggccacgtgggcaccacagccaccaagaagattgatgtgtacctgcccctgcacagcagccaggaccggctgctgcccatgacagtggtgaccatggccagcgcccgggtgcaggacctgattggcctcatctgctggcagtacaccagcgagggccgggagcccaagctgtag

SEQ ID NO: 35861 - DNA, 1428 bp, Artificial Sequence
  Description of Artificial Sequence: Synthetic coding sequence
atggccttcctggacaaccccaccatcatcctggcccacatccggcagagccacgtgaccagtgatgacaccggcatgtgtgagatggtgctgattgaccatgatgtggacctggagaagatccaccccccatccatgcctggggacagcggcagcgagatccagggcagcaatggagagacccagggctacgtgtatgcccagagcgtggacatcaccagctcctgggactttggcatcagaagaagaagcaacacagcccagaggctggagcggctgaggaaggagcggcagaaccagatcaagtgcaagaacatccagtggaaggagaggaacagcaagcagagcgcccaggagctgaagagcctgtttgagaagaagagcctgaaggagaagccacccatcagcggcaagcagagcatcctgtctgtgcggctggagcagtgccccctgcagctgaacaaccccttcaatgagtacagcaagtttgatggcaagggccacgtgggcaccacagccaccaagaagattgatgtgtacctgcccctgcacagcagccaggaccggctgctgcccatgacagtggtgaccatggccagcgcccgggtgcaggacctgattggcctcatctgctggcagtacaccagcgagggccgggagcccaagctgaatgacaacgtgtctgcctactgcctgcacatcgccgaggatgatggagaggtggacacagacttcccccccctggacagcaatgagcccatccacaagtttggcttcagcaccctggccctggtggagaagtacagcagccctggcctgaccagcaaggagagcctgtttgtgcgcatcaatgctgcccacggcttcagcctcatccaggtggacaacaccaaggtgaccatgaaggagatcctgctgaaggctgtgaagaggaggaagggcagccagaaggtgtctggcccccagtaccgcctggagaagcagagcgagcccaacgtggccgtggacctggacagcaccctggagagccagagcgcctgggagttctgcctggtgcgggagaacagcatcagcggggacaaggtggagattgatcctgtgaccaaccagaaggccagcaccaagttctggatcaagcagaagcccatcagcattgacagcgacctgctgtgtgcctgtgacctggccgaggagaagagccccagccacgccatcttcaagctgacctacctgagcaaccacgactacaagcacctgtactttgaaagtgatgctgccaccgtgaatgaaattgtgctgaaggtgaactacatcctggagagccgggccagcacagcccgggctgactactttgcccagaagcagaggaagctgaacagaaggaccagcttctccttccagaaggagaagaagagcggccagcagtag

SEQ ID NO: 35862 - DNA, 993 bp, Artificial Sequence; identical to SEQ ID NO: 35859
  Description of Artificial Sequence: Synthetic coding sequence

SEQ ID NO: 35863 - DNA, 282 bp, Artificial Sequence
  Description of Artificial Sequence: Synthetic coding sequence
atggccttcctggacaaccccaccatcatcctggcccacatccggcagagccacgtgaccagtgatgacaccggcatgtgtgagatggtgctgattgaccatgatgtggacctggagaagatccaccccccatccatgcctggggacagcggcagcgagatccagggcagcaatggagagacccagggctacgtgtatgcccagagcgtggacatcaccagctcctgggactttggcatcagaagaagaagcaacacagcccagaggctggagcggctgtag

SEQ ID NO: 35864 - DNA, 285 bp, Artificial Sequence
  Description of Artificial Sequence: Synthetic coding sequence
tgaaaatccttcaaggtgtccatgatccaccggctgcgcttcaccacagatgtgcagctgggccacgccatcttcaagctgacctacctgagcaaccacgactacaagcacctgtactttgaaagtgatgctgccaccgtgaatgagatcgtgctgaaggtgaactacatcctggagagccgggccagcacagcccgggctgactactttgcccagaagcagaggaagctgaacagaaggaccagcttctccttccagaaggagaagaagagcggccagcagtag

SEQ ID NO: 35865 - DNA, 972 bp, Artificial Sequence
  Description of Artificial Sequence: Synthetic coding sequence
atggccttcctggacaaccccaccatcatcctggcccacatccggcagagccacgtgaccagtgatgacaccggcatgtgtgagatggtgctgattgaccatgatgtggacctggagaagatccaccccccatccatgcctggggacagcggcagcgagatccagggcagcaatggagagacccagggctacgtgtatgcccagagcgtggacatcaccagctcctgggactttggcatcagaagaagaagcaacacagcccagaggctggagcggctgaggaaggagcggcagaaccagatcaagtgcaagaacatccagtggaaggagaggaacagcaagcagagcgcccaggagctgaagagcctgtttgagaagaagagcctgaaggagaagccacccatcagcggcaagcagagcatcctgtctgtgcggctggagcagtgccccctgcagctgaacaaccccttcaatgagtacagcaagtttgatggcaagggccacgtgggcaccacagccaccaagaagattgatgtgtacctgcccctgcacagcagccaggaccggctgctgcccatgacagtggtgaccatggccagcgcccgggtgcaggacctgattggcctcatctgctggcagtacaccagcgagggccgggagcccaagctgaatgacaacgtgtctgcctactgcctgcacatcgccgaggatgatggagaggtggacacagacttcccccccctggacagcaatgagcccatccacaagtttggcttcagcaccctggccctggtggagaagtacagcagccctggcctgaccagcaaggagagcctgtttgtgcgcatcaatgctgcccacggcttcagcctcatccaggtggacaacaccaaggtgaccatgaaggagatcctgctgaaggctgtgaagaggaggaagggcagccagaaggtgtctggggcctgtgactag

SEQ ID NO: 35866 - DNA, 1008 bp, Artificial Sequence
  Description of Artificial Sequence: Synthetic coding sequence
atgaaggtggagtttgcccccctgaacatccagctggcccggcggctgcagacagtggccgtgctgcagtgggtgctgaagtacctgctgctgggccccatgagcatcggcatcaccgtgatgctgatcatccacaactacctgttcctgtacatcccctacctgatgtggctgtactttgactggcacaccccagagcggggcggccgccgcagctcctggatcaagaactggaccctgtggaagcacttcaaggactacttccccatccacctgatcaagacccaggacctggaccccagccacaactacatcttcggcttccacccccacggcatcatggctgtgggcgcctttggaaacttctctgtgaactacagcgacttcaaggacctcttccctggcttcaccagctacctgcacgtgctgcccctgtggttctggtgccctgtgttccgggagtatgtgatgtctgtgggcctggtgtctgtgtccaagaagtctgtgtcctacatggtgtccaaggagggcggcggcaacatcagcgtcatcgtgctgggcggggccaaggagagcctggatgcccaccctgggaagttcaccctcttcatccggcagaggaagggctttgtgaagatcgccctgacccatggagccagcctggtgcctgtggtgtcctttggagaaaatgagctgttcaagcagacagacaaccctgagggctcctggatcagaacagtgcagaacaagctgcagaagatcatgggctttgccctgcccctcttccacgcccggggcgtcttccagtacaactttggcctgatgacctacaggaaggccatccacacagtggtgggccggcccatccctgtgcggcagaccctgaaccccacccaggagcagatcgaggagctgcaccagacctacatggaggagctgaggaagctgtttgaggagcacaagggcaagtatggcatccctgagcacgagaccctggtgctgaagtag

SEQ ID NO: 35867 - DNA, 1005 bp, Artificial Sequence
  Description of Artificial Sequence: Synthetic coding sequence
atggtggagtttgcccccctcttcatgccctgggagcggcggctgcagaccctggccgtgctgcagtttgtgttctccttcctggccctggccgagatctgcaccgtgggcttcatcgccctgctcttcacccgcttctggctgctgactgtgctgtatgctgcctggtggtacctggaccgggacaagccccggcagggcggccgccacatccaggccatccgctgctggaccatctggaagtacatgaaggactacttccccatcagcctggtgaagacagctgagctggaccccagcaggaactacatcgccggcttccacccccacggcgtgctggccgtgggcgcctttgccaacctgtgcacagagagcacaggcttcagcagcatcttccctggcatccggccccacctgatgatgctgaccctgtggttccgggcccccttcttccgggactacatcatgtctgctggcctggtgaccagcgagaaggagagcgctgcccacatcctgaacagaaaaggaggcggcaacctgctgggcatcatcgtgggcggggcccaggaggccctggatgcccggcccggcagcttcaccctgctgctgaggaacagaaaaggatttgtgcggctggccctgacccacggggcccccctggtgcccatcttctcctttggagaaaatgacctgtttgaccagatccccaacagcagcggctcctggctgcgctacatccagaaccggctgcagaagatcatgggcatcagcctgcccctcttccacggccggggcgtcttccagtacagctttggcctcatcccctacagaagacccatcaccaccgtggtgggcaagcccatcgaggtgcagaagaccctgcaccccagcgaggaggaggtgaaccagctgcaccagcgctacatcaaggagctgtgcaacctgtttgaggcccacaagctgaagttcaacatcccagctgaccagcacctggagttctgctag

SEQ ID NO: 35868 - DNA, 759 bp, Artificial Sequence
  Description of Artificial Sequence: Synthetic coding sequence
atgaaggactacttccccatcagcctggtgaagacagctgagctggaccccagcaggaactacatcgccggcttccacccccacggcgtgctggccgtgggcgcctttgccaacctgtgcacagagagcacaggcttcagcagcatcttccctggcatccggccccacctgatgatgctgaccctgtggttccgggcccccttcttccgggactacatcatgtctgctggcctggtgaccagcgagaaggagagcgctgcccacatcctgaacagaaaaggaggcggcaacctgctgggcatcatcgtgggcggggcccaggaggccctggatgcccggcccggcagcttcaccctgctgctgaggaacagaaaaggatttgtgcggctggccctgacccacggggcccccctggtgcccatcttctcctttggagaaaatgacctgtttgaccagatccccaacagcagcggctcctggctgcgctacatccagaaccggctgcagaagatcatgggcatcagcctgcccctcttccacggccggggcgtcttccagtacagctttggcctcatcccctacagaagacccatcaccaccgtggtgggcaagcccatcgaggtgcagaagaccctgcaccccagcgaggaggaggtgaaccagctgcaccagcgctacatcaaggagctgtgcaacctgtttgaggcccacaagctgaagttcaacatcccagctgaccagcacctggagttctgctag

SEQ ID NO: 35869 - DNA, 1209 bp, Artificial Sequence
  Description of Artificial Sequence: Synthetic coding sequence
atgcagatgagccctgccctgacctgcctggtgctgggcctggccctggtgtttggagagggcagcgctgtgcaccaccccccatcctatgtggcccacctggccagtgactttggagtgcgggtcttccagcaggtggcccaggccagcaaggacagaaatgtggtgttcagcccctacggcgtggcctctgtgctggccatgctgcagctgaccactggaggagagacccagcagcagatccaggccgccatgggcttcaagattgatgacaagggcatggccccagccctgcggcacctgtacaaggagctgatgggcccctggaacaaggatgagatcagcaccacagatgccatctttgtgcagagggacctgaagctggtgcagggcttcatgccccacttcttccgcctcttccgcagcacagtgaagcaggtggacttcagcgaggtggagcgggcccgcttcatcatcaatgactgggtgaagacccacaccaagggcatgatcagcaacctgctgggcaaaggagctgtggaccagctgacccggctggtgctggtgaatgccctgtacttcaacggccagtggaagacccccttcccagacagcagcacccacagaagactcttccacaagagtgatggcagcacagtgtctgtgcccatgatggcccagaccaacaagttcaactacacagagttcaccaccccagatggccactactatgacatcctggagctgccctaccacggggacaccctgtccatgttcatcgccgccccctatgagaaggaggtgcccctgagcgccctgaccaacatcctgagcgcccagctgatcagccactggaagggcaacatgacccggctgccccggctgctggtgctgcccaagttcagcctggagacagaggtggacctgaggaagcccctggagaacctgggcatgacagacatgttccggcagttccaggccgacttcaccagcctgagtgaccaggagcccctgcacgtggcccaggccctgcagaaggtgaagattgaggtgaatgaaagtggcaccgtggccagcagcagcacagctgtgattgtgtctgccaggatggcccctgaggagatcatcatggaccggcccttcctgtttgtggtgcgccacaaccccaccggcaccgtgctcttcatgggccaggtgatggagccctag

SEQ ID NO: 35870 - DNA, 846 bp, Artificial Sequence
  Description of Artificial Sequence: Synthetic coding sequence
atgggcgtggccaccaccctgcagccccccaccaccagcaagaccctgcagaagcagcacctggaggccgtgggcgcctaccagtatgtgctgaccttcctgttcatgggccccttcttcagcctgctggtgtttgtgctgctcttcaccagcctgtggcccttcagcgtcttctacctggtgtggctgtatgtggactgggacacccccaaccagggcggcagaagaagtgagtggatccggaacagagccatctggaggcagctgcgggactactaccctgtgaagctggtgaagacagctgagctgcccccagacagaaattatgtgctgggcgcccacccccacggcatcatgtgcaccggcttcctgtgcaacttcagcacagagagcaatggcttcagccagctgtttcctggcctgcggccctggctggccgtgctggccggcctcttctacctgcctgtgtacagagactacatcatgagctttggcctgtgccctgtgtcccggcagagcctggacttcatcctgagccagccccagctgggccaggccgtggtgatcatggtgggcggggcccacgaggccctgtacagcgtgcctggagagcactgcctgaccctgcagaagaggaaaggatttgtgcggctggccctgcggcacggcggccccccccacccccggcccccagcccccccaccccaccggggcggcagccagagcctgagccggcccctgcatgatggccctggagctgccctgcggggggcccagggcaagctgtggggcccccgcttccacctgccccacctgcacctgggcctggccgccgccttcagatag

SEQ ID NO: 35871 - DNA, 1035 bp, Artificial Sequence
  Description of Artificial Sequence: Synthetic coding sequence
atgggcgtggccaccaccctgcagccccccaccaccagcaagaccctgcagaagcagcacctggaggccgtgggcgcctaccagtatgtgctgaccttcctgttcatgggccccttcttcagcctgctggtgtttgtgctgctcttcaccagcctgtggcccttcagcgtcttctacctggtgtggctgtatgtggactgggacacccccaaccagggcggcagaagaagtgagtggatccggaacagagccatctggaggcagctgcgggactactaccctgtgaagctggtgaagacagctgagctgcccccagacagaaattatgtgctgggcgcccacccccacggcatcatgtgcaccggcttcctgtgcaacttcagcacagagagcaatggcttcagccagctgtttcctggcctgcggccctggctggccgtgctggccggcctcttctacctgcctgtgtacagagactacatcatgagctttggcctgtgccctgtgtcccggcagagcctggacttcatcctgagccagccccagctgggccaggccgtggtgatcatggtgggcggggcccacgaggccctgtacagcgtgcctggagagcactgcctgaccctgcagaagaggaaaggatttgtgcggctggccctgcggcacggggccagcctggtgcctgtgtacagctttggagaaaatgacatcttccggctgaaggcctttgccaccggctcctggcagcactggtgccagctgaccttcaagaagctgatgggcttcagcccctgcatcttctggggccggggcctcttcagcgccacctcctggggcctgctgccctttgctgtgcccatcaccaccgtgggggagtgccccccacctgggggccggcccccagctgctgcctgggccagcggcatcccccggccccctgtgtccctgagcctgcagtgggccgcccccagccccagccccagcgccagcaccccacccaggaggaagagcatcaccatcacccccagcacctag

SEQ ID NO: 35872 - DNA, 645 bp, Artificial Sequence
  Description of Artificial Sequence: Synthetic coding sequence
atgcaccagcagaagaggcagcctgagctggtggagggcaacctgcctgtgtttgtgttccccacagagctgatcttctatgcagatgaccagagcacccacaagcaggtgctgaccctgtacaacccctatgaatttgccctgaagttcaaggtgctgtgcaccacccccaacaagtatgtggtggtggatgctgctggagctgtgaagccccagtgctgcgtggacatcgtcatccgccacagagatgtgcgcagctgccactatggagtcatcgacaagttccggctgcaggtgtctgagcagagccagaggaaggccctgggcaggaaggaggtggtggccaccctgctgcccagcgccaaggagcagcagaaggaggaggaggagaagaggctgaaggagcacctgacagagagcctcttctttgagcagagcttccagcccgggaagaacagagctgtgagcagcggccccagcctgctgactgtgttcctgggcgtggtgtgcatcgccgccctgatgctgcccaccctgggagatgtggagagcctggtgcccctgtacctgcacctgtctgtgaaccagaagctggtggccgcctacatcctgggcctcatcaccatggccatcctgcggacctag

SEQ ID NO: 35873 - DNA, 480 bp, Artificial Sequence
  Description of Artificial Sequence: Synthetic coding sequence
atgcaccagcagaagaggcagcctgagctggtggagggcaacctgcctgtgtttgtgttccccacagagctgatcttctatgcagatgaccagagcacccacaagcaggtgctgaccctgtacaacccctatgaatttgccctgaagttcaaggtgctgtgcaccacccccaacaagtatgtggtggtggatgctgctggagctgtgaagccccagtgctgcgtggacatcgtcatccgccacagagatgtgcgcagctgccactatggagtcatcgacaagttccggctgcaggtgtctgagcagagccagaggaaggccctgggcaggaaggaggtggtggccaccctgctgcccagcgccaaggagcagcagaaggaggaggaggagaagaggctgaaggagcacctgacagagagcctcttctttgagcagagcttccagcccggcctcatcaccatggccatcctgcggacctag

SEQ ID NO: 35874 - DNA, 642 bp, Artificial Sequence
  Description of Artificial Sequence: Synthetic coding sequence
atgcaccagcagaagaggcagcctgagctggtggagggcaacctgcctgtgtttgtgttccccacagagctgatcttctatgcagatgaccagagcacccacaagcaggtgctgaccctgtacaacccctatgaatttgccctgaagttcaaggtgctgtgcaccacccccaacaagtatgtggtggtggatgctgctggagctgtgaagccccagtgctgcgtggacatcgtcatccgccacagagatgtgcgcagctgccactatggagtcatcgacaagttccggctgcaggtgtctgagcagagccagaggaaggccctgggcaggaaggaggtggtggccaccctgctgcccagcgccaaggagcagcagaaggaggaggaggagaagaggctgaaggagcacctgacagagagcctcttctttgagcagagcttccagcctgagaacagagctgtgagcagcggccccagcctgctgaccgtcttcctgggcgtggtgtgcatcgccgccctgatgctgcccaccctgggagatgtggagagcctggtgcccctgtacctgcacctgtctgtgaaccagaagctggtggccgcctacatcctgggcctcatcaccatggccatcctgcggacctag

SEQ ID NO: 35875 - DNA, 1557 bp, Artificial Sequence
  Description of Artificial Sequence: Synthetic coding sequence
atggctgaaaatcatgcccagaacaaggccaagctgatcagcgagaccaggagaagatttgaggccgagtatgtgacagacaagagtgacaagtatgatgccagagatgtggagcggctgcagcaggatgacaactgggtggagagctacctgtcctggaggcacaacatcgtggatgagaccctgaagatgctggatgagagcttccagtggaggaaggagatctctgtgaatgacctgaatgaaagcagcatcccccgctggctgctggagattggagtcatctacctgcacggctatgacaaggagggcaacaagctgttctggatccgggtgaagtaccacgtgaaggaccagaagaccatcctggacaagaagaagctgattgccttctggctggagagatatgccaagcgggagaatggcaagcctgtgacagtgatgtttgacctgtctgagaccggcatcaacagcattgacatggactttgtgcgcttcatcatcaactgcttcaaggtgtactaccccaagtacctgagcaagatcgtcatctttgacatgccctggctgatgaatgctgccttcaagatcgtgaagacctggctgggccctgaggccgtgtccctgctgaagttcaccagcaagaatgaggtgcaggactatgtgtctgtggagtacctgcccccccacatgggcggcacagaccccttcaagtacagctacccacccctggtggatgatgacttccagacccccctgtgtgaaaatggccccatcaccagtgaagatgagaccagcagcaaagaagatattgaaagtgatggcaaggagaccctggagaccatcagcaatgaggagcagacccccctgctgaagaagatcaaccccacagagagcaccagcaaggccgaggagaatgagaaggtggacagcaaggtgaaggccttcaagaagcccctgtctgtgttcaagggccccctgctgcacatcagccctgctgaggagctgtacttcggcagcacagaaagtggagagaagaagaccctcatcgtgctgaccaacgtgaccaagaacatcgtggccttcaaggtgaggaccacagcccctgagaagtacagagtgaagcccagcaacagcagctgtgaccccggggcctctgtggacatcgtggtgagcccccacggcggcctgactgtgtctgcccaggaccgcttcctgatcatggctgctgagatggagcagagcagcggcaccggccctgctgagctgacccagttctggaaggaggtgcccaggaacaaggtgatggagcaccggctgcgctgccacacagtggagagcagcaagcccaacaccctgaccctgaaggacaatgccttcaacatgtctgacaagaccagcgaggacatctgcctgcagctgagccggctgctggagagcaacaggaagctggaggaccaggtgcagcgctgcatctggttccagcagctgctgctgagcctgaccatgctgctgctggcctttgtgaccagcttcttctacctgctgtacagctag

SEQ ID NO: 35876 - DNA, 2406 bp, Artificial Sequence
  Description of Artificial Sequence: Synthetic coding sequence
atggagcggctgtggggcctcttccagagggcccagcagctgagccccaggagcagccagacagtgtaccagagggtggagggccccaggaagggccacctggaggaggaggaggaggatggagaggagggcgctgagaccctggcccacttctgccccatggagctgcggggccctgagcccctgggcagccggccccggcagcccaacctgatcccctgggccgctgctggaagaagagctgccccctacctggtgctgacagccctgctgatcttcaccggggccttcctgctgggctacgtggccttccggggcagctgccaggcctgtggggacagcgtgctggtggtgtctgaagatgtgaactatgagccagacctggacttccaccagggccgcctgtactggagcgacctgcaggccatgttcctgcagttcctgggggagggccgcctggaggacaccatccggcagaccagcctgcgggagcgggtggccggcagcgctggcatggccgccctgacccaggacatccgggccgccctgagccggcagaagctggaccacgtgtggacagacacccactacgtgggcctgcagttcccagaccctgcccaccccaacaccctgcactgggtggatgaagctgggaaggtgggggagcagctgcccctggaggaccctgatgtgtactgcccctacagcgccatcggaaatgtgactggagagctggtgtatgcccactacggccggcctgaggacctgcaggacctgcgggcccggggcgtggaccctgtgggccgcctgctgctggtgcgggtgggcgtcatcagctttgcccagaaggtgaccaatgcccaggactttggagcccagggcgtgctgatctacccagagcctgctgacttcagccaggacccccccaagcccagcctgagcagccagcaggccgtgtatggccacgtgcacctgggcactggagacccctacaccccaggcttccccagcttcaaccagacccagttcccccctgtggccagcagcggcctgcccagcatcccagcccagcccatctctgctgacatcgccagccggctgctgaggaagctgaagggccctgtggccccccaggagtggcagggcagcctgctgggcagcccctaccacctgggccctggcccccggctgcggctggtggtgaacaaccacaggaccagcacccccatcaacaacatcttcggctgcatcgagggccgctctgagccagaccactacgtggtgattggagcccagagagatgcctggggccctggggccgccaagtctgctgtgggcacagccatcctgctggagctggtgaggaccttcagctccatggtgtccaatggcttccggccccggcgcagcctgctcttcatctcctgggatggaggagactttggatctgtgggcagcacagagtggctggagggctacctgtctgtgctgcacctgaaggctgtggtgtatgtgtccctggacaatgctgtgctgggagatgacaagttccacgccaagaccagccccctgctgaccagcctgattgaatctgtgctgaagcaggtggacagccccaaccacagcggccagaccctgtatgagcaggtggtgttcaccaaccccagctgggatgctgaggtgatccggcccctgcccatggacagcagcgcctacagcttcaccgcctttgtgggcgtgcctgctgtggagttctccttcatggaggatgaccaggcctaccccttcctgcacaccaaggaggacacctatgagaacctgcacaaggtgctgcagggccgcctgcctgctgtggcccaggccgtggcccagctggccggccagctgctgatccggctgagccatgaccggctgctgcccctggactttggccgctatggagatgtggtgctgcggcacatcggcaacctgaatgagttcagcggggacctgaaggcccggggcctgaccctgcagtgggtgtacagcgcccggggggactacatccgggctgctgagaagctgcggcaggagatctacagcagcgaggagagagatgagcggctgaccaggatgtacaacgtgcgcatcatgagggtggagttctacttcctgagccagtatgtgtccccagctgacagccccttccgccacatcttcatgggccgcggggaccacaccctgggcgccctgctggaccacctgcggctgctgcggagcaacagcagcggcacccctggggccaccagcagcacaggcttccaggagagccgcttccggcggcagctggccctgctgacctggaccctgcagggcgccgccaatgccctgtctggagatgtgtggaacatcgacaacaacttctag

SEQ ID NO: 35877 - DNA, 708 bp, Artificial Sequence
  Description of Artificial Sequence: Synthetic coding sequence
atgagaagaggagccccccaggaccaggagctggtgggccctggccccccaggccggggcagcagaggagcccccccacccctgggccctgtggtgcctgtgctggtgttccccccagacctggtgttccgggctgaccagaggagcggcccccggcagctgctgaccctgtacaaccccactggaacagccctgcgcttccgggtgctgtgcacagccccagccaagtacacagtgtttgatgctgagggctacgtgaagccccagagctgcatcgacatcgtcatccgccacgtggcccccatccccagccactatgatgtgcaggaccgcttccgcatcgagctgtctgaggagggcgctgagggccgggtggtgggcaggaaggacatcaccagcatcctgcgggccccagcctaccccctggagctgcagggccagcctgaccctgccccccggcccggccccccagctggcaccccaccacccacagcccggcacttccaggagcacccccggcagcagctggccaccagcagcttcctgctcttcctgctgactggaattgtgtctgtggccttcctgctgctgcccctgcctgatgagctgggcagccagctgccccaggtgctgcacgtgtccctgggccagaagctggtggccgcctacgtgctgggcctgctgaccatggtgttcctgcggacctag

SEQ ID NO: 35878 - DNA, 708 bp, Artificial Sequence; identical to SEQ ID NO: 35877
  Description of Artificial Sequence: Synthetic coding sequence

SEQ ID NO: 35879 - DNA, 666 bp, Artificial Sequence
  Description of Artificial Sequence: Synthetic coding sequence
atgtctgacaggcctgagcccgcctgtgcccccccacccctgggccctgtggtgcctgtgctggtgttccccccagacctggtgttccgggctgaccagaggagcggcccccggcagctgctgaccctgtacaaccccactggaacagccctgcgcttccgggtgctgtgcacagccccagccaagtacacagtgtttgatgctgagggctacgtgaagccccagagctgcatcgacatcgtcatccgccacgtggcccccatccccagccactatgatgtgcaggaccgcttccgcatcgagctgtctgaggagggcgctgagggccgggtggtgggcaggaaggacatcaccagcatcctgcgggccccagcctaccccctggagctgcagggccagcctgaccctgccccccggcccggccccccagctggcaccccaccacccacagcccggcacttccaggagcacccccggcagcagctggccaccagcagcttcctgctcttcctgctgactggaattgtgtctgtggccttcctgctgctgcccctgcctgatgagctgggcagccagctgccccaggtgctgcacgtgtccctgggccagaagctggtggccgcctacgtgctgggcctgctgaccatggtgttcctgcggacctag

SEQ ID NO: 35880 - DNA, 678 bp, Artificial Sequence
  Description of Artificial Sequence: Synthetic coding sequence
atgagaagaggagccccccaggaccaggagctggtgggccctggccccccaggccggggcagcagaggagcccccccacccctgggccctgtggtgcctgtgctggtgttccccccagacctggtgttccgggctgaccagaggagcggcccccggcagctgctgaccctgtacaaccccactggaacagccctgcgcttccgggtgctgtgcacagccccagccaagtacacagtgtttgatgctgagggctacgtgaagccccagagctgcatcgacatccactatgatgtgcaggaccgcttccgcatcgagctgtctgaggagggcgctgagggccgggtggtgggcaggaaggacatcaccagcatcctgcgggccccagcctaccccctggagctgcagggccagcctgaccctgccccccggcccggccccccagctggcaccccaccacccacagcccggcacttccaggagcacccccggcagcagctggccaccagcagcttcctgctcttcctgctgactggaattgtgtctgtggccttcctgctgctgcccctgcctgatgagctgggcagccagctgccccaggtgctgcacgtgtccctgggccagaagctggtggccgcctacgtgctgggcctgctgaccatggtgttcctgcggacctag

SEQ ID NO: 35881 - DNA, 444 bp, Artificial Sequence
  Description of Artificial Sequence: Synthetic coding sequence
atggccggctggtggccagccctgagcagagctgcccggcggcacccctggcccaccaacgtgctgctgtatggcagcctggtgtctgctggagatgccctgcagcagaggctgcagggccgggaggccaactggaggcagaccaggagagtggccaccctggtggtgaccttccacgccaacttcaactacgtgtggctgcggctgctggagcgggccctgcccggccgggccccccacgccctgctggccaagctgctgtgtgaccaggtggtgggcgcccccatcgctgtgtctgccttctacgtggagtggacagatgtgctggccctgtgcacagctgaccagctgcagccctgcagctgcagcatggagaacagcctgcgctggagcctgtggttcagcctgggccacctgcacctgttcttccctgctgagtggtag

SEQ ID NO: 35882 - DNA, 591 bp, Artificial Sequence
  Description of Artificial Sequence: Synthetic coding sequence
atggccggctggtggccagccctgagcagagctgcccggcggcacccctggcccaccaacgtgctgctgtatggcagcctggtgtctgctggagatgccctgcagcagaggctgcagggccgggaggccaactggaggcagaccaggagagtggccaccctggtggtgaccttccacgccaacttcaactacgtgtggctgcggctgctggagcgggccctgcccggccgggccccccacgccctgctggccaagctgctgtgtgaccaggtggtgggcgcccccatcgctgtgtctgccttctacgtgggcatgagcatcctgcagggcaaggatgacatcttcctggacctgaagcagaagttctggaacacctacctgagcggcctgatgtactggccctttgtgcagctgaccaacttcagcctggtgcctgtgcagtggaggacagcctatgccggcgtgtgtggcttcctgtgggccaccttcatctgcttcagccagcagagcggagatggcaccttcaagagcgccttcaccatcctgtacaccaagggcaccagcgccacagagggctaccccaagaagtag

SEQ ID NO: 35883 - DNA, 621 bp, Artificial Sequence
  Description of Artificial Sequence: Synthetic coding sequence
atggcccggggcggctggaggcggctgcggcggctgctgtctgctggccagctgctcttccagggccgggccctgctggtgaccaacaccctgggctgtggggccctgatggctgctggagatggagtgcggcagagctgggagatccgggcccggcccggccaggtgtttgacccccggcgcagcgcctccatgtttgctgtgggctgcagcatgggccccttcctgcactactggtacctgagcctggacaggctcttccctgccagcggcctgcggggcttccccaacgtgctgaagaaggtgctggtggaccagctggtggccagccccctgctgggcgtgtggtacttcctgggcctgggctgcctggagggccagacagtgggggagagctgccaggagctgcgggagaagttctgggagttctacaaggctgactggtgtgtgtggccagctgcccagtttgtgaacttcctgtttgtgcccccccagttccgggtgacctacatcaatggcctgaccctgggctgggacacctacctgagctacctgaagtaccgcagccctgtgcccctgaccccacctggctgtgtggccctggacaccagggctgactag

SEQ ID NO: 35884 - DNA, 354 bp, Artificial Sequence
  Description of Artificial Sequence: Synthetic coding sequence
atggagtgcctgcggagcctgccctgcctgctgccccgggccatgaggctgcccaggaggaccctgtgtgccctggccctggatgtgacctctgtgggcccccctgtggccgcctgtggcagaagagccaacctgattggccgcagcagagctgcccagctgtgtggccctgaccggctgcgggtggccggggaggtgcaccgcttccgcaccagtgatgtgtcccaggccaccctggcctctgtggcccctgtgttcaccgtgaccaagtttgacaagcagggcaatgtgaccagctttgtgtttgagagctgtgacaacagccgggtgtccagtgacatccggctgtcctag

SEQ ID NO: 35885 - DNA, 1227 bp, Artificial Sequence
  Description of Artificial Sequence: Synthetic coding sequence
atggagtgcctgcggagcctgccctgcctgctgccccgggccatgaggctgcccaggaggaccctgtgtgccctggccctggatgtgacctctgtgggcccccctgtggccgcctgtggcagaagagccaacctgattggccgcagcagagctgcccagctgtgtggccctgaccggctgcgggtggccggggaggtgcaccgcttccgcaccagtgatgtgtcccaggccaccctggcctctgtggcccctgtgttcaccgtgaccaagtttgacaagcagggcaatgtgaccagctttgagaggaagaagacagagctgtaccaggagctgggcctgcaggcccgggacctgcgcttccagcacgtgatgagcatcaccgtgaggaacaaccgcatcatcatgaggatggagtacctgaaggccgtcatcaccccagaatgtctgctgatcctggactacagaaacctgaacctggagcagtggctgttccgggagctgcccagccagctgagcggggagggccagctggtgacctaccccctgccctttgagttccgggccatcgaggccctgctgcagtactggatcaacaccctgcagggcaagctgagcatcctgcagcccctcatcctggagaccctggatgccctggtggaccccaagcacagctctgtggacaggagcaagctgcacatcctgctgcagaatggcaagagcctgtctgagctggagacagacatcaagatcttcaaggagagcatcctggagatcctggatgaggaggagctgctggaggagctgtgtgtgtccaagtggagcgacccccaggtgtttgagaagagcagcgctggcatcgaccatgctgaggagatggagctgctgctggagaactactaccgcctggctgatgacctgagcaatgctgcccgggagctgcgggtgctgattgatgacagccagagcatcatcttcatcaacctggacagccacagaaatgtgatgatgaggctgaacctgcagctgaccatgggcaccttcagcctgagcctgtttggcctgatgggcgtggccttcggcatgaacctggagagcagcctggaggaggaccaccgcatcttctggctgatcaccggcatcatgttcatgggcagcggcctcatctggaggcggctgctgtccttcctgggccggcagctggaggcccccctgccccccatggtgtag

SEQ ID NO: 35886 - DNA, 1332 bp, Artificial Sequence
  Description of Artificial Sequence: Synthetic coding sequence
atggagtgcctgcggagcctgccctgcctgctgccccgggccatgaggctgcccaggaggaccctgtgtgccctggccctggatgtgacctctgtgggcccccctgtggccgcctgtggcagaagagccaacctgattggccgcagcagagctgcccagctgtgtggccctgaccggctgcgggtggccggggaggtgcaccgcttccgcaccagtgatgtgtcccaggccaccctggcctctgtggcccctgtgttcaccgtgaccaagtttgacaagcagggcaatgtgaccagctttgagaggaagaagacagagctgtaccaggagctgggcctgcaggcccgggacctgcgcttccagcacgtgatgagcatcaccgtgaggaacaaccgcatcatcatgaggatggagtacctgaaggccgtcatcaccccagaatgtctgctgatcctggactacagaaacctgaacctggagcagtggctgttccgggagctgcccagccagctgagcggggagggccagctggtgacctaccccctgccctttgagttccgggccatcgaggccctgctgcagtactggatcaacaccctgcagggcaagctgagcatcctgcagcccctcatcctggagaccctggatgccctggtggaccccaagcacagctctgtggacaggagcaagctgcacatcctgctgcagaatggcaagagcctgtctgagctggagacagacatcaagatcttcaaggagagcatcctggagatcctggatgaggaggagctgctggaggagctgtgtgtgtccaagtggagcgacccccaggtgtttgagaagagcagcgctggcatcgaccatgctgaggagatggagctgctgctggagaactactaccgcctggctgatgacctgagcaatgctgcccgggagctgcgggtgctgattgatgacagccagagcatcatcttcatcaacctggacagccacagaaatgtgatgatgaggctgaacctgcagctgaccatgggcaccttcagcctgagcctgtttggcctgatgggcgtggccttcggcatgaacctggagagcagcctggaggaggaccaccgcatcttctggctgatcaccggcatcatgttcatgggcagcggcctcatctggaggcggctgctgtccttcctgggccggcagctggaggcccccctgccccccatgatggccagcctgcccaagaagaccctgctggccgaccgctccatggagctgaagaacagcctgcggctggatggcctgggcagcggccgcagcatcctgaccaacagatag

SEQ ID NO: 35887 - DNA, 1341 bp, Artificial Sequence
  Description of Artificial Sequence: Synthetic coding sequence
atggagtgcctgcggagcctgccctgcctgctgccccgggccatgaggctgcccaggaggaccctgtgtgccctggccctggatgtgacctctgtgggcccccctgtggccgcctgtggcagaagagccaacctgattggccgcagcagagctgcccagctgtgtggccctgaccggctgcgggtggccggggaggtgcaccgcttccgcaccagtgatgtgtcccaggccaccctggcctctgtggcccctgtgttcaccgtgaccaagtttgacaagcagggcaatgtgaccagctttgagaggaagaagacagagctgtaccaggagctgggcctgcaggcccgggacctgcgcttccagcacgtgatgagcatcaccgtgaggaacaaccgcatcatcatgaggatggagaagtacagcctgctgctggagagcgtggccagcatcctgcagaacagcgtgtccttcatggagcggcagacagagcagtggctgttccgggagctgcccagccagctgtctggagagggccagctggtgacctaccccctgccctttgagttccgggccatcgaggccctgctgcagtactggatcaacaccctgcagggcaagctgagcatcctgcagcccctcatcctggagaccctggatgccctggtggaccccaagcacagctctgtggacaggagcaagctgcacatcctgctgcagaatggcaagagcctgtctgagctggagacagacatcaagatcttcaaggagagcatcctggagatcctggatgaggaggagctgctggaggagctgtgtgtgtccaagtggagcgacccccaggtgtttgagaagagcagcgctggcatcgaccacgccgaggagatggagctgctgctggagaactactaccgcctggctgatgacctgagcaatgctgcccgggagctgcgggtgctgattgatgacagccagagcatcatcttcatcaacctggacagccacagaaatgtgatgatgaggctgaacctgcagctgaccatgggcaccttcagcctgagcctgtttggcctgatgggcgtggccttcggcatgaacctggagagcagcctggaggaggaccaccgcatcttctggctgatcaccggcatcatgttcatgggcagcggcctcatctggaggcggctgctgtccttcctgggccggcagctggaggcccccctgccccccatgatggccagcctgcccaagaagaccctgctggccgaccgctccatggagctgaagaacagcctgcggctggatggcctgggcagcggccgcagcatcctgaccaacagatag

SEQ ID NO: 35888 - DNA, 549 bp, Artificial Sequence
  Description of Artificial Sequence: Synthetic coding sequence
tgaagagctgcccagctgtgtggccctgaccggctgcgggtggccggggaggtgcaccgcttccgcaccagtgatgtgtcccaggccaccctggcctctgtggcccctgtgttcaccgtgaccaagtttgacaagcagggcaatgtgaccagctttgagaggaagaagacagagctgtaccaggagctggagacagacatcaagatcttcaaggagagcatcctggagatcctggatgaggaggagctgctggaggagctgtgtgtgtccaagtggagcgacccccaggtgtttgagaagagcagcgctggcatcgaccacgccgaggagatggagctgctgctggagaactactaccgcctggctgatgacctgagcaatgctgcccgggagctgcgggtgctgattgatgacagccagagcatcatcttcatcaacctggacagccacagaaatgtgatgatgaggctgaacctgcagctgaccatgggcaccttcagcctgagcctgtttggcctgatgggcgtggccttcggcatgaacctgtag

SEQ ID NO: 35889 - DNA, 1182 bp, Artificial Sequence
  Description of Artificial Sequence: Synthetic coding sequence
atggagtgcctgcggagcctgccctgcctgctgccccgggccatgaggctgcccaggaggaccctgtgtgccctggccctggatgtgacctctgtgggcccccctgtggccgcctgtggcagaagagccaacctgattggccgcagcagagctgcccagctgtgtggccctgaccggctgcgggtggccggggaggtgcaccgcttccgcaccagtgatgtgtcccaggccaccctggcctctgtggcccctgtgttcaccgtgtacctgaaggccgtcatcaccccagaatgtctgctgatcctggactacagaaacctgaacctggagcagtggctgttccgggagctgcccagccagctgagcggggagggccagctggtgacctaccccctgccctttgagttccgggccatcgaggccctgctgcagtactggatcaacaccctgcagggcaagctgagcatcctgcagcccctcatcctggagaccctggatgccctggtggaccccaagcacagctctgtggacaggagcaagctgcacatcctgctgcagaatggcaagagcctgtctgagctggagacagacatcaagatcttcaaggagagcatcctggagatcctggatgaggaggagctgctggaggagctgtgtgtgtccaagtggagcgacccccaggtgtttgagaagagcagcgctggcatcgaccatgctgaggagatggagctgctgctggagaactactaccgcctggctgatgacctgagcaatgctgcccgggagctgcgggtgctgattgatgacagccagagcatcatcttcatcaacctggacagccacagaaatgtgatgatgaggctgaacctgcagctgaccatgggcaccttcagcctgagcctgtttggcctgatgggcgtggccttcggcatgaacctggagagcagcctggaggaggaccaccgcatcttctggctgatcaccggcatcatgttcatgggcagcggcctcatctggaggcggctgctgtccttcctgggccggcagctggaggcccccctgccccccatgatggccagcctgcccaagaagaccctgctggccgaccgctccatggagctgaagaacagcctgcggctggatggcctgggcagcggccgcagcatcctgaccaacagatag

SEQ ID NO: 35890 - DNA, 459 bp, Artificial Sequence
  Description of Artificial Sequence: Synthetic coding sequence
atggagctgctgctggagaactactaccgcctggctgatgacctgagcaatgctgcccgggagctgcgggtgctgattgatgacagccagagcatcatcttcatcaacctggacagccacagaaatgtgatgatgaggctgaacctgcagctgaccatgggcaccttcagcctgagcctgtttggcctgatgggcgtggccttcggcatgaacctggagagcagcctggaggaggaccaccgcatcttctggctgatcaccggcatcatgttcatgggcagcggcctcatctggaggcggctgctgtccttcctgggccggcagctggaggcccccctgccccccatgatggccagcctgcccaagaagaccctgctggccgaccgctccatggagctgaagaacagcctgcggctggatggcctgggcagcggccgcagcatcctgaccaacagatag

SEQ ID NO: 35891 - DNA, 1254 bp, Artificial Sequence
  Description of Artificial Sequence: Synthetic coding sequence
atggccctgagcgcccagcagatcccccgctggttcaacagcgtgaagctgcggagcctcatcaatgctgcccagctgaccaagcgcttcaccaggcctgcccggaccctgctgcacggcttcagcgcccagccccagatcagcagtgacaactgcttcctgcagtggggcttcaagacctaccgcaccagcagcctgtggaacagcagccagagcaccagcagcagcagccaggagaacaacagcgcccagagcagcctgctgcccagcatgaatgagcagagccagaagacccagaacatcagcagctttgacagcgagctgttcctggaggagctggatgagctgccccccctgagccccatgcagcccatcagcgaggaggaggccatccagatcatcgctgacccccccctgcccccagccagcttcaccctgcgggactatgtggaccacagcgagaccctgcagaagctggtgctgctgggcgtggacctgagcaagattgagaagcaccctgaggccgccaacctgctgctgcggctggactttgagaaggacatcaagcagatgctgctcttcctgaaggatgtgggcatcgaggacaaccagctgggcgccttcctgaccaagaaccacgccatcttcagcgaggacctggagaacctgaagaccagggtggcctacctgcacagcaagaacttcagcaaggcagatgtggcccagatggtgaggaaggcccccttcctgctgaacttctctgtggagcggctggacaaccggctgggcttcttccagaaggagctggagctgtctgtgaagaagacccgggacctggtggtgcggctgccccggctgctgaccggcagcctggagcctgtgaaggagaacatgaaggtgtaccgcctggagctgggcttcaagcacaatgagatccagcacatgatcacccgcatccccaagatgctgacagccaacaagatgaagctgacagagacctttgattttgtgcacaacgtgatgagcatcccccaccacatcatcgtgaagttcccccaggtgttcaacaccaggctcttcaaggtgaaggagcggcacctgttcctgacctacctgggccgggcccagtatgaccctgccaagcccaactacatcagcctggacaagctggtgtccatcccagatgagatcttctgtgaggagatcgccaaggcctctgtgcaggactttgagaagttcctgaagaccctgtag

SEQ ID NO: 35892 - DNA, 1158 bp, Artificial Sequence
  Description of Artificial Sequence: Synthetic coding sequence
atgctgtggaagctgctgctgcggagccagagctgccgcctgtgcagcttcaggaagatgaggagcccccccaagtaccggcccttcctggcctgcttcacctacaccacagacaagcagagcagcaaggagaacaccaggacagtggagaagctgtacaagtgcagcgtggacatcaggaagatccggcggctgaagggctgggtgctgctggaggatgagacctacgtggaggagatcgccaacatcctgcaggagctgggcgcagatgaaacagctgtggccagcatcctggagcgctgcccagaggccatcgtgtgcagccccacagctgtgaacacccagaggaagctgtggcagctggtgtgcaagaatgaggaggagctgatcaagctgattgagcagtttcctgagagcttcttcaccatcaaggaccaggagaaccagaagctgaatgtgcagttcttccaggagctgggcctgaagaatgtggtgatcagccggctgctgacagctgccccaaatgtgttccacaaccctgtggagaagaacaagcagatggtgcgcatcctgcaggagagctacctggatgtgggcggcagcgaggccaacatgaaggtgtggctgctgaagctgctgagccagaaccccttcatcctgctgaacagccccacagccatcaaggagaccctggagttcctgcaggagcagggcttcaccagctttgagatcctgcagctgctgagcaagctgaagggcttcctgttccagctgtgccccaggagcatccagaacagcatctccttcagcaagaatgccttcaagtgcacagaccatgacctgaagcagctggtgctgaagtgcccagccctgctgtactacagcgtgcctgtgctggaggagaggatgcagggcctgctgcgggagggcatcagcatcgcccagatccgggagacccccatggtgctggagctgaccccccagatcgtgcagtaccgcatcaggaagctgaacagcagcggctaccgcatcaaggatggccacctggccaacctgaatggcagcaagaaggagtttgaggccaactttgggaagatccaggccaagaaggtgcggcccctcttcaaccctgtggcccccctgaatgtggaggagtag

SEQ ID NO: 35893 - DNA, 1158 bp, Artificial Sequence; identical to SEQ ID NO: 35892
  Description of Artificial Sequence: Synthetic coding sequence

SEQ ID NO: 35894 - DNA, 537 bp, Artificial Sequence
  Description of Artificial Sequence: Synthetic coding sequence
atgctgtggaagctgctgctgcggagccagagctgccgcctgtgcagcttcaggaagatgaggagcccccccaagtaccggcccttcctggcctgcttcacctacaccacagacaagcagagcagcaaggagaacaccaggacagtggagaagctgtacaagtgcagcgtggacatcaggaagatccggcggctgaagggctgggtgctgctggaggatgagacctacgtggaggagatcgccaacatcctgcaggagctgggcgcagatgaaacagctgtggccagcatcctggagcgctgcccagaggccatcgtgtgcagccccacagctgtgaacacccagaggaagctgtggcagctggtgtgcaagaatgaggaggagctgatcaagctgattgagcagtttcctgagagcttcttcaccatcaaggaccaggagaaccagaagctgaatgtgcagttcttccaggagctgggcctgaagaatgtggtgatcagccggctgctgacagctgccccaaatgtgttccactag

SEQ ID NO: 35895 - DNA, 102 bp, Artificial Sequence
  Description of Artificial Sequence: Synthetic coding sequence
atgctgtggaagctgctgctgcggagccagagctgccgcctgtgcagcttcaggaagatgaggagcccccccaagtaccggcccttcctggcctgcttctag

SEQ ID NO: 35896 - DNA, 261 bp, Artificial Sequence
  Description of Artificial Sequence: Synthetic coding sequence
atgctgtggaagctgctgctgcggagccagagctgccgcctgtgcagcttcaggaagatgaggagcccccccaagtaccggcccttcctggcctgcttcacctacaccacagacaagcagagcagcaaggagaacaccaggacagtggagaagctgtacaagtgcagcgtggacatcaggaagatccggcggctgaagggctgggtgctgctggaggatgagacctacgtggaggagatcgccaacatcctgcaggagtag

SEQ ID NO: 35897 - DNA, 1158 bp, Artificial Sequence; identical to SEQ ID NO: 35892
  Description of Artificial Sequence: Synthetic coding sequence

SEQ ID NO: 35898 - DNA, 1701 bp, Artificial Sequence
  Description of Artificial Sequence: Synthetic coding sequence
atgaagatgcagaagggaaatgtgctgctgatgtttggcctgctgctgcacctggaggccgccaccaacagcaatgagaccagcaccagcgccaacacaggcagcagcgtcatcagcagcggggccagcacagccaccaacagcggcagctctgtgaccagcagtggagtgtccacagccaccatcagcggcagctctgtgaccagcaatggagtgtccatcgtgaccaacagcgagttccacaccaccagcagcggcatcagcacagccaccaacagcgagttcagcacagtgagcagcggcatcagcatcgccaccaacagcgagagcagcaccaccagcagcggggccagcacagccaccaacagcgagagcagcacccccagcagcggggccagcacagccaccaacagcgacagcagcaccaccagcagcggggccagcacagccaccaacagcgacagcagcaccaccagcagcgaggccagcacagccaccaacagcgagagcagcaccaccagcagcggggccagcacagccaccaacagcgagagcagcacagtgagcagccgggccagcacagccaccaacagcgagagcagcaccaccagcagcggggccagcacagccaccaacagcgagagcaggaccaccagcaatggagctggaacagccaccaacagcgagagcagcaccaccagcagcggggccagcacagccaccaacagcgagagcagcacccccagcagcggggccggcacagccaccaacagcgagagcagcaccaccagcagtggagctggaacagccaccaacagcgagagcagcacagtgagcagcggcatcagcacagtgaccaacagcgagagcagcacccccagcagcggggccaacacagccaccaacagcgagagcagcaccaccagcagcggggccaacacagccaccaacagcgacagcagcaccaccagcagcggggccagcacagccaccaacagcgagagcagcaccaccagcagcggggccagcacagccaccaacagcgagagcagcaccaccagcagcggggccagcacagccaccaacagcggcagcagcaccaccagcagcggcaccagcacagccaccaacagcgagagcagcacagtgtcctctggggccagcacagccaccaccagcgagagcagcaccaccagcagcggggccagcacagccaccaacagcgagagcagcacagtgtcctctggggccagcacagccaccaacagcgagagcagcaccaccagcagcggggccaacacagccaccaacagcggcagctctgtgaccagcgctggcagcggcacagctgccctgaccggcatgcacaccaccagccacagcgccagcacagctgtgtctgaggccaagccaggcggcagcctggtgccctgggagatcttcctgatcaccctggtgtctgtggtggccgctgtgggcctgtttgctggcctcttcttctgtgtgaggaacagcctgagcctgaggaacaccttcaacacagctgtgtaccacccccacggcctgaaccacggcctgggccctggccctgggggcaaccacggggccccccaccggccccgctggagccccaactggttctggaggaggcctgtgagcagcatcgccatggagatgagcggcaggaacagcggcccctag

SEQ ID NO: 35899 - DNA, 1251 bp, Artificial Sequence
  Description of Artificial Sequence: Synthetic coding sequence
atgaagatgcagaagggaaatgtgctgctgatgtttggcctgctgctgcacctggaggccgccaccaacagcaatgagaccagcaccagcgccaacacaggcagcagcgtcatcagcagcggggccagcacagccaccaacagcggcagctctgtgaccagcagtggagtgtccacagccaccatcagcggcagctctgtgaccagcaatggagtgtccatcgtgaccaacagcgagttccacaccaccagcagcggcatcagcacagccaccaacagcgagttcagcacagtgagcagcggcatcagcatcgccaccaacagcgagagcagcaccaccagcagcggggccagcacagccaccaacagcgagagcagcacccccagcagcggggccagcacagccaccaacagcgacagcagcaccaccagcagcggggccagcacagccaccaacagcgacagcagcaccaccagcagcgaggccagcacagccaccaacagcgagagcagcaccaccagcagcggggccagcacagccaccaacagcgagagcagcaccaccagcagcggggccagcacagccaccaacagcgagagcagcaccaccagcagcggggccagcacagccaccaacagcggcagcagcaccaccagcagcggcaccagcacagccaccaacagcgagagcagcacagtgtcctctggggccagcacagccaccaccagcgagagcagcaccaccagcagcggggccagcacagccaccaacagcgagagcagcacagtgtcctctggggccagcacagccaccaacagcgagagcagcaccaccagcagcggggccaacacagccaccaacagcggcagctctgtgaccagcgctggcagcggcacagctgccctgaccggcatgcacaccaccagccacagcgccagcacagctgtgtctgaggccaagccaggcggcagcctggtgccctgggagatcttcctgatcaccctggtgtctgtggtggccgctgtgggcctgtttgctggcctcttcttctgtgtgaggaacagcctgagcctgaggaacaccttcaacacagctgtgtaccacccccacggcctgaaccacggcctgggccctggccctgggggcaaccacggggccccccaccggccccgctggagccccaactggttctggaggaggcctgtgagcagcatcgccatggagatgagcggcaggaacagcggcccctag

SEQ ID NO: 35900 - DNA, 483 bp, Artificial Sequence
  Description of Artificial Sequence: Synthetic coding sequence
atgaccctggaggagctggtggcctgtgacaatgctgcccagaagatgcagacagtgacagctgctgtggaggagctgctggtggccgcccagaggcaggaccggctgactgtgggcgtgtatgaaagtgccaagctgatgaatgtggaccctgattctgtggtgctgtgcctgctggccattgatgaggaggaggaggatgacatcgccctgcagatccacttcaccctcatccagagcttctgctgtgacaatgacatcaacatcgtgcgggtgtctggcatgcagaggctggcccagctgctgggggagcctgctgagacccagggcaccacagaggcccgggacctgcactgcctgctggtgaccaacccccacacagatgcctggaagagccacggcctggtggaggtggccagctactgtgaggagagccggggcaacaaccagtgggtgccctacatcagcctgcaggagaggtag

SEQ ID NO: 35901 - DNA, 888 bp, Artificial Sequence
  Description of Artificial Sequence: Synthetic coding sequence
atggactttggcctggccctgctgctggccggcctgctgggcctgctgctgggccagagcctgcaggtgaagcccctgcaggtggagcccccagagcctgtggtggccgtggccctgggcgccagccggcagctgacctgccgcctggcctgtgccgacagaggagcctctgtgcagtggaggggcctggacaccagcctgggcgctgtgcagagcgacaccggccgctctgtgctgactgtgagaaatgccagcctgtctgctgctggcaccagggtgtgtgtgggcagctgtggcggccgcaccttccagcacacagtgcagctgctggtgtatgccttcccagaccagctgactgtgtccccagctgccctggtgcctggggaccctgaggtggcctgcacagcccacaaggtgacccctgtggaccccaatgccctgtccttcagcctgctggtgggcggccaggagctggagggcgcccaggccctgggccctgaggtgcaggaggaggaggaggagccccagggagatgaagatgtgctcttccgggtgacagagcgctggaggctgccccccctgggcacccctgtgcccccagccctgtactgccaggccaccatgaggctgcccggcctggagctgagccaccggcaggccatcccagccagcaagccagctggggaccagctgcctgctgccctgtggaccagcagcgctgtgctgggcctgctgctgctggccctgcccacctaccacctgtggaagcgctgccgccacctggctgaagatgacacccaccccccagccagcctgcggctgctgccccaggtgtctgcctgggccggcctgcggggcaccggccaggtgggcatcagccccagctag

SEQ ID NO: 35902 - DNA, 603 bp, Artificial Sequence
  Description of Artificial Sequence: Synthetic coding sequence
atggactttggcctggccctgctgctggccggcctgctgggcctgctgctggccttcccagaccagctgactgtgtccccagctgccctggtgcctggggaccctgaggtggcctgcacagcccacaaggtgacccctgtggaccccaatgccctgtccttcagcctgctggtgggcggccaggagctggagggcgcccaggccctgggccctgaggtgcaggaggaggaggaggagccccagggagatgaagatgtgctcttccgggtgacagagcgctggaggctgccccccctgggcacccctgtgcccccagccctgtactgccaggccaccatgaggctgcccggcctggagctgagccaccggcaggccatcccagccagcaagccagctggggaccagctgcctgctgccctgtggaccagcagcgctgtgctgggcctgctgctgctggccctgcccacctaccacctgtggaagcgctgccgccacctggccgaggatgacacccaccccccagccagcctgcggctgctgccccaggtgtctgcctgggccggcctgcggggcaccggccaggtgggcatcagccccagctag

SEQ ID NO: 35903 - DNA, 1221 bp, Artificial Sequence
  Description of Artificial Sequence: Synthetic coding sequence
atggactttggcctggccctgctgctggccggcctgctgggcctgctgctgggccagagcctgcaggtgaagcccctgcaggtggagcccccagagcctgtggtggccgtggccctgggcgccagccggcagctgacctgccgcctggcctgtgccgacagaggagcctctgtgcagtggaggggcctggacaccagcctgggcgctgtgcagagcgacaccggccgctctgtgctgactgtgagaaatgccagcctgtctgctgctggcaccagggtgtgtgtgggcagctgtggcggccgcaccttccagcacacagtgcagctgctggtgtatgccttcccagaccagctgactgtgtccccagctgccctggtgcctggggaccctgaggtggcctgcacagcccacaaggtgacccctgtggaccccaatgccctgtccttcagcctgctggtgggcggccaggagctggagggcgcccaggccctgggccctgaggtgcaggaggaggaggaggagccccagggagatgaagatgtgctcttccgggtgacagagcgctggaggctgccccccctgggcacccctgtgcccccagccctgtactgccaggccaccatgaggctgcccggcctggagctgagccaccggcaggccatcccagccctgcacgccctgagcaaccctgaggccccagctgctgagagcccccaggcccccagcctgagcaccccagccagcagccaccccaccagccctgagcccccagacaccaccagccctgagagcccagacaccaccagccctgagagcccagacaccaccagccaggagcccccagacaccaccagccctgagcccccagacaagaccagccctgagcccgccccccagcagggcagcacccacacccccaggagccctggcagcaccaggaccaggaggcctgagatcagccaggccggccccacccagggcgaggtgatccccaccggcagcagcaagccagctggggaccagctgcctgctgccctgtggaccagcagcgctgtgctgggcctgctgctgctggccctgcccacctaccacctgtggaagcgctgccgccacctggccgaggatgacacccaccccccagccagcctgcggctgctgccccaggtgtctgcctgggccggcctgcggggcaccggccaggtgggcatcagccccagctag

SEQ ID NO: 35904 - DNA, 1197 bp, Artificial Sequence
  Description of Artificial Sequence: Synthetic coding sequence
atggactttggcctggccctgctgctggccggcctgctgggcctgctgctgggccagagcctgcaggtgaagcccctgcaggtggagcccccagagcctgtggtggccgtggccctgggcgccagccggcagctgacctgccgcctggcctgtgccgacagaggagcctctgtgcagtggaggggcctggacaccagcctgggcgctgtgcagagcgacaccggccgctctgtgctgactgtgagaaatgccagcctgtctgctgctggcaccagggtgtgtgtgggcagctgtggcggccgcaccttccagcacacagtgcagctgctggtgtatgccttcccagaccagctgactgtgtccccagctgccctggtgcctggggaccctgaggtggcctgcacagcccacaaggtgacccctgtggaccccaatgccctgtccttcagcctgctggtgggcggccaggagctggagggcgcccaggccctgggccctgaggtgcaggaggaggaggaggagccccagggagatgaagatgtgctcttccgggtgacagagcgctggaggctgccccccctgggcacccctgtgcccccagccctgtactgccaggccaccatgaggctgcccggcctggagctgagccaccggcaggccatcccagccctgcacggctggctgagccccccaccaccccagaacacaggcccccacggcccccaccccaccagccctgagcccccagacaccaccagccctgagagcccagacaccaccagccctgagagcccagacaccaccagccaggagcccccagacaccaccagccctgagcccccagacaagaccagccctgagcccgccccccagcagggcagcacccacacccccaggagccctggcagcaccaggaccaggaggcctgagatcagccaggccggccccacccagggcgaggtgatccccaccggcagcagcaagccagctggggaccagctgcctgctgccctgtggaccagcagcgctgtgctgggcctgctgctgctggccctgcccacctaccacctgtggaagcgctgccgccacctggccgaggatgacacccaccccccagccagcctgcggctgctgccccaggtgtctgcctgggccggcctgcggggcaccggccaggtgggcatcagccccagctag

SEQ ID NO: 35905 - DNA, 1173 bp, Artificial Sequence
  Description of Artificial Sequence: Synthetic coding sequence
atggactttggcctggccctgctgctggccggcctgctgggcctgctgctgggccagagcctgcaggtgaagcccctgcaggtggagcccccagagcctgtggtggccgtggccctgggcgccagccggcagctgacctgccgcctggcctgtgccgacagaggagcctctgtgcagtggaggggcctggacaccagcctgggcgctgtgcagagcgacaccggccgctctgtgctgactgtgagaaatgccagcctgtctgctgctggcaccagggtgtgtgtgggcagctgtggcggccgcaccttccagcacacagtgcagctgctggtgtatgccttcccagaccagctgactgtgtccccagctgccctggtgcctggggaccctgaggtggcctgcacagcccacaaggtgacccctgtggaccccaatgccctgtccttcagcctgctggtgggcggccaggagctggagggcgcccaggccctgggccctgaggtgcaggaggaggaggaggagccccagggagatgaagatgtgctcttccgggtgacagagcgctggaggctgccccccctgggcacccctgtgcccccagccctgtactgccaggccaccatgaggctgcccggcctggagctgagccaccggcaggccatcccagccctgcacgccctgagcaaccctgaggccccagcccccaccagccctgagcccccagacaccaccagccctgagagcccagacaccaccagccctgagagcccagacaccaccagccaggagcccccagacaccaccagccctgagcccccagacaagaccagccctgagcccgccccccagcagggcagcacccacacccccaggagccctggcagcaccaggaccaggaggcctgagatcagccaggccggccccacccagggcgaggtgatccccaccggcagcagcaagccagctggggaccagctgcctgctgccctgtggaccagcagcgctgtgctgggcctgctgctgctggccctgcccacctaccacctgtggaagcgctgccgccacctggccgaggatgacacccaccccccagccagcctgcggctgctgccccaggtgtctgcctgggccggcctgcggggcaccggccaggtgggcatcagccccagctag

SEQ ID NO: 35906 - DNA, 921 bp, Artificial Sequence
  Description of Artificial Sequence: Synthetic coding sequence
atgggcatcctggacatcgaggtgtggggcaaggacaacaagaagcatgaggagcggctgggcacctgcaaggtggacatcagcgccctgcccctgaagcaggccaactgcctggagctgcccctggacagctgcctgggcgccctgctgatgctggtgaccctgaccccctgtgccggcgtgtctgtgtctgacctgtgtgtgtgccccctggccgacctgtctgagaggaagcagatcacccagcgctactgcctgcagaacagcctgaaggatgtgaaggatgtgggcatcctgcaggtgaaggtgctgaaggctgctgacctgctggccgctgacttcagcggcaagagtgaccccttctgcctgctggagctgggcaatgaccggctgcagacccacacagtgtacaagaacctgaaccctgagtggaacaaggtgttcaccttccccatcaaggacatccatgatgtgctggaggtgacagtgtttgatgaagatggagacaagcccccagacttcctgggcaaggtggccatccccctgctgagcatcagagatggccagcccaactgctacgtgctgaagaacaaggacctggagcaggccttcaagggcgtcatctacctggagatggacctgatctacaaccctgtgaaggccagcatccgcaccttcaccccccgggagaagagatttgtggaggacagcaggaagctgagcaagaagatcctgagcagagatgtggacagagtgaagaggatcaccatggccatctggaacaccatgcagttcctgaagagctgcttccagtgggagagcaccctgcggagcaccatcgcctttgcccacaggaaggaggagccccccctgtccatgaagtgcaccctcttcagcggggacatcggccccagcctgtag

SEQ ID NO: 35907 - DNA, 2337 bp, Artificial Sequence
  Description of Artificial Sequence: Synthetic coding sequence
atgctggacagctgcaagctgaagagcgcctgcaacctgcccttcatctgcaacaagaagatcatcaacacagctggcaccagcaatgctgaggtgcccctggccgaccccggcatgtaccagctggacatcaccctgcggcggggccagagcctggccgcccgggaccggggcggcaccagtgacccctacgtgaagttcaagattggaggcaaggaggtgttccgcagcaagatcatccacaagaacctgaaccctgtgtgggaggagaaggcctgcatcctggtggaccacctgcgggagcccctgtacatcaaggtgtttgattatgactttggcctgcaggatgacttcatgggcagcgccttcctggacctgacccagctggagctgaaccggcccacagatgtgaccctgaccctgaaggacccccactacccagaccatgacctgggcatcatcctgctgagcgtcatcctgacccccaaggagggggagagcagagatgtgaccatgctgatgaggaagtcctggaagaggagcagcaaggagctgtctgaaaatgaggtggtgggcagctacttctctgtgaagagcctcttctggaggacctgtggccggcctgccctgcctgtgctgggcttctgcagagctgagctgcagaacccctactgcaagaatgtgcagttccagacccagagcctgcggctgagtgacctgcacaggaagagccacctgtggaggggcatcgtgtccatcaccctcatcgagggccgggacctgaaggccatggacagcaatggcctgagtgacccctacgtgaagttccggctgggccaccagaagtacaagagcaagatcatgcccaagaccctgaacccccagtggagggagcagtttgacttccacctgtatgaggagcggggcggcgtcatcgacatcacagcctgggacaaggatgctgggaagagagatgacttcatcggccgctgccaggtggacctgagcgccctgagccgggagcagacccacaagctggagctgcagctggaggagggggagggccacctggtgctgctggtgaccctgacagccagcgccaccgtgtccatcagtgacctgtctgtgaacagcctggaggaccagaaggagcgggaggagatcctgaagcgctacagccccctgcgcatcttccacaacctgaaggatgtgggcttcctgcaggtgaaggtgatccgggcagagggcctgatggccgcagatgtgacaggcaagagtgaccccttctgtgtggtggagctgaacaatgaccggctgctgacccacacagtgtacaagaacctgaaccctgagtggaacaaggtgttcaccttcaacatcaaggacatccacagcgtgctggaggtgacagtgtatgatgaggaccgggacagatctgctgacttcctgggcaaggtggccatccccctgctgagcatccagaatggagagcagaaggcctacgtgctgaagaacaagcagctgaccggccccaccaagggcgtcatctacctggagattgatgtgatcttcaatgctgtgaaggccagcctgcggaccctcatccccaaggagcagaagtacatcgaggaggagaaccggctgagcaagcagctgctgctgaggaacttcatccgcatgaagagatgtgtgatggtgctggtgaatgctgcctactacgtgaacagctgctttgactgggacagccccccaagaagcctggccgcctttgtgctcttcctgtttgtggtgtggaactttgagctgtacatgatccccctggtgctgctgctgctgctgacctggaactacttcctgatcatcagcggcaaggacaaccggcagagggacacagtggtggaggacatgctggaggatgaggaggaggaggatgacaaggatgacaaggacagcgagaagaagggcttcatcaacaagatctatgccatccaggaggtgtgtgtgtctgtgcagaacatcctggatgaggtggccagctttggagagcgcatcaagaacaccttcaactggacagtgcccttcctgtcctggctggccatcgtggccctgtgtgtgttcaccgccatcctgtactgcatccccctgcgctacatcgtgctggtgtggggcatcaacaagttcaccaagaagctgcggagcccctatgccatcgacaacaatgagctgctggacttcctgagccgggtgcccagtgatgtgcaggtggtgcagtaccaggagctgaagccagaccccagccacagcccctacaagaggaagaagaacaacctgggctag

SEQ ID NO: 35908 - DNA, 738 bp, Artificial Sequence
  Description of Artificial Sequence: Synthetic coding sequence
atgtaccagctggacatcaccctgcggcggggccagagcctggccgcccgggaccggggcggcaccagtgacccctacgtgaagttcaagattggaggcaaggaggtgttccgcagcaagatcatccacaagaacctgaaccctgtgtgggaggagaaggcctgcatcctggtggaccacctgcgggagcccctgtacatcaaggtgtttgattatgactttggcctgcaggatgacttcatgggcagcgccttcctggacctgacccagctggagctgaaccggcccacagatgtgaccctgaccctgaaggacccccactacccagaccatgacctgggcatcatcctgctgagcgtcatcctgacccccaaggagggggagagcagagatgtgaccatgctgatgaggaagtcctggaagaggagcagcaagttccagacccagagcctgcggctgagtgacctgcacaggaagagccacctgtggaggggcatcgtgtccatcaccctcatcgagggccgggacctgaaggccatggacagcaatggcctgagtgacccctacgtgaagttccggctgggccaccagaagtacaagagcaagatcatgcccaagaccctgaacccccagtggagggagcagtttgacttccacctgtatgaggagcgctgtggcatcagccctggagagagccaccagagcggccgggtgaatggctgccgccgccactggtag

SEQ ID NO: 35909 - DNA, 2079 bp, Artificial Sequence
  Description of Artificial Sequence: Synthetic coding sequence
atgctggacagctgcaagctgaagagcgcctgcaacctgcccttcatctgcaacaagaagatcatcaacacagctggcaccagcaatgctgaggtgcccctggccgaccccggcatgtaccagctggacatcaccctgcggcggggccagagcctggccgcccgggaccggggcggcaccagtgacccctacgtgaagttcaagattggaggcaaggaggtgttccgcagcaagatcatccacaagaacctgaaccctgtgtgggaggagaaggcctgcatcctggtggaccacctgcgggagcccctgtacatcaaggtgtttgattatgactttggcctgcaggatgacttcatgggcagcgccttcctggacctgacccagctggagctgaaccggcccacagatgtgaccctgaccctgaaggacccccactacccagaccatgacctgggcatcatcctgctgagcgtcatcctgacccccaaggagggggagagcagagatgtgaccatgctgatgaggaagtcctggaagaggagcagcaagttccagacccagagcctgcggctgagtgacctgcacaggaagagccacctgtggaggggcatcgtgtccatcaccctcatcgagggccgggacctgaaggccatggacagcaatggcctgagtgacccctacgtgaagttccggctgggccaccagaagtacaagagcaagatcatgcccaagaccctgaacccccagtggagggagcagtttgacttccacctgtatgaggagcggggcggcgtcatcgacatcacagcctgggacaaggatgctgggaagagagatgacttcatcggccgctgccaggtggacctgagcgccctgagccgggagcagacccacaagctggagctgcagctggaggagggggagggccacctggtgctgctggtgaccctgacagccagcgccaccgtgtccatcagtgacctgtctgtgaacagcctggaggaccagaaggagcgggaggagatcctgaagcgctacagccccctgcgcatcttccacaacctgaaggatgtgggcttcctgcaggtgaaggtgatccgggcagagggcctgatggccgcagatgtgacaggcaagagtgaccccttctgtgtggtggagctgaacaatgaccggctgctgacccacacagtgtacaagaacctgaaccctgagtggaacaaggtgttcaccttcaacatcaaggacatccacagcgtgctggaggtgacagtgtatgatgaggaccgggacagatctgctgacttcctgggcaaggtggccatccccctgctgagcatccagaatggagagcagaaggcctacgtgctgaagaacaagcagctgaccggccccaccaagggcgtcatctacctggagattgatgtgatcttcaatgctgtgaaggccagcctgcggaccctcatccccaaggagcagaagtacatcgaggaggagaaccggctgagcaagcagctgctgctgaggaacttcatccgcatgaagagatgtgtgatggtgctggtgaatgctgcctactacgtgaacagctgctttgactgggacagccccccaagaagcctggccgcctttgtggtggtggaggacatgctggaggatgaggaggaggaggatgacaaggatgacaaggacagcgagaagaagggcttcatcaacaagatctatgccatccaggaggtgtgtgtgtctgtgcagaacatcctggatgaggtggccagctttggagagcgcatcaagaacaccttcaactggacagtgcccttcctgtcctggctggccatcgtggccctgtgtgtgttcaccgccatcctgtactgcatccccctgcgctacatcgtgctggtgtggggcatcaacaagttcaccaagaagctgcggagcccctatgccatcgacaacaatgagctgctggacttcctgagccgggtgcccagtgatgtgcaggtggtgcagtaccaggagctgaagccagaccccagccacagcccctacaagaggaagaagaacaacctgggctag

SEQ ID NO: 35910 - DNA, 1548 bp, Artificial Sequence
  Description of Artificial Sequence: Synthetic coding sequence
atggacagcaatggcctgagtgacccctacgtgaagttccggctgggccaccagaagtacaagagcaagatcatgcccaagaccctgaacccccagtggagggagcagtttgacttccacctgtatgaggagcggggcggcgtgattgacatcacagcctgggacaaggatgctgggaagagagatgacttcatcggccgctgccaggtggacctgagcgccctgagccgggagcagacccacaagctggagctgcagctggaggagggggagggccacctggtgctgctggtgaccctgacagccagcgccaccgtgtccatcagtgacctgtctgtgaacagcctggaggaccagaaggagcgggaggagatcctgaagcgctacagccccctgcgcatcttccacaacctgaaggatgtgggcttcctgcaggtgaaggtgatccgggcagagggcctgatggctgctgatgtgacaggcaagagtgaccccttctgtgtggtggagctgaacaatgaccggctgctgacccacacagtgtacaagaacctgaaccctgagtggaacaaggtgttcaccttcaacatcaaggacatccacagcgtgctggaggtgacagtgtatgatgaagatcgggacagatctgctgacttcctgggcaaggtggccatccccctgctgagcatccagaatggagagcagaaggcctacgtgctgaagaacaagcagctgaccggccccaccaagggcgtcatctacctggagattgatgtgatcttcaatgctgtgaaggccagcctgcggaccctcatccccaaggagcagaagtacatcgaggaggagaaccggctgagcaagcagctgctgctgaggaacttcatccgcatgaagagatgtgtgatggtgctggtgaatgctgcctactacgtgaacagctgctttgactgggacagcccccccaggagcctggccgcctttgtgctcttcctgtttgtggtgtggaactttgagctgtacatgatccccctggtgctgctgctgctgctgacctggaactacttcctgatcatcagcggcaaggacaaccggcagagggacacagtggtggaggacatgctggaggatgaggaggaggaggatgacaaggatgacaaggacagcgagaagaagggcttcatcaacaagatctatgccatccaggaggtgtgtgtgtctgtgcagaacatcctggatgaggtggccagctttggagagcgcatcaagaacaccttcaactggacagtgcccttcctgtcctggctggccatcgtggccctgtgtgtgttcaccgccatcctgtactgcatccccctgcgctacatcgtgctggtgtggggcatcaacaagttcaccaagaagctgcggagcccctatgccatcgacaacaatgagctgctggacttcctgagccgggtgcccagtgatgtgcaggtggtgcagtaccaggagctgaagccagaccccagccacagcccctacaagaggaagaagaacaacctgggctag

SEQ ID NO: 35911 - DNA, 1803 bp, Artificial Sequence
  Description of Artificial Sequence: Synthetic coding sequence
atgctggacagctgcaagctgaagagcgcctgcaacctgcccttcatctgcaacaagaagatcatcaacacagctggcaccagcaatgctgaggtgcccctggccgaccccggcatgtaccagctggacatcaccctgcggcggggccagagcctggccgcccgggaccggggcggcaccagtgacccctacgtgaagttcaagattggaggcaaggaggtgttccgcagcaagatcatccacaagaacctgaaccctgtgtgggaggagaaggcctgcatcctggtggaccacctgcgggagcccctgtacatcaaggtgtttgattatgactttggcctgcaggatgacttcatgggcagcgccttcctggacctgacccagctggagctgaaccggcccacagatgtgaccctgaccctgaaggacccccactacccagaccatgacctgggcatcatcctgctgagcgtcatcctgacccccaaggagggggagagcagagatgtgaccatgctgatgaggaagtcctggaagaggagcagcaaggagctgtctgaaaatgaggtggtgggcagctacttctctgtgaagagcctcttctggaggacctgtggccggcctgccctgcctgtgctgggcttctgcagagctgagctgcagaacccctactgcaagaatgtgcagttccagacccagagcctgcggctgagtgacctgcacaggaagagccacctgtggaggggcatcgtgtccatcaccctcatcgagggccgggacctgaaggccatggacagcaatggcctgagtgacccctacgtgaagttccggctgggccaccagaagtacaagagcaagatcatgcccaagaccctgaacccccagtggagggagcagtttgacttccacctgtatgaggagcggggcggcgtcatcgacatcacagcctgggacaaggatgctgggaagagagatgacttcatcggccgctgccaggtggacctgagcgccctgagccgggagcagacccacaagctggagctgcagctggaggagggggagggccacctggtgctgctggtgaccctgacagccagcgccaccgtgtccatcagtgacctgtctgtgaacagcctggaggaccagaaggagcgggaggagatcctgaagcgctacagccccctgcgcatcttccacaacctgaaggatgtgggcttcctgcaggtgaaggtgatccgggcagagggcctgatggccgcagatgtgacaggcaagagtgaccccttctgtgtggtggagctgaacaatgaccggctgctgacccacacagtgtacaagaacctgaaccctgagtggaacaaggtgttcaccttcaacatcaaggacatccacagcgtgctggaggtgacagtgtatgatgaggaccgggacagatctgctgacttcctgggcaaggtggccatccccctgctgagcatccagaatggagagcagaaggcctacgtgctgaagaacaagcagctgaccggccccaccaagggcgtcatctacctggagattgatgtgatcttcaatgctgtgaaggccagcctgcggaccctcatccccaaggagcagaagtacatcgaggaggagaaccggctgagcaagcagctgctgctgaggaacttcatccgcatgaagagatgtgtgatggtgctggtgaatgctgcctactacgtgaacagctgctttgactgggacagccccccaagaagcctggccgcctttgtggccctgtatggcaccttcatcaacgtgtag

SEQ ID NO: 35912 - DNA, 246 bp, Artificial Sequence
  Description of Artificial Sequence: Synthetic coding sequence
atgctggacagctgcaagctgaagagcgcctgcaacctgcccttcatctgcaacaagaagatcatcaacacagctggcaccagcaatgctgaggtgcccctggccgaccccggcatgtaccagctggacatcaccctgcggcggggccagagcctggccgcccgggaccggggcggcaccagtgacccctacgtgaagttcaagattggaggcaaggaggtgttccgcagcaagatcatccactag

SEQ ID NO: 35913 - DNA, 3000 bp, Artificial Sequence
  Description of Artificial Sequence: Synthetic coding sequence
atggagcccagggctgctgctgctggggagcctgagcccccagctgccagcagcagcttccaggcccggctgtggaagaacctgcagctgggcgtgggccgcagcaagggcggcggcggcggccgggccggcggccctgagaggagaacagctgacacccccagccccagccccccacctcctgtgggcactggaaatgccccagcccggggcagcggggccggcagccgctggagcggcttcaagaagaggaagcaggtgctggacagagtcttcagcagcagccagcccaacctgtgctgcagcagccctgagcccctggagcctggaggagctggccgggcagagcagggcagcaccctgcggcggcgcatccgggagcacctgctgcctgctgtgaagggccctgctgctgccagcggggctgctgggggcaccccacctgggggccgcagcccagattctgcccccagcagcagcagcgccagcagcagcctgagcagcagcccccagcccccacccaggggggaccgggccagagatgaaggagcccggcggcagggccctggggcccacctgtgccaccagaagagcagcagcctgcccggcacagcctgcctggagcagctgctggagcccccacctcctcctgctgagcccgcccggagccctgctgagagccgggcccctgagaccggggaggagcacggcagcagccagaagatcatcaacacagctggcaccagcaatgctgaggtgcccctggccgaccccggcatgtaccagctggacatcaccctgcggcggggccagagcctggccgcccgggacagaggaggcaccagtgacccctacgtgaagttcaagattggaggcaaggaggtgttccgcagcaagatcatccacaagaacctgaaccctgtgtgggaggagaaggcctgcatcctggtggaccacctgcgggagcccctgtacatcaaggtgtttgattatgactttggcctgcaggatgacttcatgggcagcgccttcctggacctgacccagctggagctgaaccggcccacagatgtgaccctgaccctgaaggacccccactacccagaccatgacctgggcatcatcctgctgagcgtcatcctgacccccaaggagggggagagcagagatgtgaccatgctgatgaggaagtcctggaagaggagcagcaaggagctgtctgaaaatgaggtggtgggcagctacttctctgtgaagagcctcttctggaggacctgtggccgcccagccctgcctgtgctgggcttctgcagagctgagctgcagaacccctactgcaagaatgtgcagttccagacccagagcctgcggctgagtgacctgcacaggaagagccacctgtggaggggcatcgtgtccatcaccctgattgagggccgggacctgaaggccatggacagcaatggcctgagtgacccctacgtgaagttccggctgggccaccagaagtacaagagcaagatcatgcccaagaccctgaacccccagtggagggagcagtttgacttccacctgtatgaggagcggggcggcgtgattgacatcacagcctgggacaaggatgctgggaagagagatgacttcatcggccgctgccaggtggacctgagcgccctgagccgggagcagacccacaagctggagctgcagctggaggagggggagggccacctggtgctgctggtgaccctgacagccagcgccaccgtgtccatcagtgacctgtctgtgaacagcctggaggaccagaaggagcgggaggagatcctgaagcgctacagccccctgcgcatcttccacaacctgaaggatgtgggcttcctgcaggtgaaggtgatccgggcagagggcctgatggctgctgatgtgacaggcaagagtgaccccttctgtgtggtggagctgaacaatgaccggctgctgacccacacagtgtacaagaacctgaaccctgagtggaacaaggtgttcaccttcaacatcaaggacatccacagcgtgctggaggtgacagtgtatgatgaagatcgggacagatctgctgacttcctgggcaaggtggccatccccctgctgagcatccagaatggagagcagaaggcctacgtgctgaagaacaagcagctgaccggccccaccaagggcgtcatctacctggagattgatgtgatcttcaatgctgtgaaggccagcctgcggaccctcatccccaaggagcagaagtacatcgaggaggagaaccggctgagcaagcagctgctgctgaggaacttcatccgcatgaagagatgtgtgatggtgctggtgaatgctgcctactacgtgaacagctgctttgactgggacagcccccccaggagcctggccgcctttgtgctcttcctgtttgtggtgtggaactttgagctgtacatgatccccctggtgctgctgctgctgctgacctggaactacttcctgatcatcagcggcaaggacaaccggcagagggacacagtggtggaggacatgctggaggatgaggaggaggaggatgacaaggatgacaaggacagcgagaagaagggcttcatcaacaagatctatgccatccaggaggtgtgtgtgtctgtgcagaacatcctggatgaggtggccagctttggagagcgcatcaagaacaccttcaactggacagtgcccttcctgtcctggctggccatcgtggccctgtgtgtgttcaccgccatcctgtactgcatccccctgcgctacatcgtgctggtgtggggcatcaacaagttcaccaagaagctgcggagcccctatgccatcgacaacaatgagctgctggacttcctgagccgggtgcccagtgatgtgcaggtggtgcagtaccaggagctgaagccagaccccagccacagcccctacaagaggaagaagaacaacctgggctag

SEQ ID NO: 35914 - DNA, 921 bp, Artificial Sequence; identical to SEQ ID NO: 35906
  Description of Artificial Sequence: Synthetic coding sequence

SEQ ID NO: 35915 - DNA, 2637 bp, Artificial Sequence
  Description of Artificial Sequence: Synthetic coding sequence
atggacctggacaagcccagcgtgtggggcagcctgaagcagaggacccggcccctgctgatcaacctgagcaagaagaaggtgaagaagaaccccagcaagcccccagacctgcgggcccggcaccacctggaccggcggctgagcctgtctgtgcctgacctgctggaggccgaggccctggcccctgagggccggccctacagcggcccccagagcagctacacctctgtgcccagcagcctgagcacagctggcatcttccccaagagcagcagcagcagcctgaagcagagcgaggaggagctggactggagccaggaggaggccagccacctgcacgtggtggagacagacagcgaggaggcctatgccagccctgctgagaggagaagagtgagcagcaatggcatctttgacctgcagaagaccagcctgggcggagatgcccctgaggagcctgagaagctgtgtggcagcagtgacctgaatgcctccatgaccagccagcactttgaggagcagagcgtgcctggagaggccagtgatggcctgagcaacctgcccagcccctttgcctacctgctgaccatccacctgaaggagggcaggaacctggtggtgcgggacagatgtggcaccagtgacccctacgtgaagttcaagctgaatggcaagaccctgtacaagagcaaggtgatctacaagaacctgaaccctgtgtgggatgaaattgtggtgctgcccatccagagcctggaccagaagctgcgggtgaaggtgtatgaccgggacctgaccaccagtgacttcatgggcagcgccttcgtcatcctgagtgacctggagctgaacagaaccacagagcacatcctgaagctggaggaccccaacagcctggaggatgacatgggcgtgattgtgctgaacctgaacctggtggtgaagcagggcgacttcaagaggcaccgctggagcaacaggaagaggctgagcgccagcaagagcagcctcatccggaacctgcggctgtctgagagcctgaagaagaaccagctgtggaatggcatcatcagcatcaccctgctggagggcaagaatgtgtctgggggctccatgacagagatgtttgtgcagctgaagctgggggaccagcgctacaagagcaagaccctgtgcaagagcgccaacccccagtggcaggagcagtttgacttccactacttcagtgacaggatgggcatcctggacatcgaggtgtggggcaaggacaacaagaagcatgaggagcggctgggcacctgcaaggtggacatcagcgccctgcccctgaagcaggccaactgcctggagctgcccctggacagctgcctgggcgccctgctgatgctggtgaccctgaccccctgtgccggcgtgtctgtgtctgacctgtgtgtgtgccccctggccgacctgtctgagaggaagcagatcacccagcgctactgcctgcagaacagcctgaaggatgtgaaggatgtgggcatcctgcaggtgaaggtgctgaaggctgctgacctgctggccgctgacttcagcggcaagagtgaccccttctgcctgctggagctgggcaatgaccggctgcagacccacacagtgtacaagaacctgaaccctgagtggaacaaggtgttcaccttccccatcaaggacatccatgatgtgctggaggtgacagtgtttgatgaagatggagacaagcccccagacttcctgggcaaggtggccatccccctgctgagcatcagagatggccagcccaactgctacgtgctgaagaacaaggacctggagcaggccttcaagggcgtcatctacctggagatggacctgatctacaaccctgtgaaggccagcatccgcaccttcaccccccgggagaagagatttgtggaggacagcaggaagctgagcaagaagatcctgagcagagatgtggacagagtgaagaggatcaccatggccatctggaacaccatgcagttcctgaagagctgcttccagtgggagagcaccctgcggagcaccatcgcctttgctgtgttcctgatcaccgtgtggaactttgagctgtacatgatccccctggccctgctgctgatctttgtgtacaacttcatccggcctgtgaagggcaaggtgagcagcatccaggacagccaggagagcacagacattgatgatgaagaagatgaagatgacaaggagagcgagaagaagggcctcatcgagcgcatctacatggtgcaggacatcgtgtccacagtgcagaatgtgctggaggagatcgccagctttggagagcgcatcaagaacaccttcaactggacagtgcccttcctgagcagcctggcctgcctgatcctggccgccgccaccatcatcctgtacttcatccccctgcgctacatcatcctgatctggggcatcaacaagttcaccaagaagctgaggaacccctacagcattgacaacaatgagctgctggacttcctgagccgggtgcccagtgatgtgcagaaggtgcagtatgcagagctgaagctgtgcagcagccacagccccctgaggaagaagaggtctgccctgtag

SEQ ID NO: 35916 - DNA, 2472 bp, Artificial Sequence
  Description of Artificial Sequence: Synthetic coding sequence
atggacctggacaagcccagcgtgtggggcagcctgaagcagaggacccggcccctgctgatcaacctgagcaagaagaaggtgaagaagaaccccagcaagcccccagacctgcgggcccggcaccacctggaccggcggctgagcctgtctgtgcctgacctgctggaggccgaggccctggcccctgagggccggccctacagcggcccccagagcagctacacctctgtgcccagcagcctgagcacagctggcatcttccccaagagcagcagcagcagcctgaagcagagcgaggaggagctggactggagccaggaggaggccagccacctgcacgtggtggagacagacagcgaggaggcctatgccagccctgctgagaggagaagagtgagcagcaatggcatctttgacctgcagaagaccagcctgggcggagatgcccctgaggagcctgagaagctgtgtggcagcagtgacctgaatgcctccatgaccagccagcactttgaggagcagagcgtgcctggagaggccagtgatggcctgagcaacctgcccagcccctttgcctacctgctgaccatccacctgaaggagggcaggaacctggtggtgcgggacagatgtggcaccagtgacccctacgtgaagttcaagctgaatggcaagaccctgtacaagagcaaggtgatctacaagaacctgaaccctgtgtgggatgaaattgtggtgctgcccatccagagcctggaccagaagctgcgggtgaaggtgtatgaccgggacctgaccaccagtgacttcatgggcagcgccttcgtcatcctgagtgacctggagctgaacagaaccacagagcacatcctgaagctggaggaccccaacagcctggaggatgacatgggcgtgattgtgctgaacctgaacctggtggtgaagcagggcgacttcaagaggcaccgctggagcaacaggaagaggctgagcgccagcaagagcagcctcatccggaacctgcggctgtctgagagcctgaagaagaaccagctgtggaatggcatcatcagcatcaccctgctggagggcaagaatgtgtctgggggctccatgacagagatgtttgtgcagctgaagctgggggaccagcgctacaagagcaagaccctgtgcaagagcgccaacccccagtggcaggagcagtttgacttccactacttcagtgacaggatgggcatcctggacatcgaggtgtggggcaaggacaacaagaagcatgaggagcggctgggcacctgcaaggtggacatcagcgccctgcccctgaagcaggccaactgcctggagctgcccctggacagctgcctgggcgccctgctgatgctggtgaccctgaccccctgtgccggcgtgtctgtgtctgacctgtgtgtgtgccccctggccgacctgtctgagaggaagcagatcacccagcgctactgcctgcagaacagcctgaaggatgtgaaggatgtgggcatcctgcaggtgaaggtgctgaaggctgctgacctgctggccgctgacttcagcggcaagagtgaccccttctgcctgctggagctgggcaatgaccggctgcagacccacacagtgtacaagaacctgaaccctgagtggaacaaggtgttcaccttccccatcaaggacatccatgatgtgctggaggtgacagtgtttgatgaagatggagacaagcccccagacttcctgggcaaggtggccatccccctgctgagcatcagagatggccagcccaactgctacgtgctgaagaacaaggacctggagcaggccttcaagggcgtcatctacctggagatggacctgatctacaaccctgtgaaggccagcatccgcaccttcaccccccgggagaagagatttgtggaggacagcaggaagctgagcaagaagatcctgagcagagatgtggacagagtgaagaggatcaccatggccatctggaacaccatgcagttcctgaagagctgcttccagtgggagagcaccctgcggagcaccatcgcctttgctgagagcgagaagaagggcctgattgagcgcatctacatggtgcaggacatcgtgtccacagtgcagaatgtgctggaggagatcgccagctttggagagcgcatcaagaacaccttcaactggacagtgcccttcctgagcagcctggcctgcctgatcctggccgccgccaccatcatcctgtacttcatccccctgcgctacatcatcctgatctggggcatcaacaagttcaccaagaagctgaggaacccctacagcattgacaacaatgagctgctggacttcctgagccgggtgcccagtgatgtgcagaaggtgcagtatgcagagctgaagctgtgcagcagccacagccccctgaggaagaagaggtctgccctgtag

SEQ ID NO: 35917 - DNA, 1191 bp, Artificial Sequence
  Description of Artificial Sequence: Synthetic coding sequence
atggacctggacaagcccagcgtgtggggcagcctgaagcagaggacccggcccctgctgatcaacctgagcaagaagaaggtgaagaagaaccccagcaagcccccagacctgcgggcccggcaccacctggaccggcggctgagcctgtctgtgcctgacctgctggaggccgaggccctggcccctgagggccggccctacagcggcccccagagcagctacacctctgtgcccagcagcctgagcacagctggcatcttccccaagagcagcagcagcagcctgaagcagagcgaggaggagctggactggagccaggaggaggccagccacctgcacgtggtggagacagacagcgaggaggcctatgccagccctgctgagaggagaagagtgagcagcaatggcatctttgacctgcagaagaccagcctgggcggagatgcccctgaggagcctgagaagctgtgtggcagcagtgacctgaatgcctccatgaccagccagcactttgaggagcagagcgtgcctggagaggccagtgatggcctgagcaacctgcccagcccctttgcctacctgctgaccatccacctgaaggagggcaggaacctggtggtgcgggacagatgtggcaccagtgacccctacgtgaagttcaagctgaatggcaagaccctgtacaagagcaaggtgatctacaagaacctgaaccctgtgtgggatgaaattgtggtgctgcccatccagagcctggaccagaagctgcgggtgaaggtgtatgaccgggacctgaccaccagtgacttcatgggcagcgccttcgtcatcctgagtgacctggagctgaacagaaccacagagcacatcctgaagctggaggaccccaacagcctggaggatgacatgggcgtgattgtgctgaacctgaacctggtggtgaagcagggcgacttcaagaggcaccgctggagcaacaggaagaggctgagcgccagcaagagcagcctcatccggaacctgcggctgtctgagagcctgaagaagaaccagctgtggaatggcatcatcagcatcaccctgctggagggcaagaatgtgtctgggggctccatgacagagatgtttgtgcagctgaagctgggggaccagcgctacaagagcaaggatggccacttcggccactag

SEQ ID NO: 35918 - DNA, 2661 bp, Artificial Sequence
  Description of Artificial Sequence: Synthetic coding sequence
atgggcatggacctgacctgccccttcggcatcagccctgcctgtggggcccaggcctcctggagcatctttggagcagatgctgctgaggtgcccggcacccggggccacagccagcaggaggccgccatgccccacatcccagaagatgaggagcccccaggagagccccaggccgcccagagccctgctggccagcagggccccccagctgctggggtgtcctgcagccccacccccaccatcgtgctgactggagatgccaccagccctgagggggagacagacaagaacctggccaacagagtgcacagcccccacaagaggctgagccaccgccacctgaaggtgtccacagccagcctgacctctgtggaccctgctggccacatcatcgacctggtgaatgaccagctgcctgacatcagcatcagcgaggaggacaagaagaagaacctggccctgctggaggaggccaagctggtgtctgagcgcttcctgacccggcggggcaggaagagccgcagcagccctggggacagccccagcgctgtgagccccaacctgagccccagcgccagccccaccagcagccgcagcaacagcctgactgtgcccaccccaccagaaggagatgaagcagatgtgagcagcccccaccctggagagcccaacgtgcccaagggcctggccgacaggaagcagaatgaccagaggaaggtgtcccagggccgcctggccccccggcccccacctgtggagaagagcaaggagatcgccatcgagcagaaggaaaattttgaccccctgcagtacccagagaccacccccaagggcctggcccctgtgaccaacagcagcggcaagatggccctgaacagcccccagcccggccctgtggagagcgagctgggcaagcagctgctgaagacaggctgggagggcagccccctgcccaggagccccacccaggatgctgctggggtgggccccccagccagccagggccggggccctgctggggagcccatgggccctgaggccggcagcaaggccgagctgcccccaacagtgtccaggcctcccctgctgcggggcctgtcctgggacagcggccctgaggagcccggcccccggctgcagaaggtgctggccaagctgcccctggccgaggaggagaagagatttgctgggaaggccggcggcaagctggccaaggcccctggcctgaaggacttccagatccaggtgcagcctgtgaggatgcagaagctgaccaagctgcgggaggagcacatcctgatgaggaaccagaacctggtgggcctgaagctgcctgacctgtctgaggccgctgagcaggagaagggcctgcccagcgagctgagccctgccatcgaggaggaggagagcaagagcggcctggatgtgatgcccaacatcagtgatgtgctgctgaggaagctgcgggtgcacaggagcctgcccggcagcgccccacccctgacagagaaggaggtggagaatgtgtttgtgcagctgagcctggccttcagaaatgacagctacaccctggagagccgcatcaaccaggccgagcgggagaggaacctgacagaagaaaatacagagaaggagctggagaacttcaaggccagcatcaccagcagcgccagcctgtggcaccactgtgagcaccgggagacctaccagaagctgctggaggacattgctgtgctgcaccggctggccgcccggctgagcagcagagctgaggtggtgggcgctgtgcggcaggagaagaggatgagcaaggccacagaggtgatgatgcagtatgtggagaacctgaagaggacctatgagaaggaccacgccgagctgatggagttcaagaagctggccaaccagaacagcagccgcagctgtggccccagtgaagatggagtgcccaggacagcccgctccatgagcctgaccctgggcaagaacatgccccggcggcgggtgtctgtggccgtggtgcccaagttcaatgccctgaacctgcccggccagacccccagcagcagcagcatccccagcctgcctgccctgtctgagagccccaacgggaagggcagcctgcctgtgaccagcgccctgcctgccctgctggagaatggcaagaccaatggagaccctgactgtgaggccagcgccccagccctgaccctgagctgcctggaggagctgagccaggagaccaaggccaggatggaggaggaggcctacagcaagggcttccaggagggcctgaagaagaccaaggagctgcaggacctgaaggaggaggaggaggagcagaagtctgagagccctgaggagcctgaggaggtggaggagacagaggaggaggagaagggccccaggagcagcaagctggaggagctggtgcacttcctgcaggtgatgtaccccaagctgtgccagcactggcaggtgatctggatgatggctgctgtgatgctggtgctgactgtggtgctgggcctgtacaacagctacaacagctgtgccgagcaggctgatggccccctgggccgcagcacctgcagcgctgcccagagggacagctggtggagcagcggcctgcagcacgagcagcccacagagcagtag

SEQ ID NO: 35919 - DNA, 2712 bp, Artificial Sequence
  Description of Artificial Sequence: Synthetic coding sequence
atgggcatggacctgacctgccccttcggcatcagccctgcctgtggggcccaggcctcctggagcatctttggagcagatgctgctgaggtgcccggcacccggggccacagccagcaggaggccgccatgccccacatcccagaagatgaggagcccccaggagagccccaggccgcccagagccctgctggccagggccccccagctgctggggtgtcctgcagccccacccccaccatcgtgctgactggagatgccaccagccctgagggggagacagacaagaacctggccaacagagtgcacagcccccacaagaggctgagccaccgccacctgaaggtgtccacagccagcctgacctctgtggaccctgctggccacatcatcgacctggtgaatgaccagctgcctgacatcagcatcagcgaggaggacaagaagaagaacctggccctgctggaggaggccaagctggtgtctgagcgcttcctgacccggcggggcaggaagagccgcagcagccctggggacagccccagcgctgtgagccccaacctgagccccagcgccagccccaccagcagccgcagcaacagcctgactgtgcccaccccacctggcctggatgtgtgcagcggcccccccagccccctgcccggggccccaccccagaagggagatgaagcagatgtgagcagcccccaccctggagagcccaacgtgcccaagggcctggccgacaggaagcagaatgaccagaggaaggtgtcccagggccgcctggcccccaggcctcctcctgtggagaagagcaaggagatcgccatcgagcagaaggagaactttgaccccctgcagtacccagagaccacccccaagggcctggcccctgtgaccaacagcagcggcaagatggccctgaacagcccccagcccggccctgtggagagcgagctgggcaagcagctgctgaagacaggctgggagggcagccccctgcccaggagccccacccaggatgctgctggggtgggccccccagccagccagggccggggccctgctggggagcccatgggccctgaggccggcagcaaggccgagctgccccccaccgtgtcccggccccccctgctgcggggcctgtcctgggacagcggccctgaggagcccggcccccggctgcagaaggtgctggccaagctgcccctggccgaggaggagaagagatttgctgggaaggccggcggcaagctggccaaggcccctggcctgaaggacttccagatccaggtgcagcctgtgaggatgcagaagctgaccaagctgcgggaggagcacatcctgatgaggaaccagaacctggtgggcctgaagctgcctgacctgtctgaggccgctgagcaggagaagggcctgcccagcgagctgagccctgccatcgaggaggaggagagcaagagcggcctggatgtgatgcccaacatcagtgatgtgctgctgaggaagctgcgggtgcacaggagcctgcccggcagcgccccacccctgacagagaaggaggtggagaatgtgtttgtgcagctgagcctggccttcagaaatgacagctacaccctggagagccgcatcaaccaggccgagcgggagaggaacctgacagaggagaacacagagaaggagctggagaacttcaaggccagcatcaccagcagcgccagcctgtggcaccactgtgagcaccgggagacctaccagaagctgctggaggacattgctgtgctgcaccggctggccgcccggctgagcagcagagctgaggtggtgggcgctgtgcggcaggagaagaggatgagcaaggccacagaggtgatgatgcagtatgtggagaacctgaagaggacctatgagaaggaccatgctgagctgatggagttcaagaagctggccaaccagaacagcagccgcagctgtggccccagtgaagatggagtgcccaggacagcccgctccatgagcctgaccctgggcaagaacatgcccaggagaagagtgtctgtggccgtggtgcccaagttcaatgccctgaacctgcccggccagacccccagcagcagcagcatccccagcctgcctgccctgtctgagagccccaacgggaagggcagcctgcctgtgaccagcgccctgcctgccctgctggagaatggcaagaccaacggggaccctgactgtgaggccagcgccccagccctgaccctgagctgcctggaggagctgagccaggagaccaaggccaggatggaggaggaggcctacagcaagggcttccaggagggcctgaagaagaccaaggagctgcaggacctgaaggaggaggaggaggagcagaagtctgagagccctgaggagcctgaggaggtggaggagacagaggaggaggagaagggccccaggagcagcaagctggaggagctggtgcacttcctgcaggtgatgtaccccaagctgtgccagcactggcaggtgatctggatgatggctgctgtgatgctggtgctgactgtggtgctgggcctgtacaacagctacaacagctgtgccgagcaggctgatggccccctgggccgcagcacctgcagcgctgcccagagggacagctggtggagcagcggcctgcagcacgagcagcccacagagcagtag

SEQ ID NO: 35920 - DNA, 1794 bp, Artificial Sequence
  Description of Artificial Sequence: Synthetic coding sequence
atggccctgaacagcccccagcccggccctgtggagagcgagctgggcaagcagctgctgaagacaggctgggagggcagccccctgcccaggagccccacccaggatgctgctggggtgggccccccagccagccagggccggggccctgctggggagcccatgggccctgaggccggcagcaaggccgagctgccccccaccgtgtcccggccccccctgctgcggggcctgtcctgggacagcggccctgaggagcccggcccccggctgcagaaggtgctggccaagctgcccctggccgaggaggagaagagatttgctgggaaggccggcggcaagctggccaaggcccctggcctgaaggacttccagatccaggtgcagcctgtgaggatgcagaagctgaccaagctgcgggaggagcacatcctgatgaggaaccagaacctggtgggcctgaagctgcctgacctgtctgaggccgctgagcaggagaagggcctgcccagcgagctgagccctgccatcgaggaggaggagagcaagagcggcctggatgtgatgcccaacatcagtgatgtgctgctgaggaagctgcgggtgcacaggagcctgcccggcagcgccccacccctgacagagaaggaggtggagaatgtgtttgtgcagctgagcctggccttcagaaatgacagctacaccctggagagccgcatcaaccaggccgagcgggagaggaacctgacagaggagaacacagagaaggagctggagaacttcaaggccagcatcaccagcagcgccagcctgtggcaccactgtgagcaccgggagacctaccagaagctgctggaggacattgctgtgctgcaccggctggccgcccggctgagcagcagagctgaggtggtgggcgctgtgcggcaggagaagaggatgagcaaggccacagaggtgatgatgcagtatgtggagaacctgaagaggacctatgagaaggaccatgctgagctgatggagttcaagaagctggccaaccagaacagcagccgcagctgtggccccagtgaagatggagtgcccaggacagcccgctccatgagcctgaccctgggcaagaacatgcccaggagaagagtgtctgtggccgtggtgcccaagttcaatgccctgaacctgcccggccagacccccagcagcagcagcatccccagcctgcctgccctgtctgagagccccaacgggaagggcagcctgcctgtgaccagcgccctgcctgccctgctggagaatggcaagaccaacggggaccctgactgtgaggccagcgccccagccctgaccctgagctgcctggaggagctgagccaggagaccaaggccaggatggaggaggaggcctacagcaagggcttccaggagggcctgaagaagaccaaggagctgcaggacctgaaggaggaggaggaggagcagaagtctgagagccctgaggagcctgaggaggtggaggagacagaggaggaggagaagggccccaggagcagcaagctggaggagctggtgcacttcctgcaggtgatgtaccccaagctgtgccagcactggcaggtgatctggatgatggctgctgtgatgctggtgctgactgtggtgctgggcctgtacaacagctacaacagctgtgccgagcaggctgatggccccctgggccgcagcacctgcagcgctgcccagagggacagctggtggagcagcggcctgcagcacgagcagcccacagagcagtag

SEQ ID NO: 35921 - DNA, 2658 bp, Artificial Sequence
  Description of Artificial Sequence: Synthetic coding sequence
atgggcatggacctgacctgccccttcggcatcagccctgcctgtggggcccaggcctcctggagcatctttggagcagatgctgctgaggtgcccggcacccggggccacagccagcaggaggccgccatgccccacatcccagaagatgaggagcccccaggagagccccaggccgcccagagccctgctggccagggccccccagctgctggggtgtcctgcagccccacccccaccatcgtgctgactggagatgccaccagccctgagggggagacagacaagaacctggccaacagagtgcacagcccccacaagaggctgagccaccgccacctgaaggtgtccacagccagcctgacctctgtggaccctgctggccacatcatcgacctggtgaatgaccagctgcctgacatcagcatcagcgaggaggacaagaagaagaacctggccctgctggaggaggccaagctggtgtctgagcgcttcctgacccggcggggcaggaagagccgcagcagccctggggacagccccagcgctgtgagccccaacctgagccccagcgccagccccaccagcagccgcagcaacagcctgactgtgcccaccccaccagatggagatgaagcagatgtgagcagcccccaccctggagagcccaacgtgcccaagggcctggccgacaggaagcagaatgaccagaggaaggtgtcccagggccgcctggcccccaggcctcctcctgtggagaagagcaaggagatcgccatcgagcagaaggagaactttgaccccctgcagtacccagagaccacccccaagggcctggcccctgtgaccaacagcagcggcaagatggccctgaacagcccccagcccggccctgtggagagcgagctgggcaagcagctgctgaagacaggctgggagggcagccccctgcccaggagccccacccaggatgctgctggggtgggccccccagccagccagggccggggccctgctggggagcccatgggccctgaggccggcagcaaggccgagctgccccccaccgtgtcccggccccccctgctgcggggcctgtcctgggacagcggccctgaggagcccggcccccggctgcagaaggtgctggccaagctgcccctggccgaggaggagaagagatttgctgggaaggccggcggcaagctggccaaggcccctggcctgaaggacttccagatccaggtgcagcctgtgaggatgcagaagctgaccaagctgcgggaggagcacatcctgatgaggaaccagaacctggtgggcctgaagctgcctgacctgtctgaggccgctgagcaggagaagggcctgcccagcgagctgagccctgccatcgaggaggaggagagcaagagcggcctggatgtgatgcccaacatcagtgatgtgctgctgaggaagctgcgggtgcacaggagcctgcccggcagcgccccacccctgacagagaaggaggtggagaatgtgtttgtgcagctgagcctggccttcagaaatgacagctacaccctggagagccgcatcaaccaggccgagcgggagaggaacctgacagaggagaacacagagaaggagctggagaacttcaaggccagcatcaccagcagcgccagcctgtggcaccactgtgagcaccgggagacctaccagaagctgctggaggacattgctgtgctgcaccggctggccgcccggctgagcagcagagctgaggtggtgggcgctgtgcggcaggagaagaggatgagcaaggccacagaggtgatgatgcagtatgtggagaacctgaagaggacctatgagaaggaccatgctgagctgatggagttcaagaagctggccaaccagaacagcagccgcagctgtggccccagtgaagatggagtgcccaggacagcccgctccatgagcctgaccctgggcaagaacatgcccaggagaagagtgtctgtggccgtggtgcccaagttcaatgccctgaacctgcccggccagacccccagcagcagcagcatccccagcctgcctgccctgtctgagagccccaacgggaagggcagcctgcctgtgaccagcgccctgcctgccctgctggagaatggcaagaccaacggggaccctgactgtgaggccagcgccccagccctgaccctgagctgcctggaggagctgagccaggagaccaaggccaggatggaggaggaggcctacagcaagggcttccaggagggcctgaagaagaccaaggagctgcaggacctgaaggaggaggaggaggagcagaagtctgagagccctgaggagcctgaggaggtggaggagacagaggaggaggagaagggccccaggagcagcaagctggaggagctggtgcacttcctgcaggtgatgtaccccaagctgtgccagcactggcaggtgatctggatgatggctgctgtgatgctggtgctgactgtggtgctgggcctgtacaacagctacaacagctgtgccgagcaggctgatggccccctgggccgcagcacctgcagcgctgcccagagggacagctggtggagcagcggcctgcagcacgagcagcccacagagcagtag

SEQ ID NO: 35922 - DNA, 2466 bp, Artificial Sequence
  Description of Artificial Sequence: Synthetic coding sequence
ctgactggagatgccaccagccctgagggggagacagacaagaacctggccaacagagtgcacagcccccacaagaggctgagccaccgccacctgaaggtgtccacagccagcctgacctctgtggaccctgctggccacatcatcgacctggtgaatgaccagctgcctgacatcagcatcagcgaggaggacaagaagaagaacctggccctgctggaggaggccaagctggtgtctgagcgcttcctgacccggcggggcaggaagagccgcagcagccctggggacagccccagcgctgtgagccccaacctgagccccagcgccagccccaccagcagccgcagcaacagcctgactgtgcccaccccacctggcctggatgtgtgcagcggcccccccagccccctgcccggggccccaccccagaagggagatgaagcagatgtgagcagcccccaccctggagagcccaacgtgcccaagggcctggccgacaggaagcagaatgaccagaggaaggtgtcccagggccgcctggcccccaggcctcctcctgtggagaagagcaaggagatcgccatcgagcagaaggagaactttgaccccctgcagtacccagagaccacccccaagggcctggcccctgtgaccaacagcagcggcaagatggccctgaacagcccccagcccggccctgtggagagcgagctgggcaagcagctgctgaagacaggctgggagggcagccccctgcccaggagccccacccaggatgctgctggggtgggccccccagccagccagggccggggccctgctggggagcccatgggccctgaggccggcagcaaggccgagctgccccccaccgtgtcccggccccccctgctgcggggcctgtcctgggacagcggccctgaggagcccggcccccggctgcagaaggtgctggccaagctgcccctggccgaggaggagaagagatttgctgggaaggccggcggcaagctggccaaggcccctggcctgaaggacttccagatccaggtgcagcctgtgaggatgcagaagctgaccaagctgcgggaggagcacatcctgatgaggaaccagaacctggtgggcctgaagctgcctgacctgtctgaggccgctgagcaggagaagggcctgcccagcgagctgagccctgccatcgaggaggaggagagcaagagcggcctggatgtgatgcccaacatcagtgatgtgctgctgaggaagctgcgggtgcacaggagcctgcccggcagcgccccacccctgacagagaaggaggtggagaatgtgtttgtgcagctgagcctggccttcagaaatgacagctacaccctggagagccgcatcaaccaggccgagcgggagaggaacctgacagaggagaacacagagaaggagctggagaacttcaaggccagcatcaccagcagcgccagcctgtggcaccactgtgagcaccgggagacctaccagaagctgctggaggacattgctgtgctgcaccggctggccgcccggctgagcagcagagctgaggtggtgggcgctgtgcggcaggagaagaggatgagcaaggccacagaggtgatgatgcagtatgtggagaacctgaagaggacctatgagaaggaccatgctgagctgatggagttcaagaagctggccaaccagaacagcagccgcagctgtggccccagtgaagatggagtgcccaggacagcccgctccatgagcctgaccctgggcaagaacatgcccaggagaagagtgtctgtggccgtggtgcccaagttcaatgccctgaacctgcccggccagacccccagcagcagcagcatccccagcctgcctgccctgtctgagagccccaacgggaagggcagcctgcctgtgaccagcgccctgcctgccctgctggagaatggcaagaccaacggggaccctgactgtgaggccagcgccccagccctgaccctgagctgcctggaggagctgagccaggagaccaaggccaggatggaggaggaggcctacagcaagggcttccaggagggcctgaagaagaccaaggagctgcaggacctgaaggaggaggaggaggagcagaagtctgagagccctgaggagcctgaggaggtggaggagacagaggaggaggagaagggccccaggagcagcaagctggaggagctggtgcacttcctgcaggtgatgtaccccaagctgtgccagcactggcaggtgatctggatgatggctgctgtgatgctggtgctgactgtggtgctgggcctgtacaacagctacaacagctgtgccgagcaggctgatggccccctgggccgcagcacctgcagcgctgcccagagggacagctggtggagcagcggcctgcagcacgagcagcccacagagcagtag

SEQ ID NO: 35923 - DNA, 1794 bp, Artificial Sequence; identical to SEQ ID NO: 35920
  Description of Artificial Sequence: Synthetic coding sequence

SEQ ID NO: 35924 - DNA, 2466 bp, Artificial Sequence; identical to SEQ ID NO: 35922
  Description of Artificial Sequence: Synthetic coding sequence

SEQ ID NO: 35925 - DNA, 2466 bp, Artificial Sequence
  Description of Artificial Sequence: Synthetic coding sequence
atgactggagatgccaccagccctgagggggagacagacaagaacctggccaacagagtgcacagcccccacaagaggctgagccaccgccacctgaaggtgtccacagccagcctgacctctgtggaccctgctggccacatcatcgacctggtgaatgaccagctgcctgacatcagcatcagcgaggaggacaagaagaagaacctggccctgctggaggaggccaagctggtgtctgagcgcttcctgacccggcggggcaggaagagccgcagcagccctggggacagccccagcgctgtgagccccaacctgagccccagcgccagccccaccagcagccgcagcaacagcctgactgtgcccaccccacctggcctggatgtgtgcagcggcccccccagccccctgcccggggccccaccccagaagggagatgaagcagatgtgagcagcccccaccctggagagcccaacgtgcccaagggcctggccgacaggaagcagaatgaccagaggaaggtgtcccagggccgcctggcccccaggcctcctcctgtggagaagagcaaggagatcgccatcgagcagaaggagaactttgaccccctgcagtacccagagaccacccccaagggcctggcccctgtgaccaacagcagcggcaagatggccctgaacagcccccagcccggccctgtggagagcgagctgggcaagcagctgctgaagacaggctgggagggcagccccctgcccaggagccccacccaggatgctgctggggtgggccccccagccagccagggccggggccctgctggggagcccatgggccctgaggccggcagcaaggccgagctgccccccaccgtgtcccggccccccctgctgcggggcctgtcctgggacagcggccctgaggagcccggcccccggctgcagaaggtgctggccaagctgcccctggccgaggaggagaagagatttgctgggaaggccggcggcaagctggccaaggcccctggcctgaaggacttccagatccaggtgcagcctgtgaggatgcagaagctgaccaagctgcgggaggagcacatcctgatgaggaaccagaacctggtgggcctgaagctgcctgacctgtctgaggccgctgagcaggagaagggcctgcccagcgagctgagccctgccatcgaggaggaggagagcaagagcggcctggatgtgatgcccaacatcagtgatgtgctgctgaggaagctgcgggtgcacaggagcctgcccggcagcgccccacccctgacagagaaggaggtggagaatgtgtttgtgcagctgagcctggccttcagaaatgacagctacaccctggagagccgcatcaaccaggccgagcgggagaggaacctgacagaggagaacacagagaaggagctggagaacttcaaggccagcatcaccagcagcgccagcctgtggcaccactgtgagcaccgggagacctaccagaagctgctggaggacattgctgtgctgcaccggctggccgcccggctgagcagcagagctgaggtggtgggcgctgtgcggcaggagaagaggatgagcaaggccacagaggtgatgatgcagtatgtggagaacctgaagaggacctatgagaaggaccatgctgagctgatggagttcaagaagctggccaaccagaacagcagccgcagctgtggccccagtgaagatggagtgcccaggacagcccgctccatgagcctgaccctgggcaagaacatgcccaggagaagagtgtctgtggccgtggtgcccaagttcaatgccctgaacctgcccggccagacccccagcagcagcagcatccccagcctgcctgccctgtctgagagccccaacgggaagggcagcctgcctgtgaccagcgccctgcctgccctgctggagaatggcaagaccaacggggaccctgactgtgaggccagcgccccagccctgaccctgagctgcctggaggagctgagccaggagaccaaggccaggatggaggaggaggcctacagcaagggcttccaggagggcctgaagaagaccaaggagctgcaggacctgaaggaggaggaggaggagcagaagtctgagagccctgaggagcctgaggaggtggaggagacagaggaggaggagaagggccccaggagcagcaagctggaggagctggtgcacttcctgcaggtgatgtaccccaagctgtgccagcactggcaggtgatctggatgatggctgctgtgatgctggtgctgactgtggtgctgggcctgtacaacagctacaacagctgtgccgagcaggctgatggccccctgggccgcagcacctgcagcgctgcccagagggacagctggtggagcagcggcctgcagcacgagcagcccacagagcagtag

SEQ ID NO: 35926 - DNA, 1794 bp, Artificial Sequence; identical to SEQ ID NO: 35920
  Description of Artificial Sequence: Synthetic coding sequence

SEQ ID NO: 35927 - DNA, 2739 bp, Artificial Sequence
  Description of Artificial Sequence: Synthetic coding sequence
atggtgaaggccccccagagcgaggagcggctggcccggggcggcaaggagaacaacagcgtgctggcctgtggggcccaggcctcctggagcatctttggagcagatgctgctgaggtgcccggcacccggggccacagccagcaggaggccgccatgccccacatcccagaagatgaggagcccccaggagagccccaggccgcccagagccctgctggccagggccccccagctgctggggtgtcctgcagccccacccccaccatcgtgctgactggagatgccaccagccctgagggggagacagacaagaacctggccaacagagtgcacagcccccacaagaggctgagccaccgccacctgaaggtgtccacagccagcctgacctctgtggaccctgctggccacatcatcgacctggtgaatgaccagctgcctgacatcagcatcagcgaggaggacaagaagaagaacctggccctgctggaggaggccaagctggtgtctgagcgcttcctgacccggcggggcaggaagagccgcagcagccctggggacagccccagcgctgtgagccccaacctgagccccagcgccagccccaccagcagccgcagcaacagcctgactgtgcccaccccacctggcctggatgtgtgcagcggcccccccagccccctgcccggggccccaccccagaagggagatgaagcagatgtgagcagcccccaccctggagagcccaacgtgcccaagggcctggccgacaggaagcagaatgaccagaggaaggtgtcccagggccgcctggccccccggcccccacctgtggagaagagcaaggagatcgccatcgagcagaaggaaaattttgaccccctgcagtacccagagaccacccccaagggcctggcccctgtgaccaacagcagcggcaagatggccctgaacagcccccagcccggccctgtggagagcgagctgggcaagcagctgctgaagacaggctgggagggcagccccctgcccaggagccccacccaggatgctgctggggtgggccccccagccagccagggccggggccctgctggggagcccatgggccctgaggccggcagcaaggccgagctgcccccaacagtgtccaggcctcccctgctgcggggcctgtcctgggacagcggccctgaggagcccggcccccggctgcagaaggtgctggccaagctgcccctggccgaggaggagaagagatttgctgggaaggccggcggcaagctggccaaggcccctggcctgaaggacttccagatccaggtgcagcctgtgaggatgcagaagctgaccaagctgcgggaggagcacatcctgatgaggaaccagaacctggtgggcctgaagctgcctgacctgtctgaggccgctgagcaggagaagggcctgcccagcgagctgagccctgccatcgaggaggaggagagcaagagcggcctggatgtgatgcccaacatcagtgatgtgctgctgaggaagctgcgggtgcacaggagcctgcccggcagcgccccacccctgacagagaaggaggtggagaatgtgtttgtgcagctgagcctggccttcagaaatgacagctacaccctggagagccgcatcaaccaggccgagcgggagaggaacctgacagaagaaaatacagagaaggagctggagaacttcaaggccagcatcaccagcagcgccagcctgtggcaccactgtgagcaccgggagacctaccagaagctgctggaggacattgctgtgctgcaccggctggccgcccggctgagcagcagagctgaggtggtgggcgctgtgcggcaggagaagaggatgagcaaggccacagaggtgatgatgcagtatgtggagaacctgaagaggacctatgagaaggaccacgccgagctgatggagttcaagaagctggccaaccagaacagcagccgcagctgtggccccagtgaagatggagtgcccaggacagcccgctccatgagcctgaccctgggcaagaacatgccccggcggcgggtgtctgtggccgtggtgcccaagttcaatgccctgaacctgcccggccagacccccagcagcagcagcatccccagcctgcctgccctgtctgagagccccaacgggaagggcagcctgcctgtgaccagcgccctgcctgccctgctggagaatggcaagaccaatggagaccctgactgtgaggccagcgccccagccctgaccctgagctgcctggaggagctgagccaggagaccaaggccaggatggaggaggaggcctacagcaagggcttccaggagggcctgaagaagaccaaggagctgcaggacctgaaggaggaggaggaggagcagaagtctgagagccctgaggagcctgaggaggtggaggagacagaggaggaggagaagggccccaggagcagcaagctggaggagctggtgcacttcctgcaggtgatgtaccccaagctgtgccagcactggcaggtgatctggatgatggctgctgtgatgctggtgctgactgtggtgctgggcctgtacaacagctacaacagctgtgccgagcaggctgatggccccctgggccgcagcacctgcagcgctgcccagagggacagctggtggagcagcggcctgcagcacgagcagcccacagagcagtag

SEQ ID NO: 35928 - DNA, 2715 bp, Artificial Sequence
  Description of Artificial Sequence: Synthetic coding sequence
atgggcatggacctgacctgccccttcggcatcagccctgcctgtggggcccaggcctcctggagcatctttggagcagatgctgctgaggtgcccggcacccggggccacagccagcaggaggccgccatgccccacatcccagaagatgaggagcccccaggagagccccaggccgcccagagccctgctggccagggccccccagctgctggggtgtcctgcagccccacccccaccatcgtgctgactggagatgccaccagccctgagggggagacagacaagaacctggccaacagagtgcacagcccccacaagaggctgagccaccgccacctgaaggtgtccacagccagcctgacctctgtggaccctgctggccacatcatcgacctggtgaatgaccagctgcctgacatcagcatcagcgaggaggacaagaagaagaacctggccctgctggaggaggccaagctggtgtctgagcgcttcctgacccggcggggcaggaagagccgcagcagccctggggacagccccagcgctgtgagccccaacctgagccccagcgccagccccaccagcagccgcagcaacagcctgactgtgcccaccccacctggcctggatgtgtgcagcggcccccccagccccctgcccggggccccaccccagcagaagggagatgaagcagatgtgagcagcccccaccctggagagcccaacgtgcccaagggcctggccgacaggaagcagaatgaccagaggaaggtgtcccagggccgcctggccccccggcccccacctgtggagaagagcaaggagatcgccatcgagcagaaggaaaattttgaccccctgcagtacccagagaccacccccaagggcctggcccctgtgaccaacagcagcggcaagatggccctgaacagcccccagcccggccctgtggagagcgagctgggcaagcagctgctgaagacaggctgggagggcagccccctgcccaggagccccacccaggatgctgctggggtgggccccccagccagccagggccggggccctgctggggagcccatgggccctgaggccggcagcaaggccgagctgcccccaacagtgtccaggcctcccctgctgcggggcctgtcctgggacagcggccctgaggagcccggcccccggctgcagaaggtgctggccaagctgcccctggccgaggaggagaagagatttgctgggaaggccggcggcaagctggccaaggcccctggcctgaaggacttccagatccaggtgcagcctgtgaggatgcagaagctgaccaagctgcgggaggagcacatcctgatgaggaaccagaacctggtgggcctgaagctgcctgacctgtctgaggccgctgagcaggagaagggcctgcccagcgagctgagccctgccatcgaggaggaggagagcaagagcggcctggatgtgatgcccaacatcagtgatgtgctgctgaggaagctgcgggtgcacaggagcctgcccggcagcgccccacccctgacagagaaggaggtggagaatgtgtttgtgcagctgagcctggccttcagaaatgacagctacaccctggagagccgcatcaaccaggccgagcgggagaggaacctgacagaagaaaatacagagaaggagctggagaacttcaaggccagcatcaccagcagcgccagcctgtggcaccactgtgagcaccgggagacctaccagaagctgctggaggacattgctgtgctgcaccggctggccgcccggctgagcagcagagctgaggtggtgggcgctgtgcggcaggagaagaggatgagcaaggccacagaggtgatgatgcagtatgtggagaacctgaagaggacctatgagaaggaccacgccgagctgatggagttcaagaagctggccaaccagaacagcagccgcagctgtggccccagtgaagatggagtgcccaggacagcccgctccatgagcctgaccctgggcaagaacatgccccggcggcgggtgtctgtggccgtggtgcccaagttcaatgccctgaacctgcccggccagacccccagcagcagcagcatccccagcctgcctgccctgtctgagagccccaacgggaagggcagcctgcctgtgaccagcgccctgcctgccctgctggagaatggcaagaccaatggagaccctgactgtgaggccagcgccccagccctgaccctgagctgcctggaggagctgagccaggagaccaaggccaggatggaggaggaggcctacagcaagggcttccaggagggcctgaagaagaccaaggagctgcaggacctgaaggaggaggaggaggagcagaagtctgagagccctgaggagcctgaggaggtggaggagacagaggaggaggagaagggccccaggagcagcaagctggaggagctggtgcacttcctgcaggtgatgtaccccaagctgtgccagcactggcaggtgatctggatgatggctgctgtgatgctggtgctgactgtggtgctgggcctgtacaacagctacaacagctgtgccgagcaggctgatggccccctgggccgcagcacctgcagcgctgcccagagggacagctggtggagcagcggcctgcagcacgagcagcccacagagcagtag

SEQ ID NO: 35929 - DNA, 2121 bp, Artificial Sequence
  Description of Artificial Sequence: Synthetic coding sequence
atggtgaaggccccccagagcgaggagcggctggcccggggcggcaaggagaacaacagcgtgctggcctgtggggcccaggcctcctggagcatctttggagcagatgctgctgaggtgcccggcacccggggccacagccagcaggaggccgccatgccccacatcccagaagatgaggagcccccaggagagccccaggccgcccagagccctgctggccagggccccccagctgctggggtgtcctgcagccccacccccaccatcgtgctgactggagatgccaccagccctgagggggagacagacaagaacctggccaacagagtgcacagcccccacaagaggctgagccaccgccacctgaaggtgtccacagccagcctgacctctgtggaccctgctggccacatcatcgacctggtgaatgaccagctgcctgacatcagcatcagcgaggaggacaagaagaagaacctggccctgctggaggaggccaagctggtgtctgagcgcttcctgacccggcggggcaggaagagccgcagcagccctggggacagccccagcgctgtgagccccaacctgagccccagcgccagccccaccagcagccgcagcaacagcctgactgtgcccaccccacctggcctggatgtgtgcagcggcccccccagccccctgcccggggccccaccccagaagggagatgaagcagatgtgagcagcccccaccctggagagcctgagcacatcctgatgaggaaccagaacctggtgggcctgaagctgcctgacctgtctgaggccgctgagcaggagaagggcctgcccagcgagctgagccctgccatcgaggaggaggagagcaagagcggcctggatgtgatgcccaacatcagtgatgtgctgctgaggaagctgcgggtgcacaggagcctgcccggcagcgccccacccctgacagagaaggaggtggagaatgtgtttgtgcagctgagcctggccttcagaaatgacagctacaccctggagagccgcatcaaccaggccgagcgggagaggaacctgacagaagaaaatacagagaaggagctggagaacttcaaggccagcatcaccagcagcgccagcctgtggcaccactgtgagcaccgggagacctaccagaagctgctggaggacattgctgtgctgcaccggctggccgcccggctgagcagcagagctgaggtggtgggcgctgtgcggcaggagaagaggatgagcaaggccacagaggtgatgatgcagtatgtggagaacctgaagaggacctatgagaaggaccacgccgagctgatggagttcaagaagctggccaaccagaacagcagccgcagctgtggccccagtgaagatggagtgcccaggacagcccgctccatgagcctgaccctgggcaagaacatgccccggcggcgggtgtctgtggccgtggtgcccaagttcaatgccctgaacctgcccggccagacccccagcagcagcagcatccccagcctgcctgccctgtctgagagccccaacgggaagggcagcctgcctgtgaccagcgccctgcctgccctgctggagaatggcaagaccaatggagaccctgactgtgaggccagcgccccagccctgaccctgagctgcctggaggagctgagccaggagaccaaggccaggatggaggaggaggcctacagcaagggcttccaggagggcctgaagaagaccaaggagctgcaggacctgaaggaggaggaggaggagcagaagtctgagagccctgaggagcctgaggaggtggaggagacagaggaggaggagaagggccccaggagcagcaagctggaggagctggtgcacttcctgcaggtgatgtaccccaagctgtgccagcactggcaggtgatctggatgatggctgctgtgatgctggtgctgactgtggtgctgggcctgtacaacagctacaacagctgtgccgagcaggctgatggccccctgggccgcagcacctgcagcgctgcccagagggacagctggtggagcagcggcctgcagcacgagcagcccacagagcagtag

SEQ ID NO: 35930 - DNA, 1731 bp, Artificial Sequence
  Description of Artificial Sequence: Synthetic coding sequence
atggctgatgccaacaaggccgaggtgcctggggccactggaggagacagcccccacctgcagcctgctgagcccccaggagagccccggcgggagccccaccctgctgaggccgagaagcagcagccccagcacagcagcagcagcaatggagtgaagatggagaatgatgaaagtgccaaggaggagaagagtgacctgaaggagaagagcacaggcagcaagaaggccaaccgcttccacccctacagcaaggacaagaacagcggggccggggagaagaagggccccaacagaaacagagtcttcatcagcaacatcccctatgacatgaagtggcaggccatcaaggacctgatgagggagaaggtgggggaggtgacctacgtggagctgttcaaggatgctgagggcaagagccggggctgcggcgtggtggagttcaaggatgaggagtttgtgaagaaggccctggagaccatgaacaagtatgacctgagcggccggcccctgaacatcaaggaggaccctgatggagaaaatgcccggcgggccctgcagaggactggaggcagcttccctgggggccacgtgcctgacatgggcagcggcctgatgaacctgcccccatccatcctgaacaaccccaacatccccccagaggtgatcagcaacctgcaggccggccgcctgggcagcaccatctttgtggccaacctggacttcaaggtgggctggaagaagctgaaggaggtgttcagcattgctggcaccgtgaagagagctgacatcaaggaggacaaggatggcaagagccggggcatgggcaccgtgacctttgagcaggccatcgaggccgtgcaggccatctccatgttcaacggccagttcctgtttgaccggcccatgcacgtgaagatggatgacaagtctgtgccccatgaggagtaccgcagccatgatggcaagaccccccagctgccccggggcctgggcggcatcggcatgggcctgggccctgggggccagcccatcagcgccagccagctgaacatcggcggcgtgatgggcaacctgggccctgggggcatgggcatggatggccctggctttggaggcatgaacagaattggaggcggcattggatttggaggcctggaggccatgaacagcatgggcggctttggaggagtgggccgcatgggagagctgtacagaggagccatgaccagctccatggagcgggactttggccgcggggacatcggcatcaaccagggctttggagacagctttggccgcctgggcggcggcatgggctccatgaacagcgtgactggaggcatgggcatgggcctggacaggatgagcagcagctttgacaggatgggccctggcattggagccatcctggagaggagcattgacatggaccggggcttcctgagcggccccatgggcagcggcatgagggagcgcatcggcagcaaaggaaaccagatctttgtgaggaacctgccctttgacctgacctggcagaagctgaaggagaagttcagccagtgtggccacgtgatgtttgctgagatcaagatggagaatggcaagagcaagggctgcggcaccgtgcgctttgacagccctgagagcgctgagaaggcctgccgcatcatgaatggcatcaagatcagcggccgggagattgatgtgcggctggacagaaatgcctag

SEQ ID NO: 35931 - DNA, 1803 bp, Artificial Sequence
  Description of Artificial Sequence: Synthetic coding sequence
atggctgatgccaacaaggccgaggtgcctggggccactggaggagacagcccccacctgcagcctgctgagcccccaggagagccccggcgggagccccaccctgctgaggccgagaagcagcagccccagcacagcagcagcagcaatggagtgaagatggagaatgatgaaagtgccaaggaggagaagagtgacctgaaggagaagagcacaggcagcaagaaggccaaccgcttccacccctacagcaaggacaagaacagcggggccggggagaagaagggccccaacagaaacagagtcttcatcagcaacatcccctatgacatgaagtggcaggccatcaaggacctgatgagggagaaggtgggggaggtgacctacgtggagctgttcaaggatgctgagggcaagagccggggctgcggcgtggtggagttcaaggatgaggagtttgtgaagaaggccctggagaccatgaacaagtatgacctgagcggccggcccctgaacatcaaggaggaccctgatggagaaaatgcccggcgggccctgcagaggactggaggcagcttccctgggggccacgtgcctgacatgggcagcggcctgatgaacctgcccccatccatcctgaacaaccccaacatccccccagaggtgatcagcaacctgcaggccggccgcctgggcagcaccatctttgtggccaacctggacttcaaggtgggctggaagaagctgaaggaggtgttcagcattgctggcaccgtgaagagagctgacatcaaggaggacaaggatggcaagagccggggcatgggcaccgtgacctttgagcaggccatcgaggccgtgcaggccatctccatgttcaacggccagttcctgtttgaccggcccatgcacgtgaagatggatgacaagtctgtgccccatgaggagtaccgcagccatgatggcaagaccccccagctgccccggggcctgggcggcatcggcatgggcctgggccctgggggccagcccatcagcgccagccagctgaacatcggcggcgtgatgggcaacctgggccctgggggcatgggcatggatggccctggctttggaggcatgaacagaattggaggcggcattggatttggaggcctggaggccatgaacagcatgggcggctttggaggagtgggccgcatgggagagctgtacagaggagccatgaccagctccatggagcgggactttggccgcggggacatcggcatcaaccagggctttggagacagctttggccgcctgggcagcgccatgattggaggctttgctggaagaattggcagcagcaacatgggccctgtgggcagcggcatcagcggcggcatgggctccatgaacagcgtgactggaggcatgggcatgggcctggacaggatgagcagcagctttgacaggatgggccctggcattggagccatcctggagaggagcattgacatggaccggggcttcctgagcggccccatgggcagcggcatgagggagcgcatcggcagcaaaggaaaccagatctttgtgaggaacctgccctttgacctgacctggcagaagctgaaggagaagttcagccagtgtggccacgtgatgtttgctgagatcaagatggagaatggcaagagcaagggctgcggcaccgtgcgctttgacagccctgagagcgctgagaaggcctgccgcatcatgaatggcatcaagatcagcggccgggagattgatgtgcggctggacagaaatgcctag

SEQ ID NO: 35932 - DNA, 567 bp, Artificial Sequence
  Description of Artificial Sequence: Synthetic coding sequence
atgaacagcatgggcggctttggaggagtgggccgcatgggagagctgtacagaggagccatgaccagctccatggagcgggactttggccgcggggacatcggcatcaaccagggctttggagacagctttggccgcctgggcggcggcatgggctccatgaacagcgtgactggaggcatgggcatgggcctggacaggatgagcagcagctttgacaggatgggccctggcattggagccatcctggagaggagcattgacatggaccggggcttcctgagcggccccatgggcagcggcatgagggagcgcatcggcagcaaaggaaaccagatctttgtgaggaacctgccctttgacctgacctggcagaagctgaaggagaagttcagccagtgtggccacgtgatgtttgctgagatcaagatggagaatggcaagagcaagggctgcggcaccgtgcgctttgacagccctgagagcgctgagaaggcctgccgcatcatgaatggcatcaagatcagcggccgggagattgatgtgcggctggacagaaatgcctag

SEQ ID NO: 35933 - DNA, 381 bp, Artificial Sequence
  Description of Artificial Sequence: Synthetic coding sequence
tgaggactggacaggatgagcagcagctttgacaggatgggccctggcattggagccatcctggagaggagcattgacatggaccggggcttcctgagcggccccatgggcagcggcatgagggagcgcatcggcagcaaaggaaaccagatctttgtgaggaacctgccctttgacctgacctggcagaagctgaaggagaagttcagccagtgtggccacgtgatgtttgctgagatcaagatggagaatggcaagagcaagggctgcggcaccgtgcgctttgacagccctgagagcgctgagaaggcctgccgcatcatgaatggcatcaagatcagcggccgggagattgatgtgcggctggacagaaatgcctag

SEQ ID NO: 35934 - DNA, 810 bp, Artificial Sequence
  Description of Artificial Sequence: Synthetic coding sequence
atggccgccagcgctggagctggagctgtgattgctgccccagacagccgccgctggctgtggagcgtgctggccgccgccctgggcctgctgacagctggggtgtctgccctggaggtgtacacccccaaggagatctttgtggccaacggcacccagggcaagctgacctgcaagttcaagagcaccagcaccaccggcggcctgacctctgtgtcctggagcttccagcctgagggcgctgacaccaccgtgtccttcttccactacagccagggccaggtgtacctgggcaactacccacccttcaaggaccgcatctcctgggccggggacctggacaagaaggatgccagcatcaacatcgagaacatgcagttcatccacaacggcacctacatctgtgatgtgaagaaccccccagacatcgtggtgcagcccggccacatccggctgtatgtggtggagaaggagaacctgcctgtgtttcctgtgtgggtggtggtgggcatcgtgacagctgtggtgctgggcctgaccctgctgatctccatgatcctggccgtgctgtacagaaggaagaacagcaagagggactacacaggctgcagcaccagcgagagcctgagccctgtgaagcaggcccccaggaagagccccagcgacacagagggcctggtgaagagcctgcccagcggcagccaccagggccctgtgatctatgcccagctggaccacagcggcggccaccacagcgacaagatcaacaagtctgagagcgtggtgtatgctgacatcaggaagaactag

SEQ ID NO: 35935 - DNA, 630 bp, Artificial Sequence
  Description of Artificial Sequence: Synthetic coding sequence
atggccgccagcgctggagctggagctgtgattgctgccccagacagccgccgctggctgtggagcgtgctggccgccgccctgggcctgctgacagctggggtgtctgccctggaggtgtacacccccaaggagatctttgtggccaacggcacccagggcaagctgacctgcaagttcaagagcaccagcaccaccggcggcctgacctctgtgtcctggagcttccagcctgagggcgctgacaccaccgtgtccttcttccactacagccagggccaggtgtacctgggcaactacccacccttcaaggaccgcatctcctgggccggggacctggacaagaaggatgccagcatcaacatcgagaacatgcagttcatccacaacggcacctacatctgtgatgtgaagaaccccccagacatcgtggtgcagcccggccacatccggctgtatgtggtggagaaggagaacctgcctgtgtttcctgtgtgggtggtggtgggcatcgtgacagctgtggtgctgggcctgaccctgctgatctccatgatcctggccgtgctgtacagaaggaagaacagcaagagggactacacaggagcccagagctacatgcacagctag

SEQ ID NO: 35936 - DNA, 360 bp, Artificial Sequence
  Description of Artificial Sequence: Synthetic coding sequence
atggccgccagcgctggagctggagctgtgattgctgccccagacagccgccgctggctgtggagcgtgctggccgccgccctgggcctgctgacagctggggtgtctgccctggaggtgtacacccccaaggagatctttgtggccaacggcacccagggcaagctgacctgcaagttcaagagcaccagcaccaccggcggcctgacctctgtgtcctggagcttccagcctgagggcgctgacaccaccgtgtctggccctgtgatctatgcccagctggaccacagcggcggccaccacagcgacaagatcaacaagtctgagagcgtggtgtatgctgacatcaggaagaactag

SEQ ID NO: 35937 - DNA, 6147 bp, Artificial Sequence
  Description of Artificial Sequence: Synthetic coding sequence
atgctgcgggtgattgtggagagcgccagcaacatccccaagaccaagtttgggaagccagaccccatcgtgtctgtcatcttcaaggatgagaagaagaagaccaagaaggtggacaatgagctgaaccctgtgtggaatgagatcctggagtttgacctgcggggcatccccctggacttcagcagcagcctgggcatcatcgtgaaggactttgagaccatcggccagaacaagctgattggaacagccaccgtggccctgaaggacctgaccggggaccagagccgcagcctgccctacaagctgatcagcctgctgaatgagaagggccaggacaccggggccaccatcgacctggtgattggctatgacccccccagcgccccccaccccaatgacctgagcggccccagcgtgcccggcatgggaggagatggagaagaagatgaaggagatgaggaccggctggacaatgctgtgcggggccctggccccaagggccctgtgggcaccgtgtctgaggcccagctggcccggcggctgaccaaggtgaagaacagcaggaggatgctgagcaacaagccccaggacttccagatccgggtgcgggtcatcgagggccggcagctgagcggcaacaacatccggcctgtggtgaaggtgcacgtgtgtggccagacccacaggacccgcatcaagaggggcaacaaccccttctttgatgagctgttcttctacaacgtgaacatgacccccagcgagctgatggatgagatcatcagcatccgggtgtacaacagccacagcctgcgggctgactgcctgatgggagagttcaagattgatgtgggctttgtgtatgatgagcccggccatgctgtgatgaggaagtggctgctgctgaatgaccctgaggacaccagcagcggcagcaagggctacatgaaggtgtccatgtttgtgctgggcactggagatgagcccccacctgagcggcgggaccgggacaatgacagtgatgatgtggagagcaacctgctgctgcctgctggcatcgccctgcgctgggtgaccttcctgctgaagatctacagagctgaggacatcccccagatggatgatgccttcagccagacagtgaaggagatctttggaggaaatgctgacaagaagaacctggtggacccctttgtggaggtgtcctttgctgggaagaaggtgtgcaccaacatcatcgagaagaatgccaaccctgagtggaaccaggtggtgaacctgcagatcaagttccccagcgtgtgtgagaagatcaagctgaccatctatgactgggaccggctgaccaagaatgatgtggtgggcaccacctacctgcacctgagcaagattgctgccagcggcggggaggtggaggtgaacacaggagaaacagaggtgggctttgtgcccaccttcggcccctgctacctgaacctgtatggcagcccccgggagtacacaggcttcccagacccctatgatgagctgaacacaggcaagggggagggcgtggcctaccggggccgcatcctggtggagctggccaccttcctggagaagaccccaccagacaagaagctggagcccatcagcaatgatgacctgctggtggtggagaagtaccagaggaggaggaagtacagcctgtctgctgtgttccacagcgccaccatgctgcaggatgtgggggaggccatccagtttgaggtgtccatcggcaactacggcaacaagtttgacaccacctgcaagcccctggccagcaccacccagtacagcagagctgtgtttgatggcaactactactactacctgccctgggcccacaccaagcctgtggtgaccctgaccagctactgggaggacatcagccaccggctggatgctgtgaacaccctgctggccatggccgagcggctgcagaccaacatcgaggccctgaagagcggcatccagggcaagatcccagccaaccagctggccgagctgtggctgaagctgattgatgaggtgattgaggacacccgctacaccctgcccctgacagagggcaaggccaacgtgacagtgctggacacccagatcaggaagctgcggagccgcagcctgagccagatccatgaagctgctgtgaggatgaggtctgaggccacagatgtgaagagcaccctggccgagattgaggactggctggacaagctgatgcagctgacagaggagccccagaacagcatgccagacatcatcatctggatgatccggggggagaagaggctggcctatgcccgcatcccagcccaccaggtgctgtacagcaccagcggggagaatgccagcggcaagtactgcggcaagacccagaccatcttcctgaagtacccccaggagaagaacaacggccccaaggtgcctgtggagctgcgggtgaacatctggctgggcctgtctgctgtggagaagaagttcaacagctttgctgagggcaccttcaccgtgtttgctgagatgtatgagaaccaggccctgatgtttgggaagtggggcaccagcggcctggtgggccgccacaagttcagtgatgtgacaggcaagatcaagctgaagcgggagttcttcctgccccccaagggctgggagtgggagggggagtggatcgtggaccctgagaggagcctgctgacagaagcagatgctggccacacagagttcacagatgaggtgtaccagaatgaaagccgctacccaggaggagactggaagccagctgaggacacctacacagatgccaacggggacaaggccgccagccccagcgagctgacctgccccccaggctgggagtgggaggatgatgcctggagctatgacatcaacagagctgtggatgagaagggctgggagtatggcatcaccatccccccagaccacaagcccaagtcctgggtggccgctgagaagatgtaccacacccacagaagaagaaggctggtgaggaagaggaagaaggacctgacccagacagccagcagcacagcccgggccatggaggagctgcaggaccaggagggctgggagtatgccagcctcatcggctggaagttccactggaagcagaggagcagtgacaccttcagaagaagacgctggaggaggaagatggcccccagcgagacccatggagctgctgccatcttcaagctggagggcgccctgggcgctgacaccacagaagatggagatgagaagagcctggagaagcagaagcacagcgccaccaccgtgtttggagccaacacccccatcgtgtcctgcaactttgacagagtgtacatctaccacctgcgctgctacgtgtaccaggccaggaacctgctggccctggacaaggacagcttcagtgacccctatgcccacatctgcttcctgcacaggagcaagaccacagagatcatccacagcaccctgaaccccacctgggaccagaccatcatctttgatgaggtggagatctatggagagccccagacagtgctgcagaacccccccaaggtgatcatggagctgtttgacaatgaccaggtgggcaaggatgagttcctgggccgcagcatcttcagccctgtggtgaagctgaacagcgagatggacatcacccccaagctgctgtggcaccctgtgatgaatggagacaaggcctgtggagatgtgctggtgacagctgagctgatcctgcggggcaaggatggcagcaacctgcccatcctgcccccccagagggcccccaacctgtacatggtgccccagggcatccggcctgtggtgcagctgacagccatcgagatcctggcctggggcctgaggaacatgaagaacttccagatggccagcatcaccagccccagcctggtggtggagtgtggcggggagcgggtggagagcgtggtgatcaagaacctgaagaagacccccaacttccccagctctgtgctcttcatgaaggtgttcctgcccaaggaggagctgtacatgccacccctggtgatcaaggtgattgaccaccggcagtttggaaggaagcctgtggtgggccagtgcaccatcgagcggctggaccgcttccgctgtgacccctatgccggcaaggaggacatcgtgccccagctgaaggccagcctgctgagcgccccaccctgccgggacatcgtgattgagatggaggacaccaagcccctgctggccagcaagctgacagagaaggaggaggagatcgtggactggtggagcaagttctacgccagcagcggggagcacgagaagtgtggccagtacatccagaagggctacagcaagctgaagatctacaactgtgagctggagaatgtggccgagtttgagggcctgacagacttcagtgacaccttcaagctgtaccggggcaagagtgatgaaaatgaagaccccagcgtggtgggggagttcaagggcagcttccgcatctaccccctgcctgatgaccccagcgtgcctgccccaccccggcagttccgggagctgcctgattctgtgccccaggagtgcaccgtgcgcatctacatcgtgcggggcctggagctgcagccccaggacaacaacggcctgtgtgacccctacatcaagatcaccctgggcaagaaggtgattgaagatcgggaccactacatccccaacaccctgaaccctgtgtttggaaggatgtatgagctgagctgctacctgccccaggagaaggacctgaagatctctgtgtatgactatgacaccttcaccagagatgagaaggtgggggagaccatcatcgacctggagaaccgcttcctgagccgcttcggcagccactgcggcatccctgaggagtactgtgtgtctggagtgaacacctggagggaccagctgcggcccacccagctgctgcagaatgtggcccgcttcaagggcttcccccagcccatcctgtctgaagatggcagccgcatccgctatggaggccgggactacagcctggatgaatttgaggccaacaagatcctgcaccagcacctgggcgcccctgaggagcggctggccctgcacatcctgcggacccagggcctggtgcctgagcacgtggagaccaggaccctgcacagcaccttccagcccaacatcagccagggcaagctgcagatgtgggtggatgtgttccccaagagcctgggccccccaggcccccccttcaacatcacccccaggaaggccaagaagtactacctgcgggtcatcatctggaacaccaaggatgtgatcctggatgagaagagcatcactggagaggagatgtctgacatctacgtgaagggctggatccctggaaatgaggagaacaagcagaagacagatgtgcactaccgcagcctggatggagagggcaacttcaactggaggtttgtgttcccctttgactacctgcctgctgagcagctgtgcatcgtggccaagaaggagcacttctggagcattgaccagacagagttccgcatcccccccaggctcatcatccagatctgggacaatgacaagttcagcctggatgactacctgggcttcctggagctggacctgcggcacaccatcatcccagccaagagccctgagaagtgccgcctggacatgatcccagacctgaaggccatgaaccccctgaaggccaagacagccagcctgtttgagcagaagtccatgaagggctggtggccctgctacgccgagaaggatggagcccgggtgatggccggcaaggtggagatgaccctggagatcctgaatgagaaggaggctgatgagaggcctgctgggaagggcagagatgagcccaacatgaaccccaagctggacctgcccaacagacctgagaccagcttcctgtggttcaccaacccctgcaagaccatgaagttcatcgtgtggaggcgcttcaagtgggtgatcatcggcctgctcttcctgctgatcctgctgctgtttgtggccgtgctgctgtacagcctgcccaactacctgtccatgaagatcgtgaagcccaacgtgtag

SEQ ID NO: 35938 - DNA, 6186 bp, Artificial Sequence
  Description of Artificial Sequence: Synthetic coding sequence
atgctgcgggtgattgtggagagcgccagcaacatccccaagaccaagtttgggaagccagaccccatcgtgtctgtcatcttcaaggatgagaagaagaagaccaagaaggtggacaatgagctgaaccctgtgtggaatgagatcctggagtttgacctgcggggcatccccctggacttcagcagcagcctgggcatcatcgtgaaggactttgagaccatcggccagaacaagctgattggaacagccaccgtggccctgaaggacctgaccggggaccagagccgcagcctgccctacaagctgatcagcctgctgaatgagaagggccaggacaccggggccaccatcgacctggtgattggctatgacccccccagcgccccccaccccaatgacctgagcggccccagcgtgcccggcatgggaggagatggagaagaagatgaaggagatgaggaccggctggacaatgctgtgcggggccctggccccaagggccctgtgggcaccgtgtctgaggcccagctggcccggcggctgaccaaggtgaagaacagcaggaggatgctgagcaacaagccccaggacttccagatccgggtgcgggtcatcgagggccggcagctgagcggcaacaacatccggcctgtggtgaaggtgcacgtgtgtggccagacccacaggacccgcatcaagaggggcaacaaccccttctttgatgagctgttcttctacaacgtgaacatgacccccagcgagctgatggatgagatcatcagcatccgggtgtacaacagccacagcctgcgggctgactgcctgatgggagagttcaagattgatgtgggctttgtgtatgatgagcccggccatgctgtgatgaggaagtggctgctgctgaatgaccctgaggacaccagcagcggcagcaagggctacatgaaggtgtccatgtttgtgctgggcactggagatgagcccccacctgagcggcgggaccgggacaatgacagtgatgatgtggagagcaacctgctgctgcctgctggcatcgccctgcgctgggtgaccttcctgctgaagatctacagagctgaggacatcccccagatggatgatgccttcagccagacagtgaaggagatctttggaggaaatgctgacaagaagaacctggtggacccctttgtggaggtgtcctttgctgggaagaaggtgtgcaccaacatcatcgagaagaatgccaaccctgagtggaaccaggtggtgaacctgcagatcaagttccccagcgtgtgtgagaagatcaagctgaccatctatgactgggaccggctgaccaagaatgatgtggtgggcaccacctacctgcacctgagcaagattgctgccagcggcggggaggtggaggacttcagcagcagcggcactggagctgccagctacacagtgaacacaggagaaacagaggtgggctttgtgcccaccttcggcccctgctacctgaacctgtatggcagcccccgggagtacacaggcttcccagacccctatgatgagctgaacacaggaaaaggagagggcgtggcctaccggggccgcatcctggtggagctggccaccttcctggagaagaccccaccagacaagaagctggagcccatcagcaatgatgacctgctggtggtggagaagtaccagaggaggaggaagtacagcctgtctgctgtgttccacagcgccaccatgctgcaggatgtgggggaggccatccagtttgaggtgtccatcggcaactacggcaacaagtttgacaccacctgcaagcccctggccagcaccacccagtacagcagagctgtgtttgatggcaactactactactacctgccctgggcccacaccaagcctgtggtgaccctgaccagctactgggaggacatcagccaccggctggatgctgtgaacaccctgctggccatggccgagcggctgcagaccaacatcgaggccctgaagagcggcatccagggcaagatcccagccaaccagctggccgagctgtggctgaagctgattgatgaggtgattgaggacacccgctacaccctgcccctgacagagggcaaggccaacgtgacagtgctggacacccagatcaggaagctgcggagccgcagcctgagccagatccacgaggccgctgtgaggatgaggtctgaggccacagatgtgaagagcaccctggccgagattgaggactggctggacaagctgatgcagctgacagaggagccccagaacagcatgccagacatcatcatctggatgatccggggggagaagaggctggcctatgcccgcatcccagcccaccaggtgctgtacagcaccagcggagaaaatgccagcggcaagtactgtgggaagacccagaccatcttcctgaagtacccccaggagaagaacaacggccccaaggtgcctgtggagctgcgggtgaacatctggctgggcctgtctgctgtggagaagaagttcaacagctttgctgagggcaccttcaccgtgtttgctgagatgtatgagaaccaggccctgatgtttgggaagtggggcaccagcggcctggtgggccgccacaagttcagtgatgtgacaggcaagatcaagctgaagcgggagttcttcctgccccccaagggctgggagtgggagggggagtggatcgtggaccctgagaggagcctgctgacagaagcagatgctggccacacagagttcacagatgaggtgtaccagaatgaaagccgctacccaggaggagactggaagccagctgaggacacctacacagatgccaatggagacaaggccgccagccccagcgagctgacctgccccccaggctgggagtgggaggatgatgcctggagctatgacatcaacagagctgtggatgagaagggctgggagtatggcatcaccatccccccagaccacaagcccaagtcctgggtggccgctgagaagatgtaccacacccacagaagaagaaggctggtgaggaagaggaagaaggacctgacccagacagccagcagcacagcccgggccatggaggagctgcaggaccaggagggctgggagtatgccagcctgattggctggaagttccactggaagcagaggagcagtgacaccttcagaagaagacgctggaggaggaagatggcccccagcgagacccacggggctgctgccatcttcaagctggagggcgccctgggcgctgacaccacagaagatggagatgagaagagcctggagaagcagaagcacagcgccaccaccgtgtttggagccaacacccccatcgtgtcctgcaactttgacagagtgtacatctaccacctgcgctgctacgtgtaccaggccaggaacctgctggccctggacaaggacagcttcagtgacccctatgcccacatctgcttcctgcacaggagcaagaccacagagatcatccacagcaccctgaaccccacctgggaccagaccatcatctttgatgaggtggagatctacggggagccccagacagtgctgcagaacccccccaaggtgatcatggagctgtttgacaatgaccaggtgggcaaggatgagttcctgggccgcagcatcttcagccctgtggtgaagctgaacagcgagatggacatcacccccaagctgctgtggcaccctgtgatgaatggagacaaggcctgtggagatgtgctggtgacagctgagctgatcctgcggggcaaggatggcagcaacctgcccatcctgcccccccagagggcccccaacctgtacatggtgccccagggcatccggcctgtggtgcagctgacagccatcgagatcctggcctggggcctgaggaacatgaagaacttccagatggccagcatcaccagccccagcctggtggtggagtgtggcggggagcgggtggagagcgtggtgatcaagaacctgaagaagacccccaacttccccagctctgtgctcttcatgaaggtgttcctgcccaaggaggagctgtacatgccacccctggtgatcaaggtgattgaccaccggcagtttggaaggaagcctgtggtgggccagtgcaccatcgagcggctggaccgcttccgctgtgacccctatgctgggaaggaggacatcgtgccccagctgaaggccagcctgctgagcgccccaccctgccgggacatcgtcatcgagatggaggacaccaagcccctgctggccagcaagctgacagagaaggaggaggagatcgtggactggtggagcaagttctacgccagcagtggagagcacgagaagtgtggccagtacatccagaagggctacagcaagctgaagatctacaactgtgagctggagaatgtggccgagtttgagggcctgacagacttcagtgacaccttcaagctgtaccggggcaagagtgatgaaaatgaagaccccagcgtggtgggggagttcaagggcagcttccgcatctaccccctgcctgatgaccccagcgtgcctgccccaccccggcagttccgggagctgcctgacagcgtgccccaggagtgcaccgtgcgcatctacatcgtgcggggcctggagctgcagccccaggacaacaacggcctgtgtgacccctacatcaagatcaccctgggcaagaaggtgattgaggaccgggaccactacatccccaacaccctgaaccctgtgtttggccgcatgtatgagctgagctgctacctgccccaggagaaggacctgaagatctctgtgtatgactatgacaccttcaccagagatgagaaggtgggggagaccatcatcgacctggagaaccgcttcctgagcagatttggcagccactgcggcatccctgaggagtactgtgtgtctggagtgaacacctggagggaccagctgcggcccacccagctgctgcagaatgtggcccgcttcaagggcttcccccagcccatcctgtctgaagatggcagccgcatccgctatggaggccgggactacagcctggatgaatttgaggccaacaagatcctgcaccagcacctgggcgcccctgaggagcggctggccctgcacatcctgcggacccagggcctggtgcctgagcacgtggagaccaggaccctgcacagcaccttccagcccaacatcagccagggcaagctgcagatgtgggtggatgtgttccccaagagcctgggccccccaggcccccccttcaacatcacccccaggaaggccaagaagtactacctgcgggtcatcatctggaacaccaaggatgtgatcctggatgagaagagcatcaccggggaggagatgtctgacatctacgtgaagggctggatccctggaaatgaggagaacaagcagaagacagatgtgcactaccgcagcctggatggagagggcaacttcaactggaggtttgtgttcccctttgactacctgcctgctgagcagctgtgcatcgtggccaagaaggagcacttctggagcattgaccagacagagttccgcatcccccccaggctcatcatccagatctgggacaatgacaagttcagcctggatgactacctgggcttcctggagctggacctgcggcacaccatcatcccagccaagagccctgagaagtgccgcctggacatgatcccagacctgaaggccatgaaccccctgaaggccaagacagccagcctgtttgagcagaagtccatgaagggctggtggccctgctacgccgagaaggatggagcccgggtgatggccggcaaggtggagatgaccctggagatcctgaatgagaaggaggctgatgagaggcctgctgggaagggcagagatgagcccaacatgaaccccaagctggacctgcccaacagacctgagaccagcttcctgtggttcaccaacccctgcaagaccatgaagttcatcgtgtggaggcgcttcaagtgggtgatcatcggcctgctcttcctgctgatcctgctgctgtttgtggccgtgctgctgtacagcctgcccaactacctgtccatgaagatcgtgaagcccaacgtgtag

SEQ ID NO: 35939 - DNA, 483 bp, Artificial Sequence
  Description of Artificial Sequence: Synthetic coding sequence
atgctgcgggtgattgtggagagcgccagcaacatccccaagaccaagtttgggaagccagaccccatcgtgtctgtcatcttcaaggatgagaagaagaagaccaagaaggtggacaatgagctgaaccctgtgtggaatgagatcctggagtttgacctgcggggcatccccctggacttcagcagcagcctgggcatcatcgtgaaggactttgagaccatcggccagaacaagctgattggaacagccaccgtggccctgaaggacctgaccggggaccagagccgcagcctgccctacaagctgatcagcctgctgaatgagaagggccaggacaccggggccaccatcgacctggtgattggctatgacccccccagcgccccccaccccaatgacctgagcggccccagcgtgcccggcatgggcggcaagctgaccctgctgaaggcccagcccccacctgggggcggctgctag

SEQ ID NO: 35940 - DNA, 1338 bp, Artificial Sequence
  Description of Artificial Sequence: Synthetic coding sequence
atgctgcgggtgattgtggagagcgccagcaacatccccaagaccaagtttgggaagccagaccccatcgtgtctgtcatcttcaaggatgagaagaagaagaccaagaaggtggacaatgagctgaaccctgtgtggaatgagatcctggagtttgacctgcggggcatccccctggacttcagcagcagcctgggcatcatcgtgaaggactttgagaccatcggccagaacaagctgattggaacagccaccgtggccctgaaggacctgaccggggaccagagccgcagcctgccctacaagctgatcagcctgctgaatgagaagggccaggacaccggggccaccatcgacctggtgattggctatgacccccccagcgccccccaccccaatgacctgagcggccccagcgtgcccggcatgggaggagatggagaagaagatgaaggagatgaggaccggctggacaatgctgtgcggggccctggccccaagggccctgtgggcaccgtgtctgaggcccagctggcccggcggctgaccaaggtgaagaacagcaggaggatgctgagcaacaagccccaggacttccagatccgggtgcgggtcatcgagggccggcagctgagcggcaacaacatccggcctgtggtgaaggtgcacgtgtgtggccagacccacaggacccgcatcaagaggggcaacaaccccttctttgatgagctgttcttctacaacgtgaacatgacccccagcgagctgatggatgagatcatcagcatccgggtgtacaacagccacagcctgcgggctgactgcctgatgggagagttcaagattgatgtgggctttgtgtatgatgagcccggccatgctgtgatgaggaagtggctgctgctgaatgaccctgaggacaccagcagcggcagcaagggctacatgaaggtgtccatgtttgtgctgggcactggagatgagcccccacctgagcggcgggaccgggacaatgacagtgatgatgtggagagcaacctgctgctgcctgctggcatcgccctgcgctgggtgaccttcctgctgaagatctacagagctgaggacatcccccagatggatgatgccttcagccagacagtgaaggagatctttggaggaaatgctgacaagaagaacctggtggacccctttgtggaggtgtcctttgctgggaagaaggtgtgcaccaacatcatcgagaagaatgccaaccctgagtggaaccaggtggtgaacctgcagatcaagttccccagcgtgtgtgagaagatcaagctgaccatctatgactggtag

SEQ ID NO: 35941 - DNA, 6186 bp, Artificial Sequence
  Description of Artificial Sequence: Synthetic coding sequence
atgctgcgggtgattgtggagagcgccagcaacatccccaagaccaagtttgggaagccagaccccatcgtgtctgtcatcttcaaggatgagaagaagaagaccaagaaggtggacaatgagctgaaccctgtgtggaatgagatcctggagtttgacctgcggggcatccccctggacttcagcagcagcctgggcatcatcgtgaaggactttgagaccatcggccagaacaagctgattggaacagccaccgtggccctgaaggacctgaccggggaccagagccgcagcctgccctacaagctgatcagcctgctgaatgagaagggccaggacaccggggccaccatcgacctggtgattggctatgacccccccagcgccccccaccccaatgacctgagcggccccagcgtgcccggcatgggaggagatggagaagaagatgaaggagatgaggaccggctggacaatgctgtgcggggccctggccccaagggccctgtgggcaccgtgtctgaggcccagctggcccggcggctgaccaaggtgaagaacagcaggaggatgctgagcaacaagccccaggacttccagatccgggtgcgggtcatcgagggccggcagctgagcggcaacaacatccggcctgtggtgaaggtgcacgtgtgtggccagacccacaggacccgcatcaagaggggcaacaaccccttctttgatgagctgttcttctacaacgtgaacatgacccccagcgagctgatggatgagatcatcagcatccgggtgtacaacagccacagcctgcgggctgactgcctgatgggagagttcaagattgatgtgggctttgtgtatgatgagcccggccatgctgtgatgaggaagtggctgctgctgaatgaccctgaggacaccagcagcggcagcaagggctacatgaaggtgtccatgtttgtgctgggcactggagatgagcccccacctgagcggcgggaccgggacaatgacagtgatgatgtggagagcaacctgctgctgcctgctggcatcgccctgcgctgggtgaccttcctgctgaagatctacagagctgaggacatcccccagatggatgatgccttcagccagacagtgaaggagatctttggaggaaatgctgacaagaagaacctggtggacccctttgtggaggtgtcctttgctgggaagaaggtgtgcaccaacatcatcgagaagaatgccaaccctgagtggaaccaggtggtgaacctgcagatcaagttccccagcgtgtgtgagaagatcaagctgaccatctatgactgggaccggctgaccaagaatgatgtggtgggcaccacctacctgcacctgagcaagattgctgccagcggcggggaggtggaggacttcagcagcagcggcactggagctgccagctacacagtgaacacaggagaaacagaggtgggctttgtgcccaccttcggcccctgctacctgaacctgtatggcagcccccgggagtacacaggcttcccagacccctatgatgagctgaacacaggaaaaggagagggcgtggcctaccggggccgcatcctggtggagctggccaccttcctggagaagaccccaccagacaagaagctggagcccatcagcaatgatgacctgctggtggtggagaagtaccagaggaggaggaagtacagcctgtctgctgtgttccacagcgccaccatgctgcaggatgtgggggaggccatccagtttgaggtgtccatcggcaactacggcaacaagtttgacaccacctgcaagcccctggccagcaccacccagtacagcagagctgtgtttgatggcaactactactactacctgccctgggcccacaccaagcctgtggtgaccctgaccagctactgggaggacatcagccaccggctggatgctgtgaacaccctgctggccatggccgagcggctgcagaccaacatcgaggccctgaagagcggcatccagggcaagatcccagccaaccagctggccgagctgtggctgaagctgattgatgaggtgattgaggacacccgctacaccctgcccctgacagagggcaaggccaacgtgacagtgctggacacccagatcaggaagctgcggagccgcagcctgagccagatccacgaggccgctgtgaggatgaggtctgaggccacagatgtgaagagcaccctggccgagattgaggactggctggacaagctgatgcagctgacagaggagccccagaacagcatgccagacatcatcatctggatgatccggggggagaagaggctggcctatgcccgcatcccagcccaccaggtgctgtacagcaccagcggagaaaatgccagcggcaagtactgtgggaagacccagaccatcttcctgaagtacccccaggagaagaacaacggccccaaggtgcctgtggagctgcgggtgaacatctggctgggcctgtctgctgtggagaagaagttcaacagctttgctgagggcaccttcaccgtgtttgctgagatgtatgagaaccaggccctgatgtttgggaagtggggcaccagcggcctggtgggccgccacaagttcagtgatgtgacaggcaagatcaagctgaagcgggagttcttcctgccccccaagggctgggagtgggagggggagtggatcgtggaccctgagaggagcctgctgacagaagcagatgctggccacacagagttcacagatgaggtgtaccagaatgaaagccgctacccaggaggagactggaagccagctgaggacacctacacagatgccaatggagacaaggccgccagccccagcgagctgacctgccccccaggctgggagtgggaggatgatgcctggagctatgacatcaacagagctgtggatgagaagggctgggagtatggcatcaccatccccccagaccacaagcccaagtcctgggtggccgctgagaagatgtaccacacccacagaagaagaaggctggtgaggaagaggaagaaggacctgacccagacagccagcagcacagcccgggccatggaggagctgcaggaccaggagggctgggagtatgccagcctgattggctggaagttccactggaagcagaggagcagtgacaccttcagaagaagacgctggaggaggaagatggcccccagcgagacccacggggctgctgccatcttcaagctggagggcgccctgggcgctgacaccacagaagatggagatgagaagagcctggagaagcagaagcacagcgccaccaccgtgtttggagccaacacccccatcgtgtcctgcaactttgacagagtgtacatctaccacctgcgctgctacgtgtaccaggccaggaacctgctggccctggacaaggacagcttcagtgacccctatgcccacatctgcttcctgcacaggagcaagaccacagagatcatccacagcaccctgaaccccacctgggaccagaccatcatctttgatgaggtggagatctacggggagccccagacagtgctgcagaacccccccaaggtgatcatggagctgtttgacaatgaccaggtgggcaaggatgagttcctgggccgcagcatcttcagccctgtggtgaagctgaacagcgagatggacatcacccccaagctgctgtggcaccctgtgatgaatggagacaaggcctgtggagatgtgctggtgacagctgagctgatcctgcggggcaaggatggcagcaacctgcccatcctgcccccccagagggcccccaacctgtacatggtgccccagggcatccggcctgtggtgcagctgacagccatcgagatcctggcctggggcctgaggaacatgaagaacttccagatggccagcatcaccagccccagcctggtggtggagtgtggcggggagcgggtggagagcgtggtgatcaagaacctgaagaagacccccaacttccccagctctgtgctcttcatgaaggtgttcctgcccaaggaggagctgtacatgccacccctggtgatcaaggtgattgaccaccggcagtttggaaggaagcctgtggtgggccagtgcaccatcgagcggctggaccgcttccgctgtgacccctatgctgggaaggaggacatcgtgccccagctgaaggccagcctgctgagcgccccaccctgccgggacatcgtcatcgagatggaggacaccaagcccctgctggccagcaagctggtgtccattgaggaggagatcgtggactggtggagcaagttctacgccagcagtggagagcacgagaagtgtggccagtacatccagaagggctacagcaagctgaagatctacaactgtgagctggagaatgtggccgagtttgagggcctgacagacttcagtgacaccttcaagctgtaccggggcaagagtgatgaaaatgaagaccccagcgtggtgggggagttcaagggcagcttccgcatctaccccctgcctgatgaccccagcgtgcctgccccaccccggcagttccgggagctgcctgacagcgtgccccaggagtgcaccgtgcgcatctacatcgtgcggggcctggagctgcagccccaggacaacaacggcctgtgtgacccctacatcaagatcaccctgggcaagaaggtgattgaggaccgggaccactacatccccaacaccctgaaccctgtgtttggccgcatgtatgagctgagctgctacctgccccaggagaaggacctgaagatctctgtgtatgactatgacaccttcaccagagatgagaaggtgggggagaccatcatcgacctggagaaccgcttcctgagcagatttggcagccactgcggcatccctgaggagtactgtgtgtctggagtgaacacctggagggaccagctgcggcccacccagctgctgcagaatgtggcccgcttcaagggcttcccccagcccatcctgtctgaagatggcagccgcatccgctatggaggccgggactacagcctggatgaatttgaggccaacaagatcctgcaccagcacctgggcgcccctgaggagcggctggccctgcacatcctgcggacccagggcctggtgcctgagcacgtggagaccaggaccctgcacagcaccttccagcccaacatcagccagggcaagctgcagatgtgggtggatgtgttccccaagagcctgggccccccaggcccccccttcaacatcacccccaggaaggccaagaagtactacctgcgggtcatcatctggaacaccaaggatgtgatcctggatgagaagagcatcaccggggaggagatgtctgacatctacgtgaagggctggatccctggaaatgaggagaacaagcagaagacagatgtgcactaccgcagcctggatggagagggcaacttcaactggaggtttgtgttcccctttgactacctgcctgctgagcagctgtgcatcgtggccaagaaggagcacttctggagcattgaccagacagagttccgcatcccccccaggctcatcatccagatctgggacaatgacaagttcagcctggatgactacctgggcttcctggagctggacctgcggcacaccatcatcccagccaagagccctgagaagtgccgcctggacatgatcccagacctgaaggccatgaaccccctgaaggccaagacagccagcctgtttgagcagaagtccatgaagggctggtggccctgctacgccgagaaggatggagcccgggtgatggccggcaaggtggagatgaccctggagatcctgaatgagaaggaggctgatgagaggcctgctgggaagggcagagatgagcccaacatgaaccccaagctggacctgcccaacagacctgagaccagcttcctgtggttcaccaacccctgcaagaccatgaagttcatcgtgtggaggcgcttcaagtgggtgatcatcggcctgctcttcctgctgatcctgctgctgtttgtggccgtgctgctgtacagcctgcccaactacctgtccatgaagatcgtgaagcccaacgtgtag

SEQ ID NO: 35942 - DNA, 6156 bp, Artificial Sequence
  Description of Artificial Sequence: Synthetic coding sequence
atgctgcgggtgattgtggagagcgccagcaacatccccaagaccaagtttgggaagccagaccccatcgtgtctgtcatcttcaaggatgagaagaagaagaccaagaaggtggacaatgagctgaaccctgtgtggaatgagatcctggagtttgacctgcggggcatccccctggacttcagcagcagcctgggcatcatcgtgaaggactttgagaccatcggccagaacaagctgattggaacagccaccgtggccctgaaggacctgaccggggaccagagccgcagcctgccctacaagctgatcagcctgctgaatgagaagggccaggacaccggggccaccatcgacctggtgattggctatgacccccccagcgccccccaccccaatgacctgagcggccccagcgtgcccggcatgggaggagatggagaagaagatgaaggagatgaggaccggctggacaatgctgtgcggggccctggccccaagggccctgtgggcaccgtgtctgaggcccagctggcccggcggctgaccaaggtgaagaacagcaggaggatgctgagcaacaagccccaggacttccagatccgggtgcgggtcatcgagggccggcagctgagcggcaacaacatccggcctgtggtgaaggtgcacgtgtgtggccagacccacaggacccgcatcaagaggggcaacaaccccttctttgatgagctgttcttctacaacgtgaacatgacccccagcgagctgatggatgagatcatcagcatccgggtgtacaacagccacagcctgcgggctgactgcctgatgggagagttcaagattgatgtgggctttgtgtatgatgagcccggccatgctgtgatgaggaagtggctgctgctgaatgaccctgaggacaccagcagcggcagcaagggctacatgaaggtgtccatgtttgtgctgggcactggagatgagcccccacctgagcggcgggaccgggacaatgacagtgatgatgtggagagcaacctgctgctgcctgctggcatcgccctgcgctgggtgaccttcctgctgaagatctacagagctgaggacatcccccagatggatgatgccttcagccagacagtgaaggagatctttggaggaaatgctgacaagaagaacctggtggacccctttgtggaggtgtcctttgctgggaagaaggtgtgcaccaacatcatcgagaagaatgccaaccctgagtggaaccaggtggtgaacctgcagatcaagttccccagcgtgtgtgagaagatcaagctgaccatctatgactgggaccggctgaccaagaatgatgtggtgggcaccacctacctgcacctgagcaagattgctgccagcggcggggaggtggaggacttcagcagcagcggcactggagctgccagctacacagtgaacacaggagaaacagaggtgggctttgtgcccaccttcggcccctgctacctgaacctgtatggcagcccccgggagtacacaggcttcccagacccctatgatgagctgaacacaggaaaaggagagggcgtggcctaccggggccgcatcctggtggagctggccaccttcctggagaagaccccaccagacaagaagctggagcccatcagcaatgatgacctgctggtggtggagaagtaccagaggaggaggaagtacagcctgtctgctgtgttccacagcgccaccatgctgcaggatgtgggggaggccatccagtttgaggtgtccatcggcaactacggcaacaagtttgacaccacctgcaagcccctggccagcaccacccagtacagcagagctgtgtttgatggcaactactactactacctgccctgggcccacaccaagcctgtggtgaccctgaccagctactgggaggacatcagccaccggctggatgctgtgaacaccctgctggccatggccgagcggctgcagaccaacatcgaggccctgaagagcggcatccagggcaagatcccagccaaccagctggccgagctgtggctgaagctgattgatgaggtgattgaggacacccgctacaccctgcccctgacagagggcaaggccaacgtgacagtgctggacacccagatcaggaagctgcggagccgcagcctgagccagatccacgaggccgctgtgaggatgaggtctgaggccacagatgtgaagagcaccctggccgagattgaggactggctggacaagctgatgcagctgacagaggagccccagaacagcatgccagacatcatcatctggatgatccggggggagaagaggctggcctatgcccgcatcccagcccaccaggtgctgtacagcaccagcggagaaaatgccagcggcaagtactgtgggaagacccagaccatcttcctgaagtacccccaggagaagaacaacggccccaaggtgcctgtggagctgcgggtgaacatctggctgggcctgtctgctgtggagaagaagttcaacagctttgctgagggcaccttcaccgtgtttgctgagatgtatgagaaccaggccctgatgtttgggaagtggggcaccagcggcctggtgggccgccacaagttcagtgatgtgacaggcaagatcaagctgaagcgggagttcttcctgccccccaagggctgggagtgggagggggagtggatcgtggaccctgagaggagcctgctgacagaagcagatgctggccacacagagttcacagatgaggtgtaccagaatgaaagccgctacccaggaggagactggaagccagctgaggacacctacacagatgccaatggagacaaggccgccagccccagcgagctgacctgccccccaggctgggagtgggaggatgatgcctggagctatgacatcaacagagctgtggatgagaagggctgggagtatggcatcaccatccccccagaccacaagcccaagtcctgggtggccgctgagaagatgtaccacacccacagaagaagaaggctggtgaggaagaggaagaaggacctgacccagacagccagcagcacagcccgggccatggaggagctgcaggaccaggagggctgggagtatgccagcctgattggctggaagttccactggaagcagaggagcagtgacaccttcagaagaagacgctggaggaggaagatggcccccagcgagacccacggggctgctgccatcttcaagctggagggcgccctgggcgctgacaccacagaagatggagatgagaagagcctggagaagcagaagcacagcgccaccaccgtgtttggagccaacacccccatcgtgtcctgcaactttgacagagtgtacatctaccacctgcgctgctacgtgtaccaggccaggaacctgctggccctggacaaggacagcttcagtgacccctatgcccacatctgcttcctgcacaggagcaagaccacagagatcatccacagcaccctgaaccccacctgggaccagaccatcatctttgatgaggtggagatctacggggagccccagacagtgctgcagaacccccccaaggtgatcatggagctgtttgacaatgaccaggtgggcaaggatgagttcctgggccgcagcatcttcagccctgtggtgaagctgaacagcgagatggacatcacccccaagctgctgtggcaccctgtgatgaatggagacaaggcctgtggagatgtgctggtgacagctgagctgatcctgcggggcaaggatggcagcaacctgcccatcctgcccccccagagggcccccaacctgtacatggtgccccagggcatccggcctgtggtgcagctgacagccatcgagatcctggcctggggcctgaggaacatgaagaacttccagatggccagcatcaccagccccagcctggtggtggagtgtggcggggagcgggtggagagcgtggtgatcaagaacctgaagaagacccccaacttccccagctctgtgctcttcatgaaggtgttcctgcccaaggaggagctgtacatgccacccctggtgatcaaggtgattgaccaccggcagtttggaaggaagcctgtggtgggccagtgcaccatcgagcggctggaccgcttccgctgtgacccctatgctgggaaggaggacatcgtgccccagctgaaggccagcctgctgagcgccccaccctgccgggacatcgtcatcgagatggaggacaccaagcccctgctggccagcaagtgcctgagctccatgagcacagccctgagcaagatggccagccctgccaccgtgcacgtgctggatgaggaggaggagatcgtggactggtggagcaagttctacgccagcagcggggagcacgagaagtgtggccagtacatccagaagggctacagcaagctgaagatctacaactgtgagctggagaatgtggccgagtttgagggcctgacagacttcagtgacaccttcaagctgtaccggggcaagagtgatgaaaatgaagaccccagcgtggtgggggagttcaagggcagcttccgcatctaccccctgcctgatgaccccagcgtgcctgccccaccccggcagttccgggagctgcctgattctgtgccccaggagtgcaccgtgcgcatctacatcgtgcggggcctggagctgcagccccaggacaacaacggcctgtgtgacccctacatcaagatcaccctgggcaagaaggtgattgaagatcgggaccactacatccccaacaccctgaaccctgtgtttggaaggatgtatgagctgagctgctacctgccccaggagaaggacctgaagatctctgtgtatgactatgacaccttcaccagagatgagaaggtgggggagaccatcatcgacctggagaaccgcttcctgagccgcttcggcagccactgcggcatccctgaggagtactgtgtgtctggagtgaacacctggagggaccagctgcggcccacccagctgctgcagaatgtggcccgcttcaagggcttcccccagcccatcctgtctgaagatggcagccgcatccgctatggaggccgggactacagcctggatgaatttgaggccaacaagatcctgcaccagcacctgggcgcccctgaggagcggctggccctgcacatcctgcggacccagggcctggtgcctgagcacgtggagaccaggaccctgcacagcaccttccagcccaacatcagccagcgctactacctgcgggtcatcatctggaacaccaaggatgtgatcctggatgagaagagcatcaccggggaggagatgtctgacatctacgtgaagggctggatccctggaaatgaggagaacaagcagaagacagatgtgcactaccgcagcctggatggagagggcaacttcaactggaggtttgtgttcccctttgactacctgcctgctgagcagctgtgcatcgtggccaagaaggagcacttctggagcattgaccagacagagttccgcatcccccccaggctcatcatccagatctgggacaatgacaagttcagcctggatgactacctgggcttcctggagctggacctgcggcacaccatcatcccagccaagagccctgagaagtgccgcctggacatgatcccagacctgaaggccatgaaccccctgaaggccaagacagccagcctgtttgagcagaagtccatgaagggctggtggccctgctacgccgagaaggatggagcccgggtgatggccggcaaggtggagatgaccctggagatcctgaatgagaaggaggctgatgagaggcctgctgggaagggcagagatgagcccaacatgaaccccaagctggacctgcccaacagacctgagaccagcttcctgtggttcaccaacccctgcaagaccatgaagttcatcgtgtggaggcgcttcaagtgggtgatcatcggcctgctcttcctgctgatcctgctgctgtttgtggccgtgctgctgtacagcctgcccaactacctgtccatgaagatcgtgaagcccaacgtgtag

SEQ ID NO: 35943 - DNA, 873 bp, Artificial Sequence
  Description of Artificial Sequence: Synthetic coding sequence
atgcaccccatcaacgtgagaagagaccccagcatccccatctacggcctgcggcagagcatcctgctgaacacccggctgcaggactgctacgtggacagccctgccctgaccaacatctggatggcccggacctgtgccaagcagaacatcaatgccccagccccagccaccaccagctcctgggaggtggtgaggaaccccctcatcgccagcagcttcagcctggtgaagctggtgctgcggcggcagctgaagaacaagtgctgccccccaccctgcaagtttggagagggcaagctgagcaagaggctgaagcacaaggatgattctgtgatgaaggccacccagcaggccaggaagaggaacttcatcagcagcaagagcaagcagcctgctggccaccggcggcctgctgggggcatccgggagagcaaggagagcagcaaggagaagaagctgactgtgcggcaggacctggaggacagatatgcagagcacgtggccgccacccaggccctgccccaggacagcggcacagctgcctggaagggccgggtgctgctgcctgagacccagaagaggcagcagctgtctgaggacaccctgaccatccacggcctgcccacagagggctaccaggccctgtaccacgctgtggtggagcccatgctgtggaaccccagcggcacccccaagcgctacagcctggagctgggcaaggccatcaagcagaagctgtgggaggccctgtgcagccagggcgccatcagcgagggcgcccagagggaccgcttccctggcaggaagcagcccggggtgcatgaggagcctgtgctgaagaagtggcccaagctgaagagcaagaagtag

SEQ ID NO: 35944 - DNA, 813 bp, Artificial Sequence
  Description of Artificial Sequence: Synthetic coding sequence
atgaaggtgacagtgggccctgaccccagcctggtgtacagaccagatgtggaccctgaggtggccaaggacaaggccagcttcaggaactacaccagcggccccctgctggacagagtcttcaccacctacaagctgatgcacacccaccagacagtggactttgtgcgcagcaagcacgcccagtttggaggcttctcctacaagaagatgacagtgatggaggccgtggacctgctggatggcctggtggatgaaagtgaccctgatgtggacttccccaacagcttccacgccttccagacagctgagggcatcaggaaggcccacccagacaaggactggttccacctggtgggcctgctgcatgacctgggcaaggtgctggccctgtttggagagccccagtgggccgtggtgggggacaccttccctgtgggctgccggccccaggcctctgtggtgttctgtgacagcaccttccaggacaacccagacctgcaggacccccgctacagcacagagctgggcatgtaccagccccactgcggcctggacagagtgctgatgtcctggggccatgatgagtacatgtaccaggtgatgaagttcaacaagttcagcctgcccccagaggccttctacatgatccgcttccacagcttctacccctggcacacaggccgggactaccagcagctgtgcagccagcaggacctggccatgctgccctggcaggtgcggcccctgcaccaggtgcccggccctgctggccggggccaggccgccgccctgctgcccggggcccactag

SEQ ID NO: 35945 - DNA, 696 bp, Artificial Sequence
  Description of Artificial Sequence: Synthetic coding sequence
atgaaggtgacagtgggccctgaccccagcctggtgtacagaccagatgtggaccctgaggtggccaaggacaaggccagcttcaggaactacaccagcggccccctgctggacagagtcttcaccacctacaagctgatgcacacccaccagacagtggactttgtgcgcagcaagcacgcccagtttggaggcttctcctacaagaagatgacagtgatggaggccgtggacctgctggatggcctggtggatgaaagtgaccctgatgtggacttccccaacagcttccacgccttccagacagctgagggcatcaggaaggcccacccagacaaggtgcccaacctgccctgccccagccccagccagacaggcagcaccagcagcggcagctgcaccacctggggccgctcctggccctgcagcggcagccccagcggcctgagcagcgccacccccagccccagtgatgctgtgagaagaccaccctggttcagcgccaccccacccagcaggaccaccctgaccagccgcatcctggacacagcccagagcagcggctgcatcagccccaccgtgggcagcacaggcagcagctgccctggggccatgatgcaggtgcggcccctgcaccaggtgcccggccctgctggccggggccaggccgccgccctgctgcccggggcccactag

SEQ ID NO: 35946 - DNA, 798 bp, Artificial Sequence
  Description of Artificial Sequence: Synthetic coding sequence
ggccctgaccccagcctggtgtacagaccagatgtggaccctgaggtggccaaggacaaggccagcttcaggaactacaccagcggccccctgctggacagagtcttcaccacctacaagctgatgcacacccaccagacagtggactttgtgcgcagcaagcacgcccagtttggaggcttctcctacaagaagatgacagtgatggaggccgtggacctgctggatggcctggtggatgaaagtgaccctgatgtggacttccccaacagcttccacgccttccagacagctgagggcatcaggaaggcccacccagacaaggactggttccacctggtgggcctgctgcatgacctgggcaaggtgctggccctgtttggagagccccaggcctctgtggtgttctgtgacagcaccttccaggacaacccagacctgcaggacccccgctacagcacagagctgggcatgtaccagccccactgcggcctggacagagtgctgatgtcctggggccatgatgagtacatgtaccaggtgatgaagttcaacaagttcagcctgcccccagaggccttctacatgatccgcttccacagcttctacccctggcacacaggccgggactaccagcagctgtgcagccagcaggacctggccatgctgccctgggtgcgggagttcaacaagtttgacctgtacaccaagtgcccagacctgcctgatgtggacaagctgcggccctactaccagggcctgattgacaagtactgccccggcatcctgtcctggtag

SEQ ID NO: 35947 - DNA, 2823 bp, Artificial Sequence
  Description of Artificial Sequence: Synthetic coding sequence
atggagattgaccagtgcctgctggagagcctgcccctgggccagaggcagaggctggtgaagaggatgagatgtgagcagatcaaggcctactatgaaagagagaaggccttccagaagcaggagggcttcctgaagaggctgaagcacgccaagaaccccaaggtgcacttcaacctgacagacatgctgcaggatgccatcatccaccacaatgacaaggaggtgctgcggctgctgaaggagggcgctgacccccacaccctggtgagcagcggcggcagcctgctgcacctgtgtgcccgctatgacaatgccttcatcgccgagatcctgattgaccggggcgtgaatgtgaaccaccaggatgaggacttctggacccccatgcacatcgcctgtgcctgtgacaacccagacatcgtgctgctgctggtgctggccggggccaacgtgctgctgcaggatgtgaatggaaacatccccctggactatgctgtggagggcacagagagcagcagcatcctgctgacctacctggatgaaaatggagtggacctgaccagcctgcggcagatgaagctgcagaggcccatgtccatgctgacagatgtgaagcacttcctgagcagcggcggcaatgtgaatgagaagaatgatgagggcgtgaccctgctgcacatggcctgtgccagcggctacaaggaggtggtgtccctcatcctggagcacggcggggacctgaacatcgtggatgaccagtactggacccccctgcacctggccgccaagtatggccagaccaacctggtgaagctgctgctgatgcaccaggccaacccccacctggtgaactgcaatgaggagaaggccagtgacattgctgccagcgagttcatcgaggagatgctgctgaaggccgagatcgcctgggaggagaagatgaaggagcccctgagcgccagcaccctggcccaggaggagccctatgaggagatcatccatgacctgcctgtgctgagcagcaagctgagccccctggtgctgcccatcgccaagcaggacagcctgctggagaaggacatcatgttcaaggatgccaccaagggcctgtgcaagcagcagagccaggacagcatccctgagaaccccatgatgagcggcagcaccaagccagagcaggtgaagctgatgcccccagccccaaatgatgacctggccaccctgtctgagctgaatgatggcagcctgctgtatgagatccagaagagatttggaaacaaccagatctacaccttcatcggggacatcctgctgctggtgaacccctacaaggagctgcccatctacagctccatggtgtcccagctgtacttcagcagcagcggcaagctgtgcagcagcctgcccccccacctgttcagctgtgtggagcgggccttccaccagctgttccgggagcagaggccccagtgcttcatcctgagcggggagcggggcagcggcaagtctgaggccagcaagcagatcatccgccacctgacctgccgggccggggccagccgggccaccctggacagccgcttcaagcacgtggtgtgcatcctggaggcctttggacatgccaagaccaccctgaatgacctgagcagctgcttcatcaagtactttgagctgcagttctgtgagaggaagcagcagctgactggagcccgcatctacacctacctgctggagaagagccggctggtgtcccagcccctgggccagagcaacttcctgatcttctacctgctgatggatggcctgtctgctgaggagaagtatggcctgcacctgaacaacctgtgtgcccaccgctacctgaaccagaccatccaggatgatgccagcactggagagaggagcctgaaccgggagaagctggccgtgctgaagagggccctgaatgtggtgggcttcagcagcctggaggtggagaacctgtttgtgatcctggccgccatcctgcacctgggggacatccgcttcaccgccctgaatgaaggcaacagcgcctttgtgtctgacctgcagctgctggagcaggtggccggcatgctgcaggtgtccacagatgagctggccagcgccctgaccacagacatccagtacttcaagggggacatgatcatccgccgccacaccatccagattgctgagttcttccgggacctgctggccaagagcctgtacagccgcctcttctccttcctggtgaacaccatgaacagctgcctgcacagccaggatgagcagaagtccatgcagaccctggacatcggcatcctggacatcttcggctttgaggagttccagaagaatgaatttgagcagctgtgtgtgaacatgaccaatgagaagatgcaccactacatcaatgaggtgctcttcctgcacgagcaggtggagtgtgtgcaggagggcgtgaccatggagacagcctacagccctggcaaccagaatggagtgctggacttcttcttccagaagcccagcggcttcctgaccctgctggatgaggagagccagatgatctggagcgtggagagcaacttccccaagaagctgcagagcctgctggagagcagcaacaccaatgctgtgtacagccccatgaaggatggaaatggaaatgtggccctgaaggaccacggcacagccttcaccatcatgcactacgccggccgggtgatgtatgatgtggtgggcgccatcgagaagaacaaggacagcctgagccagaacctgctgtttgtgatgaagaggggccgctgcttctag

SEQ ID NO: 35948 - DNA, 5577 bp, Artificial Sequence
  Description of Artificial Sequence: Synthetic coding sequence
atggagattgaccagtgcctgctggagagcctgcccctgggccagaggcagaggctggtgaagaggatgagatgtgagcagatcaaggcctactatgaaagagagaaggccttccagaagcaggagggcttcctgaagaggctgaagcacgccaagaaccccaaggtgcacttcaacctgacagacatgctgcaggatgccatcatccaccacaatgacaaggaggtgctgcggctgctgaaggagggcgctgacccccacaccctggtgagcagcggcggcagcctgctgcacctgtgtgcccgctatgacaatgccttcatcgccgagatcctgattgaccggggcgtgaatgtgaaccaccaggatgaggacttctggacccccatgcacatcgcctgtgcctgtgacaacccagacatcgtgctgctgctggtgctggccggggccaacgtgctgctgcaggatgtgaatggaaacatccccctggactatgctgtggagggcacagagagcagcagcatcctgctgacctacctggatgaaaatggagtggacctgaccagcctgcggcagatgaagctgcagaggcccatgtccatgctgacagatgtgaagcacttcctgagcagcggcggcaatgtgaatgagaagaatgatgagggcgtgaccctgctgcacatggcctgtgccagcggctacaaggaggtggtgtccctcatcctggagcacggcggggacctgaacatcgtggatgaccagtactggacccccctgcacctggccgccaagtatggccagaccaacctggtgaagctgctgctgatgcaccaggccaacccccacctggtgaactgcaatgaggagaaggccagtgacattgctgccagcgagttcatcgaggagatgctgctgaaggccgagatcgcctgggaggagaagatgaaggagcccctgagcgccagcaccctggcccaggaggagccctatgaggagatcatccatgacctgcctgtgctgagcagcaagctgagccccctggtgctgcccatcgccaagcaggacagcctgctggagaaggacatcatgttcaaggatgccaccaagggcctgtgcaagcagcagagccaggacagcatccctgagaaccccatgatgagcggcagcaccaagccagagcaggtgaagctgatgcccccagccccaaatgatgacctggccaccctgtctgagctgaatgatggcagcctgctgtatgagatccagaagagatttggaaacaaccagatctacaccttcatcggggacatcctgctgctggtgaacccctacaaggagctgcccatctacagctccatggtgtcccagctgtacttcagcagcagcggcaagctgtgcagcagcctgcccccccacctgttcagctgtgtggagcgggccttccaccagctgttccgggagcagaggccccagtgcttcatcctgagcggggagcggggcagcggcaagtctgaggccagcaagcagatcatccgccacctgacctgccgggccggggccagccgggccaccctggacagccgcttcaagcacgtggtgtgcatcctggaggcctttggacatgccaagaccaccctgaatgacctgagcagctgcttcatcaagtactttgagctgcagttctgtgagaggaagcagcagctgactggagcccgcatctacacctacctgctggagaagagccggctggtgtcccagcccctgggccagagcaacttcctgatcttctacctgctgatggatggcctgtctgctgaggagaagtatggcctgcacctgaacaacctgtgtgcccaccgctacctgaaccagaccatccaggatgatgccagcactggagagaggagcctgaaccgggagaagctggccgtgctgaagagggccctgaatgtggtgggcttcagcagcctggaggtggagaacctgtttgtgatcctggccgccatcctgcacctgggggacatccgcttcaccgccctgaatgaaggcaacagcgcctttgtgtctgacctgcagctgctggagcaggtggccggcatgctgcaggtgtccacagatgagctggccagcgccctgaccacagacatccagtacttcaagggggacatgatcatccgccgccacaccatccagattgctgagttcttccgggacctgctggccaagagcctgtacagccgcctcttctccttcctggtgaacaccatgaacagctgcctgcacagccaggatgagcagaagtccatgcagaccctggacatcggcatcctggacatcttcggctttgaggagttccagaagaatgaatttgagcagctgtgtgtgaacatgaccaatgagaagatgcaccactacatcaatgaggtgctcttcctgcacgagcaggtggagtgtgtgcaggagggcgtgaccatggagacagcctacagccctggcaaccagaatggagtgctggacttcttcttccagaagcccagcggcttcctgaccctgctggatgaggagagccagatgatctggagcgtggagagcaacttccccaagaagctgcagagcctgctggagagcagcaacaccaatgctgtgtacagccccatgaaggatggaaatggaaatgtggccctgaaggaccacggcacagccttcaccatcatgcactacgccggccgggtgatgtatgatgtggtgggcgccatcgagaagaacaaggacagcctgagccagaacctgctgtttgtgatgaagaccagtgaaaatgtggtgatcaaccacctgttccagagcaagctgagccagacaggcagcctggtgtctgcctaccccagcttcaagttccggggccacaagagcgccctgctgagcaagaagatgacagccagcagcatcattggagagaacaagaactacctggagctgagcaagctgctgaagaagaagggcaccagcaccttcctgcagaggctggagcggggggaccctgtgaccatcgccagccagctgaggaagagcctgatggacatcatcggcaagctgcagaagtgcaccccccacttcatccactgcatccggcccaacaacagcaagctgcctgacacctttgacaacttctacgtgtctgcccagctgcagtacatcggcgtgctggagatggtgaagatcttccgctatggctaccctgtgcggctgtccttcagtgacttcctgagccgctacaagcccctggccgacaccttcctgcgggagaagaaggagcagagcgctgctgagcgctgccgcctggtgctgcagcagtgcaagctgcagggctggcagatgggcgtgaggaaggtgttcctgaagtactggcatgctgaccagctgaatgacctgtgcctgcagctgcagaggaagatcatcacctgccagaaggtgatccggggcttcctggcccggcagcacctgctgcagaggatcagcatccggcagcaggaggtgaccagcatcaacagcttcctgcagaacacagaggacatgggcctgaagacctatgatgccctggtgatccagaatgccagtgacatcgcccgggagaatgaccggctgcggtctgagatgaatgccccctaccacaaggagaagctggaggtgaggaacatgcaggaggagggcagcaagaggacagatgacaagagcggccccaggcacttccaccccagctccatgtctgtgtgtgccgctgtggatggcctgggccagtgcctggtgggccccagcatctggagccccagcctgcacagcgtcttctccatggatgacagcagcagcctgcccagccccaggaagcagcccccacccaagcccaagagggaccccaacacccggctgagcgccagctatgaggccgtgtctgcctgcctgtctgctgcccgggaggccgccaatgaggccctggcccggccccggccccacagtgatgactacagcaccatgaagaagatcccccccaggaagcccaagaggagccccaacaccaagctgagcggcagctatgaggagatcagcggcagcaggcctggagatgcccggcctgctggggcccctggagctgctgcccgggtgctgaccccaggcaccccccagtgtgccctgcccccagctgcccctcctggagatgaagatgacagcgagcctgtgtacatcgagatgctgggccatgctgcccggccagacagcccagaccctggagagagcgtgtatgaggagatgaagtgctgcctgcctgatgatggcggccctggagctggcagcttcctgctgcatggagccagcccccccctgctgcaccgggccccagaagatgaggccgccggccccccaggagatgcctgtgacatccccccacccttccccaacctgctgccccaccggccccccctgctggtgttcccccccacccctgtgacctgcagccctgccagtgatgagagccccctgacccccctggaggtgaagaagctgcctgtgctggagaccaacctgaagtaccctgtgcagcctgagggcagcagccccctgagcccccagtacagcaagagccagaagggagatggagacaggcctgccagccctggcctggccctcttcaacggcagcggccgggccagcccccccagcaccccacctcctcctcctcctcctcctggccccccaccagccccctaccggccctgtgcccacctggccttccccccagagcccgcccctgtgaatgctgggaaggccggccccagcgctgaggcccccaaggtgcaccccaagcccaacagcgcccctgtggccggcccctgcagcagcttccccaagatcccctacagccctgtgaaggccaccagggcagatgccaggaaggccggcagcagcgccagccccccagccccctacagcccccccagcagccggcccctgagcagccccctggatgagctggccagcctcttcaacagcggccgctctgtgctgaggaagtctgctgctggcaggaagatccgggaggccgagggctttgagaccaacatgaacatcagcagcagagatgaccccagcaccagcgagatcaccagcgagacccaggacagaaatgccaacaaccacggcatccagctgagcaacagcctgagcagcgccatcacagcagaaaatggaaacagcatcagcaatggcctgcctgaagaagatggctacagccggctgagcatcagcggcaccggcaccagcaccttccagaggcaccgggacagccacaccacccaggtgatccaccagctgcggctgtctgaaaatgaatctgtggccctgcaggagctgctggactggaggaggaagctgtgtgaggagggccaggactggcagcagatcctgcaccacgccgagccccgggtgcccccacctccaccctgcaagaagcccagcctgctgaagaagccagagggcgccagctgcaaccggctgcccagcgagctgtgggacaccaccatctag

SEQ ID NO: 35949 - DNA, 5577 bp, Artificial Sequence; identical to SEQ ID NO: 35948
  Description of Artificial Sequence: Synthetic coding sequence

SEQ ID NO: 35950 - DNA, 2637 bp, Artificial Sequence
  Description of Artificial Sequence: Synthetic coding sequence
atgaagctgcagaggcccatgtccatgctgacagatgtgctgcacatggcctgtgccagcggctacaaggaggtggtgtccctcatcctggagcacggcggggacctgaacatcgtggatgaccagtactggacccccctgcacctggccgccaagtatggccagaccaacctggtgaagctgctgctgatgcaccaggccaacccccacctggtgaactgcaatgaggagaaggccagtgacattgctgccagcgagttcatcgaggagatgctgctgaaggccgagatcgcctgggaggagaagatgaaggagcccctgagcgccagcaccctggcccaggaggagccctatgaggagatcatccatgacctgcctgtgctgagcagcaagctgagccccctggtgctgcccatcgccaagcaggacagcctgctggagaaggacatcatgttcaaggatgccaccaagggcctgtgcaagcagcagagccaggacagcatccctgagaaccccatgatgagcggcagcaccaagccagagcaggtgaagctgatgcccccagccccaaatgatgacctggccaccctgtctgagctgaatgatggcagcctgctgtatgagatccagaagagatttggaaacaaccagatctacaccttcatcggggacatcctgctgctggtgaacccctacaaggagctgcccatctacagctccatggtgtcccagctgtacttcagcagcagcggcaagctgtgcagcagcctgcccccccacctgttcagctgtgtggagcgggccttccaccagctgttccgggagcagaggccccagtgcttcatcctgagcggggagcggggcagcggcaagtctgaggccagcaagcagatcatccgccacctgacctgccgggccggggccagccgggccaccctggacagccgcttcaagcacgtggtgtgcatcctggaggcctttggacatgccaagaccaccctgaatgacctgagcagctgcttcatcaagtactttgagctgcagttctgtgagaggaagcagcagctgactggagcccgcatctacacctacctgctggagaagagccggctggtgtcccagcccctgggccagagcaacttcctgatcttctacctgctgatggatggcctgtctgctgaggagaagtatggcctgcacctgaacaacctgtgtgcccaccgctacctgaaccagaccatccaggatgatgccagcactggagagaggagcctgaaccgggagaagctggccgtgctgaagagggccctgaatgtggtgggcttcagcagcctggaggtggagaacctgtttgtgatcctggccgccatcctgcacctgggggacatccgcttcaccgccctgaatgaaggcaacagcgcctttgtgtctgacctgcagctgctggagcaggtggccggcatgctgcaggtgtccacagatgagctggccagcgccctgaccacagacatccagtacttcaagggggacatgatcatccgccgccacaccatccagattgctgagttcttccgggacctgctggccaagagcctgtacagccgcctcttctccttcctggtgaacaccatgaacagctgcctgcacagccaggatgagcagaagtccatgcagaccctggacatcggcatcctggacatcttcggctttgaggagttccagaagaatgaatttgagcagctgtgtgtgaacatgaccaatgagaagatgcaccactacatcaatgaggtgctcttcctgcacgagcaggtggagtgtgtgcaggagggcgtgaccatggagacagcctacagccctggcaaccagaatggagtgctggacttcttcttccagaagcccagcggcttcctgaccctgctggatgaggagagccagatgatctggagcgtggagagcaacttccccaagaagctgcagagcctgctggagagcagcaacaccaatgctgtgtacagccccatgaaggatggaaatggaaatgtggccctgaaggaccacggcacagccttcaccatcatgcactacgccggccgggtgatgtatgatgtggtgggcgccatcgagaagaacaaggacagcctgagccagaacctgctgtttgtgatgaagaccagtgaaaatgtggtgatcaaccacctgttccagagcaagctgagccagacaggcagcctggtgtctgcctaccccagcttcaagttccggggccacaagagcgccctgctgagcaagaagatgacagccagcagcatcattggagagaacaagaactacctggagctgagcaagctgctgaagaagaagggcaccagcaccttcctgcagaggctggagcggggggaccctgtgaccatcgccagccagctgaggaagagcctgatggacatcatcggcaagctgcagaagtgcaccccccacttcatccactgcatccggcccaacaacagcaagctgcctgacacctttgacaacttctacgtgtctgcccagctgcagtacatcggcgtgctggagatggtgaagatcttccgctatggctaccctgtgcggctgtccttcagtgacttcctgagcaggtag

SEQ ID NO: 35951 - DNA, 2823 bp, Artificial Sequence
  Description of Artificial Sequence: Synthetic coding sequence
atggagattgaccagtgcctgctggagagcctgcccctgggccagaggcagaggctggtgaagaggatgagatgtgagcagatcaaggcctactatgaaagagagaaggccttccagaagcaggagggcttcctgaagaggctgaagcacgccaagaaccccaaggtgcacttcaacctgacagacatgctgcaggatgccatcatccaccacaatgacaaggaggtgctgcggctgctgaaggagggcgctgacccccacaccctggtgagcagcggcggcagcctgctgcacctgtgtgcccgctatgacaatgccttcatcgccgagatcctgattgaccggggcgtgaatgtgaaccaccaggatgaggacttctggacccccatgcacatcgcctgtgcctgtgacaacccagacatcgtgctgctgctggtgctggccggggccaacgtgctgctgcaggatgtgaatggaaacatccccctggactatgctgtggagggcacagagagcagcagcatcctgctgacctacctggatgaaaatggagtggacctgaccagcctgcggcagatgaagctgcagaggcccatgtccatgctgacagatgtgaagcacttcctgagcagcggcggcaatgtgaatgagaagaatgatgagggcgtgaccctgctgcacatggcctgtgccagcggctacaaggaggtggtgtccctcatcctggagcacggcggggacctgaacatcgtggatgaccagtactggacccccctgcacctggccgccaagtatggccagaccaacctggtgaagctgctgctgatgcaccaggccaacccccacctggtgaactgcaatgaggagaaggccagtgacattgctgccagcgagttcatcgaggagatgctgctgaaggccgagatcgcctgggaggagaagatgaaggagcccctgagcgccagcaccctggcccaggaggagccctatgaggagatcatccatgacctgcctgtgctgagcagcaagctgagccccctggtgctgcccatcgccaagcaggacagcctgctggagaaggacatcatgttcaaggatgccaccaagggcctgtgcaagcagcagagccaggacagcatccctgagaaccccatgatgagcggcagcaccaagccagagcaggtgaagctgatgcccccagccccaaatgatgacctggccaccctgtctgagctgaatgatggcagcctgctgtatgagatccagaagagatttggaaacaaccagatctacaccttcatcggggacatcctgctgctggtgaacccctacaaggagctgcccatctacagctccatggtgtcccagctgtacttcagcagcagcggcaagctgtgcagcagcctgcccccccacctgttcagctgtgtggagcgggccttccaccagctgttccgggagcagaggccccagtgcttcatcctgagcggggagcggggcagcggcaagtctgaggccagcaagcagatcatccgccacctgacctgccgggccggggccagccgggccaccctggacagccgcttcaagcacgtggtgtgcatcctggaggcctttggacatgccaagaccaccctgaatgacctgagcagctgcttcatcaagtactttgagctgcagttctgtgagaggaagcagcagctgactggagcccgcatctacacctacctgctggagaagagccggctggtgtcccagcccctgggccagagcaacttcctgatcttctacctgctgatggatggcctgtctgctgaggagaagtatggcctgcacctgaacaacctgtgtgcccaccgctacctgaaccagaccatccaggatgatgccagcactggagagaggagcctgaaccgggagaagctggccgtgctgaagagggccctgaatgtggtgggcttcagcagcctggaggtggagaacctgtttgtgatcctggccgccatcctgcacctgggggacatccgcttcaccgccctgaatgaaggcaacagcgcctttgtgtctgacctgcagctgctggagcaggtggccggcatgctgcaggtgtccacagatgagctggccagcgccctgaccacagacatccagtacttcaagggggacatgatcatccgccgccacaccatccagattgctgagttcttccgggacctgctggccaagagcctgtacagccgcctcttctccttcctggtgaacaccatgaacagctgcctgcacagccaggatgagcagaagtccatgcagaccctggacatcggcatcctggacatcttcggctttgaggagttccagaagaatgaatttgagcagctgtgtgtgaacatgaccaatgagaagatgcaccactacatcaatgaggtgctcttcctgcacgagcaggtggagtgtgtgcaggagggcgtgaccatggagacagcctacagccctggcaaccagaatggagtgctggacttcttcttccagaagcccagcggcttcctgaccctgctggatgaggagagccagatgatctggagcgtggagagcaacttccccaagaagctgcagagcctgctggagagcagcaacaccaatgctgtgtacagccccatgaaggatggaaatggaaatgtggccctgaaggaccacggcacagccttcaccatcatgcactacgccggccgggtgatgtatgatgtggtgggcgccatcgagaagaacaaggacagcctgagccagaacctgctgtttgtgatgaagaacagacgctgcttctag

SEQ ID NO: 35952 - DNA, 2574 bp, Artificial Sequence
  Description of Artificial Sequence: Synthetic coding sequence
atgagaagagctgacaccagagatggagagcggggcagcggcaagtctgaggccagcaagcagatcatccgccacctgacctgccgggccggggccagccgggccaccctggacagccgcttcaagcacgtggtgtgcatcctggaggcctttggacatgccaagaccaccctgaatgacctgagcagctgcttcatcaagtactttgagctgcagttctgtgagaggaagcagcagctgactggagcccgcatctacacctacctgctggagaagagccggctggtgtcccagcccctgggccagagcaacttcctgatcttctacctgctgatggatggcctgtctgctgaggagaagtatggcctgcacctgaacaacctgtgtgcccaccgctacctgaaccagaccatccaggatgatgccagcactggagagaggagcctgaaccgggagaagctggccgtgctgaagagggccctgaatgtggtgggcttcagcagcctggaggtggagaacctgtttgtgatcctggccgccatcctgcacctgggggacatccgcttcaccgccctgaatgaaggcaacagcgcctttgtgtctgacctgcagctgctggagcaggtggccggcatgctgcaggtgtccacagatgagctggccagcgccctgaccacagacatccagtacttcaagggggacatgatcatccgccgccacaccatccagattgctgagttcttccgggacctgctggccaagagcctgtacagccgcctcttctccttcctggtgaacaccatgaacagctgcctgcacagccaggatgagcagaagtccatgcagaccctggacatcggcatcctggacatcttcggctttgaggagttccagaagaatgaatttgagcagctgtgtgtgaacatgaccaatgagaagatgcaccactacatcaatgaggtgctcttcctgcacgagcaggtggagtgtgtgcaggagggcgtgaccatggagacagcctacagccctggcaaccagaatggagtgctggacttcttcttccagaagcccagcggcttcctgaccctgctggatgaggagagccagatgatctggagcgtggagagcaacttccccaagaagctgcagagcctgctggagagcagcaacaccaatgctgtgtacagccccatgaaggatggaaatggaaatgtggccctgaaggaccacggcacagccttcaccatcatgcactacgccggccgggtgatgtatgatgtggtgggcgccatcgagaagaacaaggacagcctgagccagaacctgctgtttgtgatgaagaccagtgaaaatgtggtgatcaaccacctgttccagagcaagctgagccagacaggcagcctggtgtctgcctaccccagcttcaagttccggggccacaagagcgccctgctgagcaagaagatgacagccagcagcatcattggagagaacaagaactacctggagctgagcaagctgctgaagaagaagggcaccagcaccttcctgcagaggctggagcggggggaccctgtgaccatcgccagccagctgaggaagagcctgatggacatcatcggcaagctgcagaagtgcaccccccacttcatccactgcatccggcccaacaacagcaagctgcctgacacctttgacaacttctacgtgtctgcccagctgcagtacatcggcgtgctggagatggtgaagatcttccgctatggctaccctgtgcggctgtccttcagtgacttcctgagccgctacaagcccctggccgacaccttcctgcgggagaagaaggagcagagcgctgctgagcgctgccgcctggtgctgcagcagtgcaagctgcagggctggcagatgggcgtgaggaaggtgttcctgaagtactggcatgctgaccagctgaatgacctgtgcctgcagctgcagaggaagatcatcacctgccagaaggtgatccggggcttcctggcccggcagcacctgctgcagaggatcagcatccggcagcaggaggtgaccagcatcaacagcttcctgcagaacacagaggacatgggcctgaagacctatgatgccctggtgatccagaatgccagtgacatcgcccgggagaatgaccggctgcggtctgagatgaatgccccctaccacaaggagaagctggaggtgaggaacatgcaggaggagggcagcaagaggacagatgacaagagcggccccaggcacttccaccccagctccatgtctgtgtgtgccgctgtggatggcctgggccagtgcctggtgggccccagcatctggagccccagcctgcacagcgtcttctccatggatgacagcagcagcctgcccagccccaggaagcagcccccacccaagcccaagagggaccccaacacccggctgagcgccagctatgaggccgtgtctgcctgcctgtctgctgcccgggaggccgccaatgaaggccagccctggggcggcacccagccccgggtgcccggcagcaggatgctgtag

SEQ ID NO: 35953 - DNA, 1644 bp, Artificial Sequence
  Description of Artificial Sequence: Synthetic coding sequence
atgagcacagccagcagcagcagcagcagcagcagcagccagaccccccacccccccagccagaggatgagaagatctgctgctggcagccccccagctgtggccgctgctggcagcggaaatggagctgggggcggcggcggcgtgggctgtgccccagctgctggagctggccgcctgctgcagcccatccgggccaccgtgccctaccagctgctgcggggcagccagcacagccccaccaggcctcctgtggccgctgctgctgccagcctgggcagcctgcccggccctggggccgcccggggccccagccccagcagccccaccccacctgctgctgctgccccagctgagcaggccccccgggccaagggccggcccaggaggagccctgagagccaccggcgcagcagcagccctgagaggaggagccctggcagccctgtgtgcagagctgacaaggccaagagccagcaggtgaggaccagcagcaccatccggaggaccagcagcctggacaccatcaccggcccctacctgaccggccagtggccccgggacccccacgtgcactaccccagctgcatgaaggacaaggccacccagacccccagctgctgggccgaggagggcgctgagaagaggagccaccagaggtctgcctcctggggcagcgctgaccagctgaaggagcagatcgccaagctgcggcagcagctgcagaggagcaagcagagcagccgccacagcaaggagaaggaccggcagagccccctgcacggcaaccacatcaccatcagccacacccaggccaccggcagccgctctgtgcccatgcccctgagcaacatctctgtgcccaagagctctgtgtcccgggtgccctgcaatgtggagggcatcagccctgagctggagaaggtgttcatcaaggaaaataatggcaaggaggaggtgtccaagcccctggacatcccagatggccggcgggcccccctgcctgcccactaccgcagcagcagcaccaggagcattgacacccagacccccagcgtgcaggagaggagcagcagctgcagcagccacagcccctgtgtgagccccttctgccccccagagagccaggacggcagcccctgcagcacagaggacctgctgtatgaccgggacaaggacagcggcagcagcagccccctgcccaagtatgccagcagccccaagcccaacaacagctacatgttcaagcgggagcccccagagggctgtgagcgggtgaaggtgtttgaggagatggccagccggcagcccatcagcgcccccctcttcagctgcccagacaagaacaaggtgaacttcatccccaccggcagcgccttctgccctgtgaagctgctgggccccctgctgcctgccagtgacctgatgctgaagaacagccccaacagcggccagagcagcgccctggccaccctgactgtggagcagctgagcagccgggtgtccttcaccagcctgagtgatgacaccagcacagctggctccatggaggcctctgtgcagcagcccagccagcagcagcagctgctgcaggagctgcagggcgaggaccacatcagcgcccagaactacgtgatcatctag

SEQ ID NO: 35954 - DNA, 999 bp, Artificial Sequence
  Description of Artificial Sequence: Synthetic coding sequence
atgggcgcccagttcagcaagacagctgccaagggggaggccgctgctgagaggcctggagaggccgctgtggccagcagccccagcaaggccaacggccaggagaatggccacgtgaaggtgaatggagatgccagccctgctgctgctgagagcggggccaaggaggagctgcaggccaatggaagtgccccagctgctgacaaggaggagcctgctgctgctggcagcggggccgccagccccagcgctgctgagaagggggagcctgctgctgctgctgcccctgaggccggggccagccctgtggagaaggaggccccagctgagggggaggccgctgagcccggcagccccacagctgctgagggggaggccgccagcgctgccagcagcaccagcagccccaaggcagaagatggagccacccccagccccagcaatgagacccccaagaagaagaagaagcgcttctccttcaagaagagcttcaagctgagcggcttctccttcaagaagaacaagaaggaggccggggagggcggggaggccgaggccccagctgctgagggcggcaaggatgaggccgccggcggcgctgctgctgctgctgctgaggccggggccgccagcggggagcaggccgccgcccctggagaggaggccgccgccggggaggagggcgccgccggcggggacccccaggaggccaagccccaggaggccgctgtggcccctgagaagcccccagccagtgatgagaccaaggctgctgaggagcccagcaaggtggaggagaagaaggccgaggaggccggggccagcgctgctgcctgtgaggcccccagcgctgctggccctggggcccctcctgagcaggaggccgccccagctgaggagcctgctgctgctgctgccagcagcgcctgtgccgcccccagccaggaggcccagcctgagtgcagccctgaggcccccccagctgaggccgctgagtag

SEQ ID NO: 35955 - DNA, 978 bp, Artificial Sequence
  Description of Artificial Sequence: Synthetic coding sequence
atggccgaggtgcccccaggccccagcagcctgctgcccccaccagcccccccagccccagctgctgtggagccccgctgccccttccctgctggagctgccctggcctgctgcagtgaagatgaggagcagcagcagctgaatggcctcatcagccctgagctgcggcacctgcgggctgctgccagcctgaagagcaaggtgctgtctgtggccgaggtggccgccaccacagccaccccagatggcggcccccgggccacagccaccaagggagctggggtgcacagcggggagaggcctccccacagcctgagcagcaatgccaggacagctgtgcccagccctgtggaggccgctgctgccagtgaccctgctgctgccagaaatggcctggccgagggcacagagcaggaggaggaggaggaggatgagcaggtgcggctgctgagcagcagcctgacagctgactgcagcctgcggagccccagcggccgggaggtggagcccggggaggacaggaccatccgctacgtgcgctatgaaagtgagctgcagatgccagacatcatgaggctcatcaccaaggacctgtctgagccctacagcatctacacctaccgctacttcatccacaactggccccagctgtgcttcctggccatggtgggggaggagtgtgtgggcgccatcgtgtgcaagctggacatgcacaagaagatgttcagaagaggctacatcgccatgctggccgtggacagcaagtacagaagaaatggaattggcaccaacctggtgaagaaggccatctatgccatggtggagggggactgtgatgaggtggtgctggagacagagatcaccaacaagagcgccctgaagctgtatgagaacctgggctttgtgcgggacaagaggctcttccgctactacctgaatggagtggatgccctgcggctgaagctgtggctgaggtag

SEQ ID NO: 35956 - DNA, 1089 bp, Artificial Sequence
  Description of Artificial Sequence: Synthetic coding sequence
atggccgaggtgcccccaggccccagcagcctgctgcccccaccagcccccccagccccagctgctgtggagccccgctgccccttccctgctggagctgccctggcctgctgcagtgaagatgaagaagatgatgaggagcacgagggcggcggcagccgcagccctgctggaggagagagcgccaccgtggccgccaagggccacccctgcctgcgctgcccccagcccccccaggagcagcagcagctgaatggcctcatcagccctgagctgcggcacctgcgggccgccgccagcctgaagagcaaggtgctgtctgtggccgaggtggccgccaccacagccaccccagatggcggcccccgggccacagccaccaagggggccggcgtgcacagcggggagcggcccccccacagcctgagcagcaatgccaggacagctgtgcccagccctgtggaggccgccgccgccagtgaccctgctgctgccagaaatggcctggccgagggcacagagcaggaggaggaggaggaggatgagcaggtgcggctgctgagcagcagcctgacagctgactgcagcctgcggagccccagcggccgggaggtggagcctggagaggacaggaccatccgctacgtgcgctatgagagcgagctgcagatgccagacatcatgaggctcatcaccaaggacctgtctgagccctacagcatctacacctaccgctacttcatccacaactggccccagctgtgcttcctggccatggtgggggaggagtgtgtgggcgccatcgtgtgcaagctggacatgcacaagaagatgttccggcggggctacatcgccatgctggccgtggacagcaagtacagaagaaatggcatcggcaccaacctggtgaagaaggccatctatgccatggtggagggggactgtgatgaggtggtgctggagacagagatcaccaacaagagcgccctgaagctgtatgagaacctgggctttgtgcgggacaagaggctcttccgctactacctgaatggagtggatgccctgcggctgaagctgtggctgaggtag

SEQ ID NO: 35957 - DNA, 2178 bp, Artificial Sequence
  Description of Artificial Sequence: Synthetic coding sequence
atggtgatgaaggcctctgtggatgatgatgacagcggctgggagctgtccatgcctgagaagatggagaagagcaacaccaactgggtggacatcacccaggactttgaggaggcctgccgggagctgaagctgggggagctgctgcatgacaagctgtttggcctgtttgaggccatgtctgccatcgagatgatggaccccaagatggatgctggcatgattggcaaccaggtgaacaggaaggtgctgaactttgagcaggccatcaaggatggcaccatcaagatcaaggacctgaccctgcctgagctgattggcatcatggacacctgcttctgctgcctgatcacctggctggagggccacagcctggcccagaccgtcttcacctgcctgtacatccacaacccagacttcatcgaggaccctgccatgaaggcctttgccctgggcatcctgaagatctgtgacatcgcccgggagaaggtgaacaaggctgctgtgtttgaggaggaggacttccagagcatgacctacggcttcaagatggccaacagcgtgacagacctgcgggtgacaggcatgctgaaggatgtggaggatgacatgcagaggagagtgaagagcaccaggagccggcagggcgaggagcgggaccctgaggtggagctggagcaccagcagtgcctggccgtgttcagccgggtgaagttcaccagggtgctgctgactgtgctgattgccttcaccaagaaggagaccagcgctgtggccgaggcccagaagctgatggtgcaggccgctgacctgctgagcgccatccacaacagcctgcaccacggcatccaggcccagaatgacaccaccaagggggaccaccccatcatgatgggctttgagcccctggtgaaccagaggctgctgccccccaccttccccaggtatgccaagatcatcaagcgggaggagatggtgaactactttgcccggctgattgaccgcatcaagacagtgtgtgaggtggtgaacctgaccaacctgcactgcatcctggacttcttctgtgagttcagcgagcagagcccctgtgtgctgagccgcagcctgctgcagaccaccttcctggtggacaacaagaaggtgtttggcacccacctgatgcaggacatggtgaaggatgccctgcggagctttgtgagcccccctgtgctgagccccaagtgctacctgtacaacaaccaccaggccaaggactgcatcgacagctttgtgacccactgtgtgcggcccttctgcagcctcatccagatccacggccacaacagagcccggcagagggacaagctgggccacatcctggaggagtttgccaccctgcaggatgaggccgagaaggtggatgctgccctgcacaccatgctgctgaagcaggagccccagaggcagcacctggcctgcctgggcacctgggtgctgtaccacaacctgcgcatcatgatccagtacctgctgagcggctttgagctggagctgtacagcatgcatgagtactactacatctactggtacctgtctgagttcctgtatgcctggctgatgagcaccctgagcagagcagatggcagccagatggccgaggagcgcatcatggaggagcagcagaagggccgcagcagcaagaagaccaagaagaagaagaaggtgcggcccctgagccgggagatcaccatgagccaggcctaccagaacatgtgtgccggcatgttcaagaccatggtggcctttgacatggatggcaaggtgaggaagcccaagtttgagctggacagcgagcaggtgcgctatgagcacagatttgcccccttcaacagcgtgatgaccccacctcctgtgcactacctgcagttcaaggagatgtctgacctgaacaagtacagccccccaccccagagccctgagctgtatgtggccgccagcaagcacttccagcaggccaagatgatcctggagaacatccccaacccagaccacgaggtgaaccgcatcctgaaggtggccaagcccaactttgtggtgatgaagctgctggccggcggccacaagaaggagagcaaggtgcccccagagtttgacttcagcgcccacaagtacttccctgtggtgaagctggtgtag

SEQ ID NO: 35958 - DNA, 885 bp, Artificial Sequence
  Description of Artificial Sequence: Synthetic coding sequence
atggtgatgaaggcctctgtggatgatgatgacagcggctgggagctgtccatgcctgagaagatggagaagagcaacaccaactgggtggacatcacccaggactttgaggaggcctgccgggagctgaagctgggggagctgctgcatgacaagctgtttggcctgtttgaggccatgtctgccatcgagatgatggaccccaagatggatgctggcatgattggcaaccaggtgaacaggaaggtgctgaactttgagcaggccatcaaggatggcaccatcaagatcaaggacctgaccctgcctgagctgattggcatcatggacacctgcttctgctgcctgatcacctggctggagggccacagcctggcccagaccgtcttcacctgcctgtacatccacaacccagacttcatcgaggaccctgccatgaaggcctttgccctgggcatcctgaagatctgtgacatcgcccgggagaaggtgaacaaggctgctgtgtttgaggaggaggacttccagagcatgacctacggcttcaagatggccaacagcgtgacagacctgcgggtgacaggcatgctgaaggatgtggaggatgacatgcagaggagagtgaagagcaccaggagccggcagggcgaggagcgggaccctgaggtggagctggagcaccagcagtgcctggccgtgttcagccgggtgaagttcaccagggtgctgctgactgtgctgattgccttcaccaagaaggagaccagcgctgtggccgaggcccagaagctgatggtgcaggccgctgacctgctgagcgccatccacaacagcctgcaccacggcatccaggcccagaatgacaccaccaagggcggcctgtag

SEQ ID NO: 35959 - DNA, 594 bp, Artificial Sequence
  Description of Artificial Sequence: Synthetic coding sequence
atggtgatgaaggcctctgtggatgatgatgacagcggctgggagctgtccatgcctgagaagatggagaagagcaacaccaactgggtggacatcacccaggactttgaggaggcctgccgggagctgaagctgggggagctgctgcatgacaagctgtttggcctgtttgaggccatgtctgccatcgagatgatggaccccaagatggatgctggcatgattggcaaccaggtgaacaggaaggtgctgaactttgagcaggccatcaaggatggcaccatcaagatcaaggacctgaccctgcctgagctgattggcatcatggacacctgcttctgctgcctgatcacctggctggagggccacagcctggcccagaccgtcttcacctgcctgtacatccacaacccagacttcatcgaggaccctgccatgaaggcctttgccctgggcatcctgaagatctgtgacatcgcccgggagaaggtgaacaaggctgctgtgtttgaggagatcagccggctgctggagctgattgacttccacgagtacaacttcaagaatgaaaatgtgcagtgctggaaggagtag

SEQ ID NO: 35960 - DNA, 1857 bp, Artificial Sequence
  Description of Artificial Sequence: Synthetic coding sequence
atggtgagccccaggatgagcggcctgctgagccagaccgtcatcctggccctgatcttcctgccccagaccaggcctgctggggtgtttgagctgcagatccacagctttggacctggccctggccctggggcccccaggagcccctgcagcgcccggctgccctgccgcctcttcttccgggtgtgcctgaagccaggcctgtctgaggaggccgctgagagcccctgtgccctgggcgccgccctgagcgcccggggccctgtgtacacagagcagcccggggccccagccccagacctgcccctgcctgatggcctgctgcaggtgcccttcagagatgcctggccaggcaccttctccttcatcatcgagacctggagggaggagctgggggaccagattggaggccctgcctggagcctgctggcccgggtggccggcagaagaaggctggccgccggcggcccctgggcccgggacatccagagagctggggcctgggagctgcgcttctcctaccgggcccgctgtgagcccccagctgtgggcacagcctgcacccggctgtgccggcccaggtctgcccccagccgctgtggccctggcctgcggccctgtgcccccctggaggatgaatgtgaggcccccctggtgtgccgggccggctgcagccctgagcacggcttctgtgagcagcccggggagtgccgctgcctggagggctggacaggccccctgtgcaccgtgcctgtgtccaccagcagctgcctgagcccccggggccccagcagcgccaccaccggctgcctggtgcccggccctggcccctgtgatggcaacccctgtgccaatggaggcagctgcagcgagacccccaggagctttgaatgtacctgcccccggggcttctacggcctgcgctgtgaggtgtctggagtgacctgtgctgatggcccctgcttcaatggaggcctgtgtgtgggcggcgctgaccctgattctgcctacatctgccactgccccccaggcttccagggcagcaactgtgagaagagggtggaccgctgcagcctgcagccctgcagaaatggaggcctgtgcctggacctgggccacgccctgcgctgccgctgcagagctggctttgctggcccccgctgtgaacatgacctggatgactgtgccggccgggcctgtgccaacggcggcacctgtgtggagggcggcggggcccaccgctgcagctgtgccctgggctttggaggccgggactgccgggagagagctgacccctgtgccgcccggccctgtgcccacggcggccgctgctacgcccacttcagcggcctggtgtgtgcctgtgcccctggctacatgggcgcccgctgtgagttccctgtgcacccagatggagccagcgccctgcctgctgcccctcctggcctgcggcctggggacccccagcgctacctgctgcccccagccctgggcctgctggtggccgccggcgtggccggggccgccctgctgctggtgcacgtgagaagaagaggccacagccaggatgctggcagccggctgctggccggcaccccagagcccagcgtgcacgccctgcctgatgccctgaacaacctgcggacccaggagggcagcggagatggccccagcagctctgtggactggaacagaccagaagatgtggacccccagggcatctacgtgatcagcgcccccagcatctatgcccgggaggtggccacccccctcttcccccccctgcacacaggccgggccggccagaggcagcacctgctcttcccctaccccagcagcatcctgtctgtgaagtag

SEQ ID NO: 35961 - DNA, 2181 bp, Artificial Sequence
  Description of Artificial Sequence: Synthetic coding sequence
atgtctgccatcaccgtggccctgctgagcctgctcttcatcaccagcggcaccatcgagaaccacaaggacctgggcggccacttcttcagcaccacccagagccccccagccacccagggcagcacagctgcccagaggagcacagccacccagcacagcacagccacccagagcagcacagccacccagaccagccctgtgcccctgaccccagagagccccctcttccagaacttcagcggctaccacatcggcgtgggccgggctgactgcaccggccaggtggccgacatcaacctgatgggctacggcaagagcggccagaatgcccagggcatcctgacccggctgtacagccgggccttcatcatggccgagccagatggcagcaacagaacagtgtttgtgtccattgatattggcatggtgtcccagaggctgcggctggaggtgctgaaccggctgcagagcaaatatggcagcctgtacagaagagacaacgtcatcctgagcggcacccacacccacagcggccctgctggctacttccagtacacagtgtttgtgattgccagcgagggcttcagcaaccagaccttccagcacatggtgacaggcatcctgaagagcattgacatcgcccacaccaacatgaagccaggcaagatcttcatcaacaagggaaatgtggatggagtgcagatcaacagaagcccctacagctacctgcagaacccccagagcgagcgggcccgctacagcagcaacacagacaaggagatgattgtgctgaagatggtggacctgaatggagatgacctgggcctcatctcctggtttgccatccaccctgtgtccatgaacaacagcaaccacctggtgaacagcgacaacgtgggctacgccagctacctgctggagcaggagaagaacaagggctacctgcccggccagggcccctttgtggccgcctttgccagcagcaacctgggagatgtgagccccaacatcctgggcccccgctgcatcaacacaggagagagctgtgacaatgccaacagcacctgccccatcggcggccccagcatgtgcatcgccaagggccctggccaggacatgtttgacagcacccagatcatcggccgggccatgtaccagagggccaagagcaagacctgcaagccagccctgggctacagctttgctgctggcaccattgatggagtgggcggcctgaacttcacccagggcaagacagaaggagaccccttctgggacaccatccgggaccagatcctgggcaagcccagcgaggagatcaaggagtgccacaagcccaagcccatcctgctgcacactggagagctgagcaagccccacccctggcacccagacatcgtggatgtgcagatcatcaccctgggcagcctggccatcacagccatccctggagagttcaccaccatgtctggaagaaggctgcgggaggccgtgcaggccgagtttgccagccacggcatgcagaacatgacagtggtgatcagcggcctgtgcaatgtgtacacccactacatcaccacctatgaggagtaccaggcccagagatatgaagctgccagcaccatctacggcccccacaccctgagcgcctacatccagctgttcaggaacctggccaaggccatcgccacagacacagtggccaacctgagccggggccctgagccccccttcttcaagcagctgattgtgcccctcatccccagcatcgtggaccgggcccccaagggccgcacctttggagatgtgctgcagcctgccaagccagagtacagagtgggggaggtggccgaggtgatctttgtgggcgccaaccccaagaacagcgtgcagaaccagacccaccagaccttcctgactgtggagaagtatgaggccaccagcacctcctggcagatcgtgtgcaatgatgcctcctgggagacccgcttctactggcacaagggcctgctgggcctgagcaatgccaccgtggagtggcacatcccagacacagcccagcccggcatctaccgcatccgctacttcggccacaacaggaagcaggacatcctgaagccagctgtgatcctgagctttgagggcaccagccctgcctttgaggtggtgaccatctag

SEQ ID NO: 35962 - DNA, 723 bp, Artificial Sequence
  Description of Artificial Sequence: Synthetic coding sequence
atgagcggccggcggctgcgggaggccgtgcaggccgagtttgccagccacggcatgcagaacatgacagtggtgatcagcggcctgtgcaatgtgtacacccactacatcaccacctatgaggagtaccaggcccagagatatgaggccgccagcaccatctacggcccccacaccctgagcgcctacatccagctgttcaggaacctggccaaggccatcgccacagacacagtggccaacctgagccggggccctgagccccccttcttcaagcagctgattgtgcccctcatccccagcatcgtggaccgggcccccaagggccgcacctttggagatgtgctgcagcctgccaagccagagtacagagtgggggaggtggccgaggtgatctttgtgggcgccaaccccaagaacagcgtgcagaaccagacccaccagaccttcctgactgtggagaagtatgaggccaccagcacctcctggcagatcgtgtgcaatgatgcctcctgggagacccgcttctactggcacaagggcctgctgggcctgagcaatgccaccgtggagtggcacatcccagacacagcccagcccggcatctaccgcatccgctacttcggccacaacaggaagcaggacatcctgaagccagctgtgatcctgagctttgagggcaccagccctgcctttgaggtgcccaacagcggcctgcactag

SEQ ID NO: 35963 - DNA, 2343 bp, Artificial Sequence
  Description of Artificial Sequence: Synthetic coding sequence
atggccaagaggaccttcagcaacctggagaccttcctgatcttcctgctggtgatgatgtctgccatcaccgtggccctgctgagcctgctcttcatcaccagcggcaccatcgagaaccacaaggacctgggcggccacttcttcagcaccacccagagccccccagccacccagggcagcacagctgcccagaggagcacagccacccagcacagcacagccacccagagcagcacagccacccagaccagccctgtgcccctgaccccagagagccccctcttccagaacttcagcggctaccacatcggcgtgggccgggctgactgcaccggccaggtggccgacatcaacctgatgggctacggcaagagcggccagaatgcccagggcatcctgacccggctgtacagccgggccttcatcatggccgagccagatggcagcaacagaacagtgtttgtgtccattgacatcggcatggtgtcccagaggctgcggctggaggtgctgaaccggctgcagagcaaatatggcagcctgtaccgccgggacaacgtcatcctgagcggcacccacacccacagcggccctgctggctacttccagtacacagtgtttgtgattgccagcgagggcttcagcaaccagaccttccagcacatggtgacaggcatcctgaagagcattgatattgcccacaccaacatgaagccaggcaagatcttcatcaacaagggaaatgtggatggagtgcagatcaacagaagcccctacagctacctgcagaacccccagagcgagcgggcccgctacagcagcaacacagacaaggagatgattgtgctgaagatggtggacctgaatggagatgacctgggcctcatctcctggtttgccatccaccctgtgtccatgaacaacagcaaccacctggtgaacagcgacaacgtgggctacgccagctacctgctggagcaggagaagaacaagggctacctgcccggccagggcccctttgtggccgcctttgccagcagcaacctgggagatgtgagccccaacatcctgggcccccgctgcatcaacacaggagagagctgtgacaatgccaacagcacctgccccatcggcggccccagcatgtgcatcgccaagggccctggccaggacatgtttgacagcacccagatcatcggccgggccatgtaccagagggccaaggagctgtatgccagcgccagccaggaggtgacaggccccctggccagcgcccaccagtgggtggacatgacagatgtgacagtgtggctgaacagcacccacgccagcaagacctgcaagccagccctgggctacagctttgctgctggcaccattgatggagtgggcggcctgaacttcacccagggcaagacagaaggagaccccttctgggacaccatccgggaccagatcctgggcaagcccagcgaggagatcaaggagtgccacaagcccaagcccatcctgctgcacactggagagctgagcaagccccacccctggcacccagacatcgtggatgtgcagatcatcaccctgggcagcctggccatcacagccatccctggagagttcaccaccatgtctggaagaaggctgcgggaggccgtgcaggccgagtttgccagccacggcatgcagaacatgacagtggtgatcagcggcctgtgcaatgtgtacacccactacatcaccacctatgaggagtaccaggcccagagatatgaagctgccagcaccatctacggcccccacaccctgagcgcctacatccagctgttcaggaacctggccaaggccatcgccacagacacagtggccaacctgagccggggccctgagccccccttcttcaagcagctgattgtgcccctcatccccagcatcgtggaccgggcccccaagggccgcacctttggagatgtgctgcagcctgccaagccagagtacagagtgggggaggtggccgaggtgatctttgtgggcgccaaccccaagaacagcgtgcagaaccagacccaccagaccttcctgactgtggagaagtatgaggccaccagcacctcctggcagatcgtgtgcaatgatgcctcctgggagacccgcttctactggcacaagggcctgctgggcctgagcaatgccaccgtggagtggcacatcccagacacagcccagcccggcatctaccgcatccgctacttcggccacaacaggaagcaggacatcctgaagccagctgtgatcctgagctttgagggcaccagccctgcctttgaggtggtgaccatctag

SEQ ID NO: 35964 - DNA, 1869 bp, Artificial Sequence
  Description of Artificial Sequence: Synthetic coding sequence
atggattctgagaagagcagcgagtggaggagtgatgtgctgaaccggctgcagagcaaatatggcagcctgtaccgccgggacaacgtcatcctgagcggcacccacacccacagcggccctgctggctacttccagtacacagtgtttgtgattgccagcgagggcttcagcaaccagaccttccagcacatggtgacaggcatcctgaagagcattgatattgcccacaccaacatgaagccaggcaagatcttcatcaacaagggaaatgtggatggagtgcagatcaacagaagcccctacagctacctgcagaacccccagagcgagcgggcccgctacagcagcaacacagacaaggagatgattgtgctgaagatggtggacctgaatggagatgacctgggcctcatctcctggtttgccatccaccctgtgtccatgaacaacagcaaccacctggtgaacagcgacaacgtgggctacgccagctacctgctggagcaggagaagaacaagggctacctgcccggccagggcccctttgtggccgcctttgccagcagcaacctgggagatgtgagccccaacatcctgggcccccgctgcatcaacacaggagagagctgtgacaatgccaacagcacctgccccatcggcggccccagcatgtgcatcgccaagggccctggccaggacatgtttgacagcacccagatcatcggccgggccatgtaccagagggccaaggagctgtatgccagcgccagccaggaggtgacaggccccctggccagcgcccaccagtgggtggacatgacagatgtgacagtgtggctgaacagcacccacgccagcaagacctgcaagccagccctgggctacagctttgctgctggcaccattgatggagtgggcggcctgaacttcacccagggcaagacagaaggagaccccttctgggacaccatccgggaccagatcctgggcaagcccagcgaggagatcaaggagtgccacaagcccaagcccatcctgctgcacactggagagctgagcaagccccacccctggcacccagacatcgtggatgtgcagatcatcaccctgggcagcctggccatcacagccatccctggagagttcaccaccatgtctggaagaaggctgcgggaggccgtgcaggccgagtttgccagccacggcatgcagaacatgacagtggtgatcagcggcctgtgcaatgtgtacacccactacatcaccacctatgaggagtaccaggcccagagatatgaagctgccagcaccatctacggcccccacaccctgagcgcctacatccagctgttcaggaacctggccaaggccatcgccacagacacagtggccaacctgagccggggccctgagccccccttcttcaagcagctgattgtgcccctcatccccagcatcgtggaccgggcccccaagggccgcacctttggagatgtgctgcagcctgccaagccagagtacagagtgggggaggtggccgaggtgatctttgtgggcgccaaccccaagaacagcgtgcagaaccagacccaccagaccttcctgactgtggagaagtatgaggccaccagcacctcctggcagatcgtgtgcaatgatgcctcctgggagacccgcttctactggcacaagggcctgctgggcctgagcaatgccaccgtggagtggcacatcccagacacagcccagcccggcatctaccgcatccgctacttcggccacaacaggaagcaggacatcctgaagccagctgtgatcctgagctttgagggcaccagccctgcctttgaggtggtgaccatctag

SEQ ID NO: 35965 - DNA, 2238 bp, Artificial Sequence
  Description of Artificial Sequence: Synthetic coding sequence
atggccaagaggaccttcagcaacctggagaccttcctgatcttcctgctggtgatgatgtctgccatcaccgtggccctgctgagcctgctcttcatcaccagcggcaccatcgagaaccacaaggacctgggcggccacttcttcagcaccacccagagccccccagccacccagggcagcacagctgcccagaggagcacagccacccagcacagcacagccacccagagcagcacagccacccagaccagccctgtgcccctgaccccagagagccccctcttccagaacttcagcggctaccacatcggcgtgggccgggctgactgcaccggccaggtggccgacatcaacctgatgggctacggcaagagcggccagaatgcccagggcatcctgacccggctgtacagccgggccttcatcatggccgagccagatggcagcaacagaacagtgtttgtgtccattgacatcggcatggtgtcccagaggctgcggctggaggtgctgaaccggctgcagagcaaatatggcagcctgtaccgccgggacaacgtcatcctgagcggcacccacacccacagcggccctgctggctacttccagtacacagtgtttgtgattgccagcgagggcttcagcaaccagaccttccagcacatggtgacaggcatcctgaagagcattgatattgcccacaccaacatgaagccaggcaagatcttcatcaacaagggaaatgtggatggagtgcagatcaacagaagcccctacagctacctgcagaacccccagagcgagcgggcccgctacagcagcaacacagacaaggagatgattgtgctgaagatggtggacctgaatggagatgacctgggcctcatctcctggtttgccatccaccctgtgtccatgaacaacagcaaccacctggtgaacagcgacaacgtgggctacgccagctacctgctggagcaggagaagaacaagggctacctgcccggccagggcccctttgtggccgcctttgccagcagcaacctgggagatgtgagccccaacatcctgggcccccgctgcatcaacacaggagagagctgtgacaatgccaacagcacctgccccatcggcggccccagcatgtgcatcgccaagggccctggccaggacatgtttgacagcacccagatcatcggccgggccatgtaccagagggccaagagcaagacctgcaagccagccctgggctacagctttgctgctggcaccattgatggagtgggcggcctgaacttcacccagggcaagacagaaggagaccccttctgggacaccatccgggaccagatcctgggcaagcccagcgaggagatcaaggagtgccacaagcccaagcccatcctgctgcacactggagagctgagcaagccccacccctggcacccagacatcgtggatgtgcagatcatcaccctgggcagcctggccatcacagccatccctggagagttcaccaccatgagcggccggcggctgcgggaggccgtgcaggccgagtttgccagccacggcatgcagaacatgacagtggtgatcagcggcctgtgcaatgtgtacacccactacatcaccacctatgaggagtaccaggcccagagatatgaggccgccagcaccatctacggcccccacaccctgagcgcctacatccagctgttcaggaacctggccaaggccatcgccacagacacagtggccaacctgagccggggccctgagccccccttcttcaagcagctgattgtgcccctcatccccagcatcgtggaccgggcccccaagggccgcacctttggagatgtgctgcagcctgccaagccagagtacagagtgggggaggtggccgaggtgatctttgtgggcgccaaccccaagaacagcgtgcagaaccagacccaccagaccttcctgactgtggagaagtatgaggccaccagcacctcctggcagatcgtgtgcaatgatgcctcctgggagacccgcttctactggcacaagggcctgctgggcctgagcaatgccaccgtggagtggcacatcccagacacagcccagcccggcatctaccgcatccgctacttcggccacaacaggaagcaggacatcctgaagccagctgtgatcctgagctttgagggcaccagccctgcctttgaggtggtgaccatctag

SEQ ID NO: 35966 - DNA, 840 bp, Artificial Sequence
  Description of Artificial Sequence: Synthetic coding sequence
atgctgctggccgccagcaaggtgctggaccggctgaagcctgtgattggagtgaacacagatcctgagaggtctgagggccacctgtgcctgcctgtgcgctacacccacagcttccctgaggccctgcagaagttctacagaggagagttccgctggctgtggaggcagaggatccggctgtacctggagggcaccggcatcaaccctgtgcctgtggacctgcacgagcagcagctgagcctgaaccagcacaacagagccctgaacatcgagcgggcccatgatgagaggtctgaggccagcggcccccagctgctgcctgtgcgggccctgaatgaggtgttcatcggggagagcctgagcagccgggccagctactatgagatctctgtggatgatggcccctgggagaagcagaagagcagcggcctgaacctgtgcacaggaacaggcagcaaggcctggagcttcaacatcaacagagtggccacccaggccgtggaggatgtgctgaacatcgccaagaggcagggcaacctgagcctgcccctgaaccgggagctggtggagaaggtgaccaatgagtacaatgaaagcctgctgtacagccctgaggagcccaagatcctcttcagcatccgggagcccatcgccaacagagtcttcagcagcagccggcagcgctgcttcagcagcaaggtgtgtgtgcgcagccgctgctgggatgcctgcatggtggtggatggcggcaccagctttgagttcaatgatggagccatcgcctccatgatgatcaacaaggaggatgagctgaggacagtgctgctggagcagtag

SEQ ID NO: 35967 - DNA, 1329 bp, Artificial Sequence
  Description of Artificial Sequence: Synthetic coding sequence
atgacctgctaccggggcttcctgctgggcagctgctgccgggtggccggcggccgggctgctgccctgcggggccctggggccggcggccctgctgcccggccccggctgggcggagatggcggcggccgccgccacctgggccagggccagccccgggagctggccggctgcggcagcagagcagatggcggcttccggcccagccgggtggtggtggtggccaagaccaccaggtatgaatttgagcagcagcgctaccgctatgcagagctgtctgaggaggacctgaagcagctgctggccctgaagggcagcagctacagcggcctgctggagcggcaccacatccacaccaagaatgtggagcacatcatcgacagcctgagaaatgaaggcatcgaggtgcggctggtgaagagaagagaatatgatgaggagaccgtgcgctgggcagatgctgtgattgctgctggaggagatggcaccatgctgctggccgccagcaaggtgctggaccggctgaagcctgtgattggagtgaacacagatcctgagaggtctgagggccacctgtgcctgcctgtgcgctacacccacagcttccctgaggccctgcagaagttctacagaggagagttccgctggctgtggaggcagaggatccggctgtacctggagggcaccggcatcaaccctgtgcctgtggacctgcacgagcagcagctgagcctgaaccagcacaacagagccctgaacatcgagcgggcccatgatgagaggtctgaggccagcggcccccagctgctgcctgtgcgggccctgaatgaggtgttcatcggggagagcctgagcagccgggccagctactatgagatctctgtggatgatggcccctgggagaagcagaagagcagcggcctgaacctgtgcaccggcaccggcagcaaggcctggagcttcaacatcaacagagtggccacccaggccgtggaggatgtgctgaacatcgccaagaggcagggcaacctgagcctgcccctgaaccgggagctggtggagaaggtgaccaatgagtacaatgaaagcctgctgtacagccctgaggagcccaagatcctcttcagcatccgggagcccatcgccaacagagtcttcagcagcagccggcagcgctgcttcagcagcaaggtgtgtgtgcgcagccgctgctgggatgcctgcatggtggtggatggcggcaccagctttgagttcaatgatggagccatcgcctccatgatgatcaacaaggaggatgagctgaggacagtgctgctggagcagtag

SEQ ID NO: 35968 - DNA, 840 bp, Artificial Sequence; identical to SEQ ID NO: 35966
  Description of Artificial Sequence: Synthetic coding sequence

SEQ ID NO: 35969 - DNA, 906 bp, Artificial Sequence
  Description of Artificial Sequence: Synthetic coding sequence
atgctgctggccgccagcaaggtgctggaccggctgaagcctgtgattggagtgaacacagatcctgagaggtctgagggccacctgtgcctgcctgtgcgctacacccacagcttccctgaggccctgcagaagttctacagaggagagttccgctggctgtggaggcagaggatccggctgtacctggagggcaccggcatcaaccctgtgcctgtggacctgcacgagcagcagctgagcctgaaccagcacaacagagccctgaacatcgagcgggcccatgatgagaggtctgaggccagcggcccccagctgctgcctgtgcgggccctgaatgaggtgttcatcggggagagcctgagcagcaggatgagctacagctgggccgtggccgtggacaacctgcggcgcagcatccccaccctgaagggcctggccagctactatgagatctctgtggatgatggcccctgggagaagcagaagagcagcggcctgaacctgtgcacaggaacaggcagcaaggcctggagcttcaacatcaacagagtggccacccaggccgtggaggatgtgctgaacatcgccaagaggcagggcaacctgagcctgcccctgaaccgggagctggtggagaaggtgaccaatgagtacaatgaaagcctgctgtacagccctgaggagcccaagatcctcttcagcatccgggagcccatcgccaacagagtcttcagcagcagccggcagcgctgcttcagcagcaaggtgtgtgtgcgcagccgctgctgggatgcctgcatggtggtggatggcggcaccagctttgagttcaatgatggagccatcgcctccatgatgatcaacaaggaggatgagctgaggacagtgctgctggagcagtag

SEQ ID NO: 35970 - DNA, 1233 bp, Artificial Sequence
  Description of Artificial Sequence: Synthetic coding sequence
atgacctgctaccggggcttcctgctgggcagctgctgccgggtggccggcggccgggctgctgccctgcggggccctggggccggcggccctgctgcccggccccggctgggcggagatggcggcggccgccgccacctgggccagggccagccccgggagctggccggctgcggcagcagagcagatggcggcttccggcccagccgggtggtggtggtggccaagaccaccaggtatgaatttgagcagcagcgctaccgctatgcagagctgtctgaggaggacctgaagcagctgctggccctgaagggcagcagctacagcggcctgctggagcggcaccacatccacaccaagaatgtggagcacatcatcgacagcctgagaaatgaaggcatcgaggtgcggctggtgaagagaagagaatatgatgaggagaccgtgcgctgggcagatgctgtgattgctgctggaggagatggcaccatgctgctggccgccagcaaggtgctggaccggctgaagcctgtgattggagtgaacacagatcctgagaggtctgagggccacctgtgcctgcctgtgcgctacacccacagcttccctgaggccctgcagaagttctacagaggagagttccgctggctgtggaggcagaggatccggctgtacctggagggcaccggcatcaaccctgtgcctgtggacctgcacgagcagcagctgagcctgaaccagcacaacagagccctgaacatcgagcgggcccatgatgagaggtctgaggccagcggcccccagctgctgcctgtgcgggccctgaatgaggtgttcatcggggagagcctgagcagccgctccttcaacatcaacagagtggccacccaggccgtggaggatgtgctgaacatcgccaagaggcagggcaacctgagcctgcccctgaaccgggagctggtggagaaggtgaccaatgagtacaatgaaagcctgctgtacagccctgaggagcccaagatcctcttcagcatccgggagcccatcgccaacagagtcttcagcagcagccggcagcgctgcttcagcagcaaggtgtgtgtgcgcagccgctgctgggatgcctgcatggtggtggatggcggcaccagctttgagttcaatgatggagccatcgcctccatgatgatcaacaaggaggatgagctgaggacagtgctgctggagcagtag

SEQ ID NO: 35971 - DNA, 192 bp, Artificial Sequence
  Description of Artificial Sequence: Synthetic coding sequence
atggagctggtgcaggtgctgaagaggggcctgcagcagatcactggacatggaggcctgcggggctacctgcgggtcttcttccgcaccaatgatgccaaggtgggcaccctggtgggggaggacaagtatggcaacaagtactatgaggacaacaagcagttcttcggcatcgtgggcttcaccgtgtag

SEQ ID NO: 35972 - DNA, 438 bp, Artificial Sequence
  Description of Artificial Sequence: Synthetic coding sequence
atggagctggtgcaggtgctgaagaggggcctgcagcagatcactggacatggaggcctgcggggctacctgcgggtcttcttccgcaccaatgatgccaaggtgggcaccctggtgggggaggacaagtatggcaacaagtactatgaggacaacaagcagttcttcggccgccaccgctgggtggtgtacaccacagagatgaatggcaagaacaccttctgggatgtggatggctccatggtgcccccagagtggcaccgctggctgcacagcatgacagatgatcctcccaccaccaagcccctgacagccaggaagttcatctggaccaaccacaagttcaacgtgacaggcaccccagagcagtatgtgccctacagcaccaccaggaagaagatccaggagtggatcccccccagcaccccctacaagtag

SEQ ID NO: 35973 - DNA, 255 bp, Artificial Sequence
  Description of Artificial Sequence: Synthetic coding sequence
atggccgcccgggtgggcgccttcctgaagaatgcctgggacaaggagcctgtgctggtggtgtcctttgtggtgggcggcctggccgtcatcctgccccccctgagcccctacttcaagtacagcgtgatgatcaacaaggccaccccctacaactaccctgtgcctgtgagagatgatggcaacatgccagatgtgcccagccacccccaggacccccagggccccagcctggagtggctgaagaagctgtag

SEQ ID NO: 35974 - DNA, 255 bp, Artificial Sequence; identical to SEQ ID NO: 35973
  Description of Artificial Sequence: Synthetic coding sequence

SEQ ID NO: 35975 - DNA, 255 bp, Artificial Sequence; identical to SEQ ID NO: 35973
  Description of Artificial Sequence: Synthetic coding sequence

SEQ ID NO: 35976 - DNA, 246 bp, Artificial Sequence
  Description of Artificial Sequence: Synthetic coding sequence
atgctgcggcagatcatcggccaggccaagaagcaccccagcctcatccccctgtttgtgttcatcggcaccggggccactggagccaccctgtacctgctgcggctggccctcttcaacccagatgtgtgctgggacaggaacaaccctgagccctggaacaagctgggccccaatgaccagtacaagttctacagcgtgaatgtggactacagcaagctgaagaaggagaggccagacttctag

SEQ ID NO: 35977 - DNA, 171 bp, Artificial Sequence
  Description of Artificial Sequence: Synthetic coding sequence
atccctgtggccatcttcatcaccctggtgaatgtgttcatcggccaggccgagctggccgagatccctgagggctacgtgcctgagcactgggagtactacaagggcaaaggagctggcagcgccaagattgatgcctgtgaaagacgctggaccctggtgctgctgtag

SEQ ID NO: 35978 - DNA, 318 bp, Artificial Sequence
  Description of Artificial Sequence: Synthetic coding sequence
atgatctgctggaggcaccccagcgccccctgtggccgcggggagtggcaggtgcccaggagccagctgcccctggcccgggtggagttccctgtggccctgggcctgggcgtggccgtgggcgctgaggccgccgccatcatggtgaacctgctgcagatcgtgcgggaccactgggtgcacgtgctggtgcccatgggcttcgtcatcggctgctacctggacaggaagagtgatgagcggctgacagccttcaggaacaagtccatgctgttcaagcgggagctgcagcccagcgaggaggtgacctggaagtag

SEQ ID NO: 35979 - DNA, 177 bp, Artificial Sequence
  Description of Artificial Sequence: Synthetic coding sequence
atggtgaacctgctgcagatcgtgcgggaccactgggtgcacgtgctggtgcccatgggctttgtgattggctgctacctggacaggaagagtgatgagcggctgacagccttcaggaacaagtccatgctgttcaagcgggagctgcagcccagcgaggaggtgacctggaagtag

SEQ ID NO: 35980 - DNA, 177 bp, Artificial Sequence; identical to SEQ ID NO: 35979
  Description of Artificial Sequence: Synthetic coding sequence

SEQ ID NO: 35981 - DNA, 288 bp, Artificial Sequence
  Description of Artificial Sequence: Synthetic coding sequence
atggagagccatgagcggcagcccctggtgctgcacgaggagatgggagaatgtcgcagcagcctgtctgctgggggcggcgtgcacatcgagccccgctaccggcagttcccccagctgaccaggagccaggtgttccagagcgagttcttcagcggcctgatgtggttctggatcctgtggaggttctggcatgattctgaggaggtgctgggccacttcccctacccagaccccagccagtggacagatgaggagctgggcatccccccagatgatgaggactag

SEQ ID NO: 35982 - DNA, 318 bp, Artificial Sequence
  Description of Artificial Sequence: Synthetic coding sequence
atgtctgccctgacccggctggccagctttgcccgggtgggcggccgcctcttccgcagcggctgtgccaggacagctggagatggcggcgtgagacatgctgggggcggcgtgcacatcgagccccgctaccggcagttcccccagctgaccaggagccaggtgttccagagcgagttcttcagcggcctgatgtggttctggatcctgtggaggttctggcatgattctgaggaggtgctgggccacttcccctacccagaccccagccagtggacagatgaggagctgggcatccccccagatgatgaggactag

SEQ ID NO: 35983 - DNA, 315 bp, Artificial Sequence
  Description of Artificial Sequence: Synthetic coding sequence
tctgccctgacccggctggccagctttgcccgggtgggcggccgcctcttccgcagcggctgtgccaggacagctggagatggaggagtgagacatgctgggggcggcgtgcacatcgagccccgctaccggcagttcccccagctgaccaggagccaggtgttccagagcgagttcttcagcggcctgatgtggttctggatcctgtggaggttctggcatgacagcgaggaggtgctgggccacttcccctacccagaccccagccagtggacagatgaggagctgggcatccccccagatgatgaagattag

SEQ ID NO: 35984 - DNA, 318 bp, Artificial Sequence; identical to SEQ ID NO: 35982
  Description of Artificial Sequence: Synthetic coding sequence

SEQ ID NO: 35985 - DNA, 318 bp, Artificial Sequence; identical to SEQ ID NO: 35982
  Description of Artificial Sequence: Synthetic coding sequence

SEQ ID NO: 35986 - DNA, 390 bp, Artificial Sequence
  Description of Artificial Sequence: Synthetic coding sequence
atgtccttccccaagtacaagcccagcagcctgcggaccctgcctgagaccctggaccctgctgagtacaacatcagccctgagacccggcgggcccaggccgagcggctggccatccgggcccagctgaagcgggagtacctgctgcagtacaatgaccccaacagaagaggcctgattgaaaatcctgccctgctgcgctgggcctatgcccggaccatcaacgtgtaccccaacttccggcccacccccaagaacagcctgatgggcgccctgtgtggcttcggccccctcatcttcatctactacatcatcaagacagagcgggacaggaaggagaagctgatccaggagggcaagctggacaggaccttccacctgagctactag

SEQ ID NO: 35987 - DNA, 363 bp, Artificial Sequence
  Description of Artificial Sequence: Synthetic coding sequence
atgtccttccccaagtacaagcccagcagcctgcggaccctgcctgagaccctggaccctgctgagtacaacatcagccctgagacccggcgggcccaggccgagcggctggccatccgggcccagctgaagcgggagtacctgctgcagtacaatgaccccaacagaagaggcctgattgaaaatcctgccctgctgcgctgggcctatgcccggaccatcaacgtgtaccccaacttccggcccacccccaagaacagcctgatgggcgccctgtgtggcttcggccccctcatcttcatctactacatcatcaagacagagcgggtgtccatccagacccgctgcctggtgtttgaatag

SEQ ID NO: 35988 - DNA, 570 bp, Artificial Sequence
  Description of Artificial Sequence: Synthetic coding sequence
atggccgccatgagcctgctgcggcgggtgtctgtgacagctgtggccgccctgagcggccggcccctgggcacccggctgggctttggaggcttcctgacccggggcttccccaaggctgctgcccctgtgcgccacagcggggaccacggcaagaggctgtttgtgatccggcccagccgcttctatgaccggcgcttcctgaagctgctgcgcttctacatcgccctgaccggcatccctgtggccatcttcatcaccctggtgaatgtgttcatcggccaggccgagctggccgagatccctgagggctacgtgcctgagcactgggagtactacaagcaccccatcagccgctggatcgccaggaacttctatgacagccctgagaagatctatgaaagaaccatggctgtgctgcagatcgaggccgagaaggccgagctgcgggtgaaggagctggaggtgaggaagctgatgcacgtgagaggagatggcccctggtactactatgagaccatcgacaaggagctgattgaccacagccccaaggccaccccagacaactag

SEQ ID NO: 35989 - DNA, 414 bp, Artificial Sequence
  Description of Artificial Sequence: Synthetic coding sequence
atggccgccatgagcctgctgcggcgggtgtctgtgacagctgtggccgccctgagcggccggcccctgggcacccggctgggctttggaggcttcctgacccggggcttccccaaggctgctggccaggccgagctggccgagatccctgagggctacgtgcctgagcactgggagtactacaagcaccccatcagccgctggatcgccaggaacttctatgacagccctgagaagatctatgaaagaaccatggctgtgctgcagatcgaggccgagaaggccgagctgcgggtgaaggagctggaggtgaggaagctgatgcacgtgagaggagatggcccctggtactactatgagaccatcgacaaggagctgattgaccacagccccaaggccaccccagacaactag

SEQ ID NO: 35990 - DNA, 342 bp, Artificial Sequence
  Description of Artificial Sequence: Synthetic coding sequence
atgacaggctacaccccagatgagaagctgcggctgcagcagctgcgggagctgcggcggcgctggctgaaggaccaggagctgagcccccgggagcctgtgctgcccccccagaagatgggccccatggagaagttctggaacaagttcctggagaacaagagcccctggaggaagatggtgcacggcgtgtacaagaagagcatctttgtgttcacccacgtgctggtgcctgtgtggatcatccactactacatgaagtaccacgtgtctggggacaccatcctggagaccggggaggtgattcctcccatgaaggagttcccagaccagcaccactag

SEQ ID NO: 35991 - DNA, 291 bp, Artificial Sequence
  Description of Artificial Sequence: Synthetic coding sequence
atgattgccaggagaaatcctgagcccctgcgcttcctgcctgatgaggcccggagcctgcccccacccaagctgacagacccccggctgctgtacatcggcttcctgggctactgcagcggcctgattgacaacctgatcagaagaagacccatcgccacagctgactacctgtatgctgtgcgggaccgggagatgtttggctacatgaagctgcaccctgaggacttccctgaggaggacaagaagacctatggagagatctttgagaagttccaccccatcagatag

SEQ ID NO: 35992 - DNA, 267 bp, Artificial Sequence
  Description of Artificial Sequence: Synthetic coding sequence
atgattgccaggagaaatcctgagcccctgcgcttcctgcctgatgaggcccggagcctgcccccacccaagctgacagacccccggctgctgtacatcggcttcctgggctactgcagcggcctgattgacaacctgatcagaagaagacccatcgccacagctggcctgcaccggcagctgctgtacatcacagccttcttctttgctggctactacctggtgaagctggaggcctatgccaacctgtatgtggacaccctgtag

SEQ ID NO: 35993 - DNA, 360 bp, Artificial Sequence
  Description of Artificial Sequence: Synthetic coding sequence
atgattgccaggagaaatcctgagcccctgcgcttcctgcctgatgaggcccggagcctgcccccacccaagctgacagacccccggctgctgtacatcggcttcctgggctactgcagcggcctgattgacaacctgatcagaagaagacccatcgccacagctggcctgcaccggcagctgctgtacatcacagccttcttctttgctggctactacctggtgaagcgggaggactacctgtatgctgtgcgggaccgggagatgtttggctacatgaagctgcaccctgaggacttccctgaggaggacaagaagacctacggggagatctttgagaagttccaccccatcagatag

SEQ ID NO: 35994 - DNA, 231 bp, Artificial Sequence
  Description of Artificial Sequence: Synthetic coding sequence
atgattgccaggagaaatcctgagcccctgcgcttcctgcctgatgaggcccggagcctgcccccacccaagctgacagacccccggctgctgtacatcggcttcctgggctactgcagcggcctgattgacaacctgatcagaagaagacccatcgccacagctggcctgcaccggcagctgctgtacatcacagccttcttctgctggatcctgagctgcaagacctag

SEQ ID NO: 35995 - DNA, 1032 bp, Artificial Sequence
  Description of Artificial Sequence: Synthetic coding sequence
atgtctgtgctgctgcggagcggcctgggccccctgtgtgctgtggcccgggccgccatccccttcatctggaggggcaagtacttcagcagtggaaatgaaccagcagaaaatcctgtgacccccatgctgcggcacctgatgtacaagatcaagagcacaggccccatcaccgtggccgagtacatgaaggaggtgctgaccaacccagccaagctgctgggcatctggttcatcagcgagtggatggccaccgggaagagcacagccttccagctggtggagctgggccctggccggggcaccctggtgggggacatcctgcgggtcttcacccagctgggctctgtgctgaagaactgtgacatctctgtgcacctggtggagaagaccccccagggctggagggaggtgtttgtggacatcgacccccaggtgtctgacaagctgcgctttgtgctggcccccagcgccaccccagctgaggccttcatccagcatgatgagacccgggaccacgtggaggtgtgcccagatgctggggtcatcatcgaggagctgagccagagaattgccctgaccggcggggccgccctggtggccgactatggccatgatggcaccaagacagacaccttccggggcttctgtgaccacaagctgcatgatgtgctgattgcccctggaacagctgacctgacagcagatgtggacttctcctacctgcggaggatggcccagggcaaggtggccagcctgggccccatcaagcagcacaccttcctgaagaacatgggcattgatgtgcggctgaaggtgctgctggacaagagcaatgagcccagcgtgcggcagcagctgctgcagggctatgacatgctgatgaaccccaagaagatgggagagcgcttcaacttctttgccctgctgccccaccagaggctgcagggcggccgctaccagagaaatgcccggcagagcaagccctttgcctctgtggtggccggcttcagcgagctggcctggcagtag

SEQ ID NO: 35996 - DNA, 1452 bp, Artificial Sequence
  Description of Artificial Sequence: Synthetic coding sequence
atggccagcctgggggacctggtgcgggcctggcacctgggcgcccaggccgtggacagaggagactgggcccgggccctgcacctgttctctggagtgcctgcccccccagcccggctgtgcttcaatgccggctgtgtgcacctgctggccggggaccctgaggccgccctgcgggcctttgaccaggccgtgaccaaggacacctgcatggctgtgggcttcttccagaggggcgtggccaacttccagctggcccgcttccaggaggccctgagtgacttctggctggccctggagcagctgcggggccacgccgccatcgactacacccagctgggcctgcgcttcaagctgcaggcctgggaggtgctgcacaacgtggccagcgcccagtgccagctgggcctgtggacagaagctgccagcagcctgcgggaggccatgagcaagtggccagagggcagcctgaatggcctggacagcgccctggaccaggtgcagaggcggggcagcctgcccccccggcaggtgcccagaggagaggtgttccggccccaccgctggcacctgaagcacctggagcctgtggacttcctgggcaaggccaaggtggtggccagcgccatcccagatgaccagggctggggcgtgcggccccagcagccccagggccctggggccaaccatgatgcccggagcctcatcatggacagcccccgggccggcacccaccagggccccctggatgctgagacagaggtgggcgctgaccgctgcaccagcacagcctaccaggagcagaggccccaggtggagcaggtgggcaagcaggcccccctgagccctggcctgcctgccatgggcggccctggccctggcccctgtgaagatcctgctggggccggcggggccggggccggcggcagcgagcccctggtgacagtgacagtgcagtgtgccttcaccgtggccctgcgggccaggagaggagctgacctgagcagcctgcgggccctgctgggccaggccctgccccaccaggcccagctgggccagctgagctacctggcccctggagaagatggccactgggtgcccatccctgaggaggagagcctgcagagggcctggcaggatgctgctgcctgcccccggggcctgcagctgcagtgcagaggagctgggggccggcctgtgctgtaccaggtggtggcccagcacagctacagcgcccagggccctgaggacctgggcttccggcagggcgacacagtggatgtgctgtgtgaggagccagatgtgcccctggccgtggaccaggcctggctggagggccactgtgatggccgcatcggcatcttccccaagtgctttgtggtgcctgctggccccaggatgtctggggcccctggccgcctgcccaggagccagcagggcgaccagccctag

SEQ ID NO: 35997 - DNA, 1284 bp, Artificial Sequence
  Description of Artificial Sequence: Synthetic coding sequence
atggccagcctgggggacctggtgcgggcctggcacctgggcgcccaggccgtggacagaggagactgggcccgggccctgcacctgttctctggagtgcctgcccccccagcccggctgtgcttcaatgccggctgtgtgcacctgctggccggggaccctgaggccgccctgcgggcctttgaccaggccgtgaccaaggacacctgcatggctgtgggcttcttccagaggggcgtggccaacttccagctggcccgcttccaggaggccctgagtgacttctggctggccctggagcagctgcggggccacgccgccatcgactacacccagctgggcctgcgcttcaagctgcaggcctgggaggtgctgcacaacgtggccagcgcccagtgccagctgggcctgtggacagaagctgccagcagcctgcgggaggccatgagcaagtggccagagggcagcctgaatggcctggacagcgccctggaccaggtgcagggccctggggccaaccatgatgcccggagcctcatcatggacagcccccgggccggcacccaccagggccccctggatgctgagacagaggtgggcgctgaccgctgcaccagcacagcctaccaggagcagaggccccaggtggagcaggtgggcaagcaggcccccctgagccctggcctgcctgccatgggcggccctggccctggcccctgtgaagatcctgctggggccggcggggccggggccggcggcagcgagcccctggtgacagtgacagtgcagtgtgccttcaccgtggccctgcgggccaggagaggagctgacctgagcagcctgcgggccctgctgggccaggccctgccccaccaggcccagctgggccagctgagctacctggcccctggagaagatggccactgggtgcccatccctgaggaggagagcctgcagagggcctggcaggatgctgctgcctgcccccggggcctgcagctgcagtgcagaggagctgggggccggcctgtgctgtaccaggtggtggcccagcacagctacagcgcccagggccctgaggacctgggcttccggcagggcgacacagtggatgtgctgtgtgaggagccagatgtgcccctggccgtggaccaggcctggctggagggccactgtgatggccgcatcggcatcttccccaagtgctttgtggtgcctgctggccccaggatgtctggggcccctggccgcctgcccaggagccagcagggcgaccagccctag

SEQ ID NO: 35998 - DNA, 1113 bp, Artificial Sequence
  Description of Artificial Sequence: Synthetic coding sequence
atggccggcccccgctaccctgtgtctgtgcagggcgccgccctggtgcagatcaagaggctgcagacctttgccttctctgtgcgctggagcgatggcagtgacacctttgtgagaagatcctgggatgagttccggcagctgaagaccctgaaggagaccttccctgtggaggccggcctgctgcggcggagtgacagagtgctgcccaagctgctggatgcccccctgctgggccgggtgggccgcaccagccggggcctggcccggctgcagctgctggagacctacagccggcggctgctggccacagctgagcgggtggcccggagccccaccatcaccggcttctttgccccccagcccctggacctggagcccgccctgcccccaggcagcagggtcatcctgcccaccccagaggagcagcccctgagcagagctgctggccgcctgagcatccacagcctggaggcccagagcctgcgctgcctgcagcccttctgcacccaggacacccgggaccggcccttccaggcccaggcccaggagagcctggatgtgctgctgcggcaccccagcggctggtggctggtggagaatgaagatcggcagacagcctggttccctgccccctacctggaggaggccgcccctggccagggccgggagggcggccccagcctgggcagcagcggcccccagttctgtgccagccgggcctatgagagcagcagagcagatgagctgtctgtgcctgctggggcccgggtgcgggtgctggagaccagtgaccggggctggtggctgtgccgctatggagacagagctggcctgctgcctgctgtgctgctgcggcctgagggcctgggcgccctgctgtctggaacaggcttcagaggaggagatgatcctgctggggaggcccggggcttccctgagcccagccaggccacagcccccccacccaccgtgcccacccggcccagccctggggccatccagagccgctgctgcaccgtgacccggcgggccctggagcggcggccccggcggcagggccggccccggggctgtgtggacagcgtgccccaccccaccacagagcagtag

SEQ ID NO: 35999 - DNA, 1116 bp, Artificial Sequence
  Description of Artificial Sequence: Synthetic coding sequence
atggccggcccccgctaccctgtgtctgtgcagggcgccgccctggtgcagatcaagaggctgcagacctttgccttctctgtgcgctggagcgatggcagtgacacctttgtgagaagatcctgggatgagttccggcagctgaagaagaccctgaaggagaccttccctgtggaggccggcctgctgcggcggagtgacagagtgctgcccaagctgctggatgcccccctgctgggccgggtgggccgcaccagccggggcctggcccggctgcagctgctggagacctacagccggcggctgctggccacagctgagcgggtggcccggagccccaccatcaccggcttctttgccccccagcccctggacctggagcccgccctgcccccaggcagcagggtcatcctgcccaccccagaggagcagcccctgagcagagctgctggccgcctgagcatccacagcctggaggcccagagcctgcgctgcctgcagcccttctgcacccaggacacccgggaccggcccttccaggcccaggcccaggagagcctggatgtgctgctgcggcaccccagcggctggtggctggtggagaatgaagatcggcagacagcctggttccctgccccctacctggaggaggccgcccctggccagggccgggagggcggccccagcctgggcagcagcggcccccagttctgtgccagccgggcctatgagagcagcagagcagatgagctgtctgtgcctgctggggcccgggtgcgggtgctggagaccagtgaccggggctggtggctgtgccgctacggggaccgggccggcctgctgcctgctgtgctgctgcggcctgagggcctgggcgccctgctgagcggcaccggcttcagaggaggagatgatcctgctggggaggcccggggcttccctgagcccagccaggccacagcccccccacccaccgtgcccacccggcccagccctggggccatccagagccgctgctgcaccgtgacccggcgggccctggagcggcggccccggcggcagggccggccccggggctgtgtggacagcgtgccccaccccaccacagagcagtag

SEQ ID NO: 36000 - DNA, 1131 bp, Artificial Sequence
  Description of Artificial Sequence: Synthetic coding sequence
atggccggcccccgctaccctgtgtctgtgcagggcgccgccctggtgcagatcaagaggctgcagacctttgccttctctgtgcgctggagcgatggcagtgacacctttgtgagaagatcctgggatgagttccggcagctgaagaagaccctgaaggagaccttccctgtggaggccggcctgctgcggcggagtgacagagtgctgcccaagctgctgggccaggccagcctggatgcccccctgctgggccgggtgggccgcaccagccggggcctggcccggctgcagctgctggagacctacagccggcggctgctggccacagctgagcgggtggcccggagccccaccatcaccggcttctttgccccccagcccctggacctggagcccgccctgcccccaggcagcagggtcatcctgcccaccccagaggagcagcccctgagcagagctgctggccgcctgagcatccacagcctggaggcccagagcctgcgctgcctgcagcccttctgcacccaggacacccgggaccggcccttccaggcccaggcccaggagagcctggatgtgctgctgcggcaccccagcggctggtggctggtggagaatgaagatcggcagacagcctggttccctgccccctacctggaggaggccgcccctggccagggccgggagggcggccccagcctgggcagcagcggcccccagttctgtgccagccgggcctatgagagcagcagagcagatgagctgtctgtgcctgctggggcccgggtgcgggtgctggagaccagtgaccggggctggtggctgtgccgctatggagacagagctggcctgctgcctgctgtgctgctgcggcctgagggcctgggcgccctgctgtctggaacaggcttcagaggaggagatgatcctgctggggaggcccggggcttccctgagcccagccaggccacagcccccccacccaccgtgcccacccggcccagccctggggccatccagagccgctgctgcaccgtgacccggcgggccctggagcggcggccccggcggcagggccggccccggggctgtgtggacagcgtgccccaccccaccacagagcagtag

SEQ ID NO: 36001 - DNA, 1413 bp, Artificial Sequence
  Description of Artificial Sequence: Synthetic coding sequence
atgggcaagctgcacagcaagccagctgctgtgtgcaagaggcgggagagccctgagggggacagctttgctgtgtctgctgcctgggccaggaagggcatcgaggagtggattggccggcagcgctgccctgggggcgtgtctggcccccggcagctgcggctggccggcaccatcggccgcagcacccgggagctggtgggagatgtgctgcgggacaccctgtctgaggaggaggaggatgacttccggctggaggtggccctgcccccagagaagacagatggcctgggcagcggagatgagaagaagatggagcgggtgtctgagccctgccccggcagcaagaagcagctgaagtttgaggagctgcagtgtgatgtgtccatggaggaggacagccggcaggagtggaccttcaccctgtatgactttgacaacaacgggaaggtgacccgggaggacatcaccagcctgctgcacaccatctatgaggtggtggacagctctgtgaaccacagccccaccagcagcaagatgctgcgggtgaagctgactgtggccccagatggcagccagagcaagaggtctgtgctggtgaaccaggccgacctgcagagcgcccggcccagggctgagaccaagcccacagaggacctgcgctcctgggagaagaagcagagggcccccctgcgcttccagggcgacagccggctggagcagagcggctgctaccaccactgtgtggatgaaaatattgaaagaagaaaccactacctggacctggccggcatcgagaactacaccagccagtttggacctggcagccccagcgtggcccagaagtctgagctgccccccaggaccagcaaccccaccaggagccgcagccatgagcctgaggccatccacatcccccacaggaagccccagggcgtggaccctgccagcttccacttcctggacacccccatcgccaaggtgtctgagctgcagcagaggctgcggggcacccaggacggcagcaagcactttgtgcgcagccccaaggcccagggcaagtctgtgggcgtgggccacgtggcccggggggccaggaacaagccacccctgggccctgccatcccagctgtgagccccagcgcccacctggccgccagccctgccctgctgcccagcctggcccccctgggccacaagaagcacaagcaccgggccaaggagagccagcagggctgccggggcctgcaggcccccctggccagcggcggccctgtgctgggccgggagcacctgcgggagctgcctgccctggtggtgtatgagagccaggccggccagcctgtgcagagacatgagcaccaccaccaccacgagcaccaccaccactaccaccacttctaccagacctag

SEQ ID NO: 36002 - DNA, 1356 bp, Artificial Sequence
  Description of Artificial Sequence: Synthetic coding sequence
atgggcaagctgcagagcaagcatgctgctgctgccaggaagagaagagagagccctgagggggacagctttgtggccagcgcctatgccagcggcaggaaaggagctgaggaggccgagcggcgggcccgggacaagcaggagctgcccaatggagaccccaaggagggccccttccgggaggaccagtgccccctgcaggtggccctgcctgctgagaaggccgagggccgggagcaccctggccagctgctgtctgcagatgatggagagagagctgccaaccgggagggcccccggggccctgggggccagaggctgaacattgatgccctgcagtgtgatgtgtctgtggaggaggatgaccggcaggagtggaccttcaccctgtatgactttgacaactgtgggaaggtgacccgggaggacatgagcagcctgatgcacaccatctatgaggtggtggatgcctctgtgaaccacagcagcggcagcagcaagaccctgcgggtgaagctgactgtgtccccagagcccagcagcaagaggaaggagggccccccagctggccaggaccgggagcccacccgctgcaggatggagggggagctggccgaggagccccgggtggccgaccggcggctgagcgcccacgtgcggcggcccagcacagacccccagccctgcagcgagcggggcccctactgtgtggatgaaaatacagaaagaagaaaccactacctggacctggccggcatcgagaactacaccagccgcttcggccctggcagcccccctgtgcaggccaagcaggagccccagggccgggccagccacctgcaggcccggagccgcagccaggagccagacacccatgctgtgcaccacagaagaagccaggtgctggtggagcacgtggtgcctgccagcgagcctgctgcccgggccctggacacccagccccggcccaagggccctgagaagcagttcctgaagagccccaagggcagcggcaagcccccaggagtgcctgccagcagcaagagcggcaaggccttctcctactacctgcctgctgtgctgcccccccaggccccccaggacggccaccacctgccccagcccccacctccaccctacggccacaagcgctaccggcagaagggccgggagggccacagccccctgaaggccccccacgcccagcctgccaccgtggagcacgaggtggtgcgggacctgccccccaccccagctggggagggctatgctgtgcctgtgatccagagacatgagcaccaccaccaccacgagcaccaccaccaccaccaccaccaccacttccaccccagctag

SEQ ID NO: 36003 - DNA, 507 bp, Artificial Sequence
  Description of Artificial Sequence: Synthetic coding sequence
atggccggctctgtggacaaccggcagtgtggccggcagggccggcagtgtggccagcagacagtgtccacagctggctctgtggatggccggcaggccgtgtggatggccggctctgtggatgcctgccacagcggggcccggggcggggccggccctgctgcccacgccagcagaagaggcctgcggggggccagtgaccctgctgcccgggcccctcctccaccccgggcccctcctcctcctcctcctccacccctgccccctgtgctggcccccctgcccagcacccccaggagccagcacaccacagcccgggacctgcgggccggcagcagagctgctgctggctgtgtgcccatgggcagccctgcccccaccccccacctgcggcagcagacagccacagactgccgctgctggcatgatggcggcggggccccctggacccggggccagggccctggggccctgtgcagcagcgccctggatgccacctggaggtag

SEQ ID NO: 36004 - DNA, 936 bp, Artificial Sequence
  Description of Artificial Sequence: Synthetic coding sequence
atgggcaagctgcagagcaagcatgctgctgctgccaggaagagaagagagagccctgagggggacagctttgtggccagcgcctatgccagcggcaggaaaggagctgaggaggccgagcggcgggcccgggacaagcaggagctgcccaatggagaccccaaggagggccccttccgggaggaccagtgccccctgcaggtggccctgcctgctgagaaggccgagggccgggagcaccctggccagctgctgtctgcagatgatggagagagagctgccaaccgggagggcccccggggccctgggggccagaggctgaacattgatgccctgcagtgtgatgtgtctgtggaggaggatgaccggcaggagtggaccttcaccctgtatgactttgacaactgtgggaaggtgacccgggaggacatgagcagcctgatgcacaccatctatgaggtggtggatgcctctgtgaaccacagcagcggcagcagcaagaccctgcgggtgaagctgactgtgtccccagagcccagcagcaagaggaaggagggccccccagctggccaggaccgggagcccacccgctgcaggatggagggggagctggccgaggagccccgggtggccgaccggcggctgagcgcccacgtgcggcggcccagcacagacccccagccctgcagcgagcggggcccctactgtgtggatgaaaatacagaaagaagaaaccactacctggacctggccggcatcgagaactacaccagccgcttcggccctggcagccagctgtgtgagaagaggagcagcgcccccaggacccacagcggggacaaggcccggggcgtgggcctgtgccgggagctgtggagccaggccggccacccccagtggccaggccccttccccagcggcctggtggccgtgtag

SEQ ID NO: 36005 - DNA, 936 bp, Artificial Sequence; identical to SEQ ID NO: 36004
  Description of Artificial Sequence: Synthetic coding sequence

SEQ ID NO: 36006 - DNA, 438 bp, Artificial Sequence
  Description of Artificial Sequence: Synthetic coding sequence
atgcctggggtgacagtgaaggatgtgaaccagcaggagtttgtgcgggccctggccgccttcctgaagaagagcggcaagctgaaggtgcctgagtgggtggacacagtgaagctggccaagcacaaggagctggccccctatgatgagaactggttctacaccagggctgccagcacagcccggcacctgtacctgcggggcggggccggcgtgggctccatgaccaagatctatggaggccggcagagaaatggagtgatgcccagccacttcagccggggcagcaagtctgtggccaggagagtgctgcaggccctggagggcctgaagatggtggagaaggaccaggacggcggcaggaagctgaccccccagggccagagggacctggacagaattgctggccaggtggccgccgccaacaagaagcactag

SEQ ID NO: 36007 - DNA, 1134 bp, Artificial Sequence
  Description of Artificial Sequence: Synthetic coding sequence
atggccgaggaggtggtggtggtggccaagtttgattatgtggcccagcaggagcaggagctggacatcaagaagaatgaaaggctgtggctgctggatgacagcaagtcctggtggagggtgaggaacagcatgaacaagacaggctttgtgcccagcaactacgtggagaggaagaacagcgccaggaaggccagcatcgtgaagaacctgaaggacaccctgggcatcggcaaggtgaagaggaagcccagcgtgcctgattctgccagccctgcagatgacagctttgtggaccccggggagcggctgtatgacctgaacatgcctgcctacgtgaagttcaactacatggccgagcgggaggatgagctgagcctcatcaagggcaccaaggtgattgtgatggagaagtgcagtgatggctggtggaggggcagctacaacggccaggtgggctggttccccagcaactacgtgacagaggagggggacagccccctgggggaccacgtgggcagcctgtctgagaagctggccgctgtggtgaacaacctgaacacaggccaggtgctgcacgtggtgcaggccctgtaccccttcagcagcagcaatgatgaggagctgaactttgagaagggagatgtgatggatgtgattgagaagccagaaaatgaccctgagtggtggaagtgcaggaagatcaatggcatggtgggcctggtgcccaagaactacgtgacagtgatgcagaacaaccccctgaccagcggcctggagcccagccccccccagtgtgactacatccggcccagcctgaccgggaagtttgctggcaacccctggtactacggcaaggtgaccaggcaccaggccgagatggccctgaatgaaagaggacatgaaggagacttcctgatccgggacagcgagagcagccccaatgacttctctgtgtccctgaaggcccagggcaagaacaagcacttcaaggtgcagctgaaggagaccgtgtactgcatcggccagaggaagttcagcaccatggaggagctggtggagcactacaagaaggcccccatcttcaccagcgagcagggcgagaagctgtacctggtgaagcacctgtcctag

SEQ ID NO: 36008 - DNA, 228 bp, Artificial Sequence
  Description of Artificial Sequence: Synthetic coding sequence
atggccgaggaggtggtggtggtggccaagtttgattatgtggcccagcaggagcaggagctggacatcaagaagaatgaaaggctgtggctgctggatgacagcaagtcctggtggagggtgaggaacagcatgaacaagacaggctttgtgcccagcaactacgtggagaggaagaacagcgccaggaaggccagcatcgtgaagaacctgaaggacaccctgtag

SEQ ID NO: 36009 - DNA, 1134 bp, Artificial Sequence; identical to SEQ ID NO: 36007
  Description of Artificial Sequence: Synthetic coding sequence

SEQ ID NO: 36010 - DNA, 348 bp, Artificial Sequence
  Description of Artificial Sequence: Synthetic coding sequence
atggccgaggaggtggtggtggtggccaagtttgattatgtggcccagcaggagcaggagctggacatcaagaagaatgaaaggctgtggctgctggatgacagcaagtcctggtggagggtgaggaacagcatgaacaagacaggctttgtgcccagcaactacgtggagaggaagaacagcgccaggaaggccagcatcgtgaagaacctgaaggacaccctgggcatcggcaaggtgaagaggaagcccagcgtgcctgattctgccagccctgcagatgacagctttgtggaccccggggagcggctgtatgacctgaacatgcctgcctacgtgaagttctag

SEQ ID NO: 36011 - DNA, 390 bp, Artificial Sequence
  Description of Artificial Sequence: Synthetic coding sequence
atggccgaggaggtggtggtggtggccaagtttgattatgtggcccagcaggagcaggagctggacatcaagaagaatgaaaggctgtggctgctggatgacagcaagtcctggtggagggtgaggaacagcatgaacaagacaggctttgtgcccagcaactacgtggagaggaagaacagcgccaggaaggccagcatcgtgaagaacctgaaggacaccctgggcatcggcaaggtgaagaggaagcccagcgtgcctgattctgccagccctgcagatgacagctttgtggaccccggggagcggctgtatgacctgaacatgcctgcctacgtgaagttcaactacatggccgagcgggaggatgagctgagcctcatcaagtag

SEQ ID NO: 36012 - DNA, 942 bp, Artificial Sequence
  Description of Artificial Sequence: Synthetic coding sequence
atggactggctgaatgtgttcaaggacttcttcagcatcggcaaggtgaagaggaagcccagcgtgcctgattctgccagccctgcagatgacagctttgtggaccccggggagcggctgtatgacctgaacatgcctgcctacgtgaagttcaactacatggccgagcgggaggatgagctgagcctcatcaagggcaccaaggtgattgtgatggagaagtgcagtgatggctggtggaggggcagctacaacggccaggtgggctggttccccagcaactacgtgacagaggagggggacagccccctgggggaccacgtgggcagcctgtctgagaagctggccgctgtggtgaacaacctgaacacaggccaggtgctgcacgtggtgcaggccctgtaccccttcagcagcagcaatgatgaggagctgaactttgagaagggagatgtgatggatgtgattgagaagccagaaaatgaccctgagtggtggaagtgcaggaagatcaatggcatggtgggcctggtgcccaagaactacgtgacagtgatgcagaacaaccccctgaccagcggcctggagcccagccccccccagtgtgactacatccggcccagcctgaccgggaagtttgctggcaacccctggtactacggcaaggtgaccaggcaccaggccgagatggccctgaatgaaagaggacatgaaggagacttcctgatccgggacagcgagagcagccccaatgacttctctgtgtccctgaaggcccagggcaagaacaagcacttcaaggtgcagctgaaggagaccgtgtactgcatcggccagaggaagttcagcaccatggaggagctggtggagcactacaagaaggcccccatcttcaccagcgagcagggcgagaagctgtacctggtgaagcacctgtcctag

SEQ ID NO: 36013 - DNA, 3384 bp, Artificial Sequence
  Description of Artificial Sequence: Synthetic coding sequence
atgagcctgaccagcgcctaccagcacaagctggccgagaagctgaccatcctgaatgaccggggccagggcgtgctgatccgcatgtacaacatcaagaagacctgcagcgaccccaagagcaagccacccttcctgctggagaagtccatggagcccagcctgaagtacatcaacaagaagttccccaacattgatgtgaggaacagcacccagcacctgggccctgtgcaccgggagaaggccgagatcatccgcttcctgaccaactactaccagagctttgtggatgtgatggagttccgggaccacgtgtatgagctgctgaacaccattgatgcctgccagtgccactttgacatcaacctgaactttgacttcaccaggagctacctggacctgattgtgacctacaccagcgtcatcctgctgctgagcagaattgaagatcggcgcatcctgattggcatgtacaactgtgcccacgagatgctgcacggccacggggaccccagctttgcccggctgggccagatggtgctggagtatgaccaccccctgaagaagctgacagaggagtttggcccccacaccaaggctgtgtctggggccctgctgagcctgcacttcctgtttgtgagaagaaaccagggcgctgagcagtggaggtctgcccagctgctgagcctcatcagcaaccccccagccatgatcaacccagccaacagcgacaccatggcctgtgagtacctgtctgtggaggtgatggagcgctggatcatcatcggcttcctgctgtgccacggctgcctgaacagcaacagccagtgccagaagctgtggaagctgtgcctgcagggcagcctgtacatcaccctcatccgggaggatgtgctgcaggtgcacaaggtgacagaggacctcttcagcagcctgaagggctacggcaagagggtggccgacatcaaggagagcaaggagcacgtgattgccaacagcggccagttccactgccagaggcggcagttcctgaggatggctgtgaaggagctggagaccgtgctggctgatgagcccggcctgctgggccccaaggccctgtttgccttcatggccctgtccttcatcagagatgaggtgacctggctggtgcgccacacagaaaatgtgaccaagaccaagaccccagaagattatgctgacagcagcattgctgagctgctcttcctgctggagggcatccgcagcctggtgagaagacacatcaaggtgatccagcagtaccacctgcagtacctggccaggtttgatgccctggtgctgagtgacatcatccagaacctgtctgtgtgcccagaggaggagagcatcatcatgagcagctttgtgtccatcctgagcagcctgaacctgaagcaggtggacaacggggagaagtttgagttcagcggcctgcggctggactggttccggctgcaggcctacacctctgtggccaaggcccccctgcacctgcatgaaaatccagacctggccaaggtgatgaacctgattgtgttccacagcaggatgctggacagcgtggagaagctgctggtggagaccagtgacctgagcaccttctgcttccacctgcgcatctttgagaagatgtttgccatgaccctggaggagagcgccatgctgcgctatgccatcgccttccccctcatctgtgcccactttgtgcactgcacccatgagatgtgcccagaggagtacccccacctgaagaaccacggcctgcaccactgcaacagcttcctggaggagctggccaagcagaccagcaactgtgtgctggagatctgtgccgagcagaggaacctgtctgagcagctgctgcccaagcactgtgccaccaccatcagcaaggccaagaacaagaagaccaggaagcagaggcagacccccaggaaaggagagcctgagcgggacaagccaggagctgagagccacaggaagaacagaagcatcgtgaccaacatggacaagctgcacctgaacctgacagagctggccctgaccatgaaccacgtgtacagcttctctgtgtttgagcacaccatcttccccagcgagtacctgagcagccacctggaggcccggctgaacagagccatcgtgtggctggccggctacaatgccaccacccaggagatcgtgcggcccagcgagctgctggccggcgtgaaggcctacatcggcttcatccagagcctggcccagttcctgggcgcagatgccagcagggtcatcagaaatgccctgctgcagcagacccagcccctggacagctgtggggagcagaccatcaccaccctgtacaccaactggtacctggagagcctgctgcggcaggccagcagcggcaccatcatcctgagccctgccatgcaggcctttgtgtccctgccccgggagggggagcagaacttctctgctgaggagttcagtgacatcagcgagatgagggccctggccgagctgctgggcccctacggcatgaagttcctgtctgagaacctgatgtggcacgtgaccagccagatcgtggagctgaagaagctggtggtggagaacatggacatcctggtgcagatccgcagcaacttcagcaagccagacctgatggccagcctgctgccccagctgactggagcagaaaatgtgctgaagaggatgaccatcattggagtcatcctgtccttccgggccatggcccaggagggcctgcgggaggtgttcagcagccactgccccttcctgatgggccccattgaatgtctgaaggagtttgtgaccccagacacagacatcaaggtgaccctgagcatctttgagctggccagcgctgctggggtgggctgtgacatcgaccctgccctggtggccgccatcgccaacctgaaggctgacaccagcagccctgaggaggagtacaaggtggcctgcctgctgctgatcttcctggccgtgtccctgcccctgctggccacagaccccagcagcttctacagcattgagaaggatggctacaacaacaacatccactgcctgaccaaggccatcatccaggtgtctgctgccctcttcaccctgtacaacaagaacatcgagacccacctgaaggagttcctggtggtggcctctgtgtccctgctgcagctgggccaggagacagacaagctgaagaccaggaaccgggagagcatcagcctgctgatgaggctggtggtggaggagagcagcttcctgaccctggacatgctggagagctgcttcccctacgtgctgctgagaaatgcctaccgggaggtgtcccgggccttccacctgaactag

SEQ ID NO: 36014 - DNA, 3234 bp, Artificial Sequence
  Description of Artificial Sequence: Synthetic coding sequence
atggagcccagcctgaagtacatcaacaagaagttccccaacattgatgtgaggaacagcacccagcacctgggccctgtgcaccgggagaaggccgagatcatccgcttcctgaccaactactaccagagctttgtggatgtgatggagttccgggaccacgtgtatgagctgctgaacaccattgatgcctgccagtgccactttgacatcaacctgaactttgacttcaccaggagctacctggacctgattgtgacctacaccagcgtcatcctgctgctgagcagaattgaagatcggcgcatcctgattggcatgtacaactgtgcccacgagatgctgcacggccacggggaccccagctttgcccggctgggccagatggtgctggagtatgaccaccccctgaagaagctgacagaggagtttggcccccacaccaaggctgtgtctggggccctgctgagcctgcacttcctgtttgtgagaagaaaccagggcgctgagcagtggaggtctgcccagctgctgagcctcatcagcaaccccccagccatgatcaacccagccaacagcgacaccatggcctgtgagtacctgtctgtggaggtgatggagcgctggatcatcatcggcttcctgctgtgccacggctgcctgaacagcaacagccagtgccagaagctgtggaagctgtgcctgcagggcagcctgtacatcaccctcatccgggaggatgtgctgcaggtgcacaaggtgacagaggacctcttcagcagcctgaagggctacggcaagagggtggccgacatcaaggagagcaaggagcacgtgattgccaacagcggccagttccactgccagaggcggcagttcctgaggatggctgtgaaggagctggagaccgtgctggctgatgagcccggcctgctgggccccaaggccctgtttgccttcatggccctgtccttcatcagagatgaggtgacctggctggtgcgccacacagaaaatgtgaccaagaccaagaccccagaagattatgctgacagcagcattgctgagctgctcttcctgctggagggcatccgcagcctggtgagaagacacatcaaggtgatccagcagtaccacctgcagtacctggccaggtttgatgccctggtgctgagtgacatcatccagaacctgtctgtgtgcccagaggaggagagcatcatcatgagcagctttgtgtccatcctgagcagcctgaacctgaagcaggtggacaacggggagaagtttgagttcagcggcctgcggctggactggttccggctgcaggcctacacctctgtggccaaggcccccctgcacctgcatgaaaatccagacctggccaaggtgatgaacctgattgtgttccacagcaggatgctggacagcgtggagaagctgctggtggagaccagtgacctgagcaccttctgcttccacctgcgcatctttgagaagatgtttgccatgaccctggaggagagcgccatgctgcgctatgccatcgccttccccctcatctgtgcccactttgtgcactgcacccatgagatgtgcccagaggagtacccccacctgaagaaccacggcctgcaccactgcaacagcttcctggaggagctggccaagcagaccagcaactgtgtgctggagatctgtgccgagcagaggaacctgtctgagcagctgctgcccaagcactgtgccaccaccatcagcaaggccaagaacaagaagaccaggaagcagaggcagacccccaggaaaggagagcctgagcgggacaagccaggagctgagagccacaggaagaacagaagcatcgtgaccaacatggacaagctgcacctgaacctgacagagctggccctgaccatgaaccacgtgtacagcttctctgtgtttgagcacaccatcttccccagcgagtacctgagcagccacctggaggcccggctgaacagagccatcgtgtggctggccggctacaatgccaccacccaggagatcgtgcggcccagcgagctgctggccggcgtgaaggcctacatcggcttcatccagagcctggcccagttcctgggcgcagatgccagcagggtcatcagaaatgccctgctgcagcagacccagcccctggacagctgtggggagcagaccatcaccaccctgtacaccaactggtacctggagagcctgctgcggcaggccagcagcggcaccatcatcctgagccctgccatgcaggcctttgtgtccctgccccgggagggggagcagaacttctctgctgaggagttcagtgacatcagcgagatgagggccctggccgagctgctgggcccctacggcatgaagttcctgtctgagaacctgatgtggcacgtgaccagccagatcgtggagctgaagaagctggtggtggagaacatggacatcctggtgcagatccgcagcaacttcagcaagccagacctgatggccagcctgctgccccagctgactggagcagaaaatgtgctgaagaggatgaccatcattggagtcatcctgtccttccgggccatggcccaggagggcctgcgggaggtgttcagcagccactgccccttcctgatgggccccattgaatgtctgaaggagtttgtgaccccagacacagacatcaaggtgaccctgagcatctttgagctggccagcgctgctggggtgggctgtgacatcgaccctgccctggtggccgccatcgccaacctgaaggctgacaccagcagccctgaggaggagtacaaggtggcctgcctgctgctgatcttcctggccgtgtccctgcccctgctggccacagaccccagcagcttctacagcattgagaaggatggctacaacaacaacatccactgcctgaccaaggccatcatccaggtgtctgctgccctcttcaccctgtacaacaagaacatcgagacccacctgaaggagttcctggtggtggcctctgtgtccctgctgcagctgggccaggagacagacaagctgaagaccaggaaccgggagagcatcagcctgctgatgaggctggtggtggaggagagcagcttcctgaccctggacatgctggagagctgcttcccctacgtgctgctgagaaatgcctaccgggaggtgtcccgggccttccacctgaactag

SEQ ID NO: 36015 - DNA, 2622 bp, Artificial Sequence
  Description of Artificial Sequence: Synthetic coding sequence
atgtccttcatcatgaagctgcaccgccacttccagaggacagtcatcctgctggccaccttctgcatggtgtccatcatcatcagcgcctactacctgtacagcggctacaagcaggagaatgagctgtctgaaacagccagcgaggtggactgtggggacctgcagcacctgccctaccagctgatggaggtgaaggccatgaagctgtttgatgccagcaggacagaccccaccgtgctggtgtttgtggagagccagtacagcagcctgggccaggacatcatcatgatcctggagagcagccgcttccagtaccacatcgagatcgcccctgggaagggggacctgcctgtgctgattgacaagatgaagggcaagtacatcctgatcatctatgagaacatcctgaagtacatcaacatggacagctggaacagaagcctgctggacaagtactgtgtggagtatggagtgggcgtcatcggcttccacaagaccagcgagaagtctgtgcagagcttccagctgaagggcttccccttcagcatctacggcaacctggccgtgaaggactgctgcatcaacccccacagccccctcatccgggtgaccaagagcagcaagctggagaagggcagcctgcccggcacagactggacagtgttccagatcaaccacagcgcctaccagcccgtcatctttgccaaggtgaagaccccagagaacctgagccccagcatcagcaagggggccttctacgccaccatcatccatgacctgggcctgcatgatggcatccagagggtgctgtttggaaacaacctgaacttctggctgcacaagctgatcttcattgatgccatctccttcctgagcggcaagaggctgaccctgagcctggaccgctacatcctggtggacattgatgacatctttgtgggcaaggagggcaccaggatgaacaccaatgatgtgaaggccctgctggacacccagaacctgctgcgggcccagatcaccaacttcaccttcaacctgggcttcagcggcaagttctaccacactggaacagaggaggaggatgaaggagatgactgcctgctgggctctgtggatgagttctggtggttcccccacatgtggagccacatgcagccccacctgttccacaatgaaagcagcctggtggagcagatgatcctgaacaagaagtttgccctggagcacggcatccccacagacatgggctatgctgtggccccccaccacagcggcgtgtaccctgtgcacgtgcagctgtatgaggcctggaagaaggtgtggaacatcaagatcaccagcacagaggagtacccccacctgaagccagcccgctacagaagaggcttcatccacaagaacatcatggtgctgccccggcagacctgtggcctcttcacccacaccatcttctacaaggagtacccaggcggccccaaggagctggacaagagcatccagggcggggagctgttcttcaccgtggtgctgaaccccatcagcatcttcatgacccacctgagcaactatggaaatgaccggctgggcctgtacacctttgtgaacctggccaactttgtgaagtcctggaccaacctgcggctgcagaccctgccccctgtgcagctggcccacaagtactttgagctgttcccagaccagaaggaccccctgtggcagaacccctgtgatgacaagaggcaccgggacatctggagcaaggagaagacctgtgaccggctgcccaagttcctggtgattggcccccagaagacaggcaccacagccctgtacctgttcctggtgatgcaccccagcatcctgagcaacagccccagccccaagacctttgaggaggtgcagttcttcaacagaaacaactaccaccggggcatcgactggtacatggacttcttccctgtgcccagcaatgtgaccacagacttcctgtttgagaagagcgccaactacttccacagcgaggaggcccccaagagagctgccagcctggtgcccaaggccaagatcatcaccatcctgattgaccccagcgaccgggcctacagctggtaccagcaccagaggagccatgaggaccctgctgccctgaagttctccttctatgaggtgatctctgctggcccccgggcccccagcgagctgcgggccctgcagaagcgctgcctggtgcccggctggtacgccagccacatcgagcgctggctggtgtacttcccccccttccagctgctgatcattgatggccagcagctgaggacagatcctgccaccgtgatggatgaggtgcagaagttcctgggcgtgctgccccactacaactacagcgaggccctgacctttgacagccacaagggcttctggtgccagctgctggaggagggcaagaccaagtgcctgggcaagagcaagggcaggaagtacccacccatggacagcgacagcaggaccttcctgagcagctactacagagaccacaacgtggagctgagcaagctgctgcacaagctgggccagcccctgcccagctggctgcggcaggagctgcagaaggtgaggtag

SEQ ID NO: 36016 - DNA, 1686 bp, Artificial Sequence
  Description of Artificial Sequence: Synthetic coding sequence
atgtccttcatcatgaagctgcaccgccacttccagaggacagtcatcctgctggccaccttctgcatggtgtccatcatcatcagcgcctactacctgtacagcggctacaagcaggagaatgagctgtctgaaacagccagcgaggtggactgtggggacctgcagcacctgccctaccagctgatggaggtgaaggccatgaagctgtttgatgccagcaggacagaccccaccgtgctggtgtttgtggagagccagtacagcagcctgggccaggacatcatcatgatcctggagagcagccgcttccagtaccacatcgagatcgcccctgggaagggggacctgcctgtgctgattgacaagatgaagggcaagtacatcctgatcatctatgagaacatcctgaagtacatcaacatggacagctggaacagaagcctgctggacaagtactgtgtggagtatggagtgggcgtcatcggcttccacaagaccagcgagaagtctgtgcagagcttccagctgaagggcttccccttcagcatctacggcaacctggccgtgaaggactgctgcatcaacccccacagccccctcatccgggtgaccaagagcagcaagctggagaagggcagcctgcccggcacagactggacagtgttccagatcaaccacagcgcctaccagcccgtcatctttgccaaggtgaagaccccagagaacctgagccccagcatcagcaagggggccttctacgccaccatcatccatgacctgggcctgcatgatggcatccagagggtgctgtttggaaacaacctgaacttctggctgcacaagctgatcttcattgatgccatctccttcctgagcggcaagaggctgaccctgagcctggaccgctacatcctggtggacattgatgacatctttgtgggcaaggagggcaccaggatgaacaccaatgatgtgaaggagcacggcatccccacagacatgggctatgctgtggccccccaccacagcggcgtgtaccctgtgcacgtgcagctgtatgaggcctggaagaaggtgtggaacatcaagatcaccagcacagaggagtacccccacctgaagccagcccgctaccgccggggcttcatccacaagaacatcatggtgctgccccggcagacctgtggcctcttcacccacaccatcttctacaaggagtacccaggcggccccaaggagctggacaagagcatccagggcggggagctgttcttcaccgtggtgctgaaccccatcagcatcttcatgacccacctgagcaactatggaaatgaccggctgggcctgtacacctttgtgaacctggccaactttgtgaagtcctggaccaacctgcggctgcagaccctgccccctgtgcagctggcccacaagtactttgagctgttcccagaccagaaggaccccctgtggcagaacccctgtgatgacaagaggcaccgggacatctggagcaaggagaagacctgtgaccggctgcccaagttcctggtgattggcccccagaagacaggcaccacagccctgtacctgttcctggtgatgcaccccagcatcctgagcaacagccccagccccaagacctttgaggaggtgtatggcttcctgcccagccccatctag

SEQ ID NO: 36017 - DNA, 2619 bp, Artificial Sequence
  Description of Artificial Sequence: Synthetic coding sequence
atgaacctgattgtgaagctgcggcgctccttccgcaccctgattgtgctgctggccaccttctgcctggtgtccatcgtcatcagcgcctacttcctgtacagcggctacaagcaggagatgaccctcatcgagaccacagctgaggctgaatgtacagacatcaagatcctgccctaccgctccatggagctgaagacagtgaagcccatcgacaccagcaagacagaccccaccgtgctgctgtttgtggagagccagtacagccagctgggccaggacatcatcgccatcctggagagcagccgcttccagtaccacatggtgattgcccctgggaagggggacatcccccccctgacagacaatggcaagggcaagtacaccctggtgatctatgagaacatcctgaagtatgtgtccatggacagctggaaccgggagctgctggagaagtactgtgtggagtacagcgtgtccatcatcggcttccacaaggccaatgaaaacagcctgcccagcacccagctgaagggcttccccctgaacctcttcaacaacctggccctgaaggactgctttgtgaacccccagagccccctgctgcacatcaccaaggcccccaaggtggagaagggccccctgcccggggaggactggaccatcttccagtacaaccacagcacctaccagcctgtgctgctgacagagctgcagacagagaagagcctgagcagcctgagcagcaagaccctgtttgccaccgtcatccaggacctgggcctgcatgatggcatccagagggtgctgtttggaaacaacctgaacttctggctgcacaagctgatcttcattgatgccatctccttcctgagcggcaagaggctgaccctgagcctggaccgctacatcctggtggacattgatgacatctttgtgggcaaggagggcaccaggatgaatgtgaaggatgtgaaggccctgctggagacccagaacctgctgcggacccaggtggccaacttcaccttcaacctgggcttcagcggcaagttctaccacactggaacagaggaggaggatgaaggagatgacctgctgctgcggtctgtggatgagttctggtggttcccccacatgtggagccacatgcagccccacctgttccacaatgaaagcagcctggtggagcagatgatcctgaacaaggagtttgccctggagcacggcatccccatcaacatgggctatgctgtggccccccaccacagcggcgtgtaccctgtgcacatccagctgtatgctgcctggaagaaggtgtggggcatccaggtgaccagcacagaggagtacccccacctgaagccagcccgctacaggaagggcttcatccacaacagcatcatggtgctgccccggcagacctgtggcctcttcacccacaccatcttctacaaggagtacccaggcggcccccaggagctggacaagagcatccggggcggggagctgttcctgaccatcctgctgaaccccatcagcatcttcatgacccacctgagcaactatggaaatgaccggctgggcctgtacacctttgtgaacctggtgaactttgtgcagagctggaccaacctgaagctgcagaccctgccccctgtgcagctggcccaccagtactttgagctgtttcctgagcagaaggaccccctgtggcagaacccctgtgatgacaagaggcacaaggacatctggagccgggagaagacctgtgaccacctgcccaagttcctggtgattggcccccagaagacaggcaccacagccctgtacctgttcctgctgatgcaccccagcatcatcagcaacctgcccagccccaagacctttgaggaggtgcagttcttcaatggaaacaactaccacaagggcatcgactggtacatggacttcttccccacccccagcaacaccaccagtgacttcctgtttgagaagagcgccaactacttccacagcgaggaggccccccggcgggccgccagcctggtgcccaaggccaagatcatcaccatcctgattgaccccagcgaccgggcctacagctggtaccagcaccagaggagccatgaagatcctgctgccctgcgcttcaacttctatgaagtcatcagcacaggccactgggcccccagcgacctgaagaccctgcagaggcgctgcctggtgcccggctggtatgctgtgcacatcgagcgctggctgacctactttgccaccagccagctgctgatcattgatggccagcagctgcggagtgaccctgccaccgtgatggatgaggtgcagaagttcctgggcgtgaccccccgctacaactacagcgaggccctgacctttgacccccagaagggcttctggtgccagctgctggagggcggcaagaccaagtgcctgggcaagagcaaaggaaggaagtacccacccatggaccctgagagcaggaccttcctgagcaactactacagagaccacaacgtggagctgagcaagctgctgcaccggctgggccagcccctgcccagctggctgcggcaggagctgcagaaggtgaggtag

SEQ ID NO: 36018 - DNA, 1635 bp, Artificial Sequence
  Description of Artificial Sequence: Synthetic coding sequence
atggccacagcccctggccctgctggcatcgccatgggctctgtgggcagcctgctggagcggcaggacttcagccctgaggagctgcgggccgccctggccggcagccggggcagccggcagccagatggcctgctgaggaagggcctgggccagcgggagttcctgagctacctgcacctgcccaagaaggacagcaagagcaccaagaacaccaagagggcccccagaaatgaacctgctgactatgccaccctgtactaccgggagcacagccgggccggggacttcagcaagaccagcctgcctgagcggggccgctttgacaagtgccgcatccggcccagcgtcttcaagcccacagctggaaatggcaagggcttcctgtccatgcagagcctggccagccacaagggccagaagctgtggaggagcaatggcagcctgcacaccctggcctgccacccccccctgagccctggcccccgggccagccaggcccgggcccagctgctgcacgccctgagcctggatgagggcggccctgagcctgagcccagcctgagtgacagcagcagcggcggcagctttggccgcagccctggcaccggccccagccccttcagcagcagcctgggccacctgaaccacctgggcggcagcctggaccgggccagccagggccccaaggaggccggccccccagctgtgctgagctgcctgcctgagcccccaccaccctatgagttcagctgcagcagcgctgaggagatgggcgctgtgctgcctgagacctgtgaggagctgaagaggggcctgggagatgaagatggcagcaaccccttcacccaggtgctggaggagcggcagaggctgtggctggccgagctgaagaggctgtatgtggagcggctgcacgaggtgacccagaaggccgagaggagtgaaagaaacctgcagctgcagctgttcatggcccagcaggagcagaggcggctgaggaaggagctgcgggcccagcagggcctggcccctgagccccgggcccctggcaccctgcctgaggccgaccccagcgcccggcctgaggaggaggcccgctgggaggtgtgccagaagacagctgagatcagcctgctgaagcagcagctgcgggaggcccaggccgagctggcccagaagctggccgagatcttcagcctgaagacccagctgcggggcagccgggcccaggcccaggcccaggatgctgagctggtgcggctgcgggaggccgtgcgcagcctgcaggagcaggccccccgggaggaggcccctggcagctgtgaaacagatgactgcaagagccggggcctgctgggggaggccggcggcagcgaggcccgggacagcgctgagcagctgcgggcagagctgctgcaggagcggctgcggggccaggagcaggccctgcgctttgagcaggagaggaggacctggcaggaggagaaggagcgggtgctgcgctaccagcgggagatccagggcggctacatggacatgtacagaagaaaccaggccctggagcaggagctgcgggccctgcgggagccccccaccccctggagcccccggctggagagcagcaagatctag

SEQ ID NO: 36019 - DNA, 939 bp, Artificial Sequence
  Description of Artificial Sequence: Synthetic coding sequence
atggccgcccagaagatcaatgaaggcctggagcacctggccaaggccgagaagtacctgaagacaggcttcctgaagtggaagccagactatgattctgctgcctctgaatatggcaaggctgctgtggccttcaagaatgccaagcagtttgagcaggccaaggatgcctgcctgcgggaggccgtggcccacgagaacaacagagccctcttccacgccgccaaggcctatgagcaggccggcatgatgctgaaggagatgcagaagctgcctgaggccgtgcagctgattgagaaggcctccatgatgtacctggagaatggcaccccagacacagctgccatggccctggagagagctgggaagctgattgaaaatgtggaccctgagaaggctgtgcagctgtaccagcagacagccaacgtgtttgaaaatgaggagcggctgcggcaggccgtggagctgctgggcaaggccagccggctgctggtgcggggccgccgctttgatgaagctgccctgagcatccagaaggagaagaacatctacaaggagattgagaactaccccacctgctacaagaagaccatcgcccaggtgctggtgcacctgcacagaaatgactatgtggccgctgagcgctgtgtgcgggagagctacagcatccctggcttcaatggaagtgaggactgtgccgccctggagcagctgctggagggctatgaccagcaggaccaggaccaggtgtctgatgtgtgcaacagccccctcttcaagtacatggacaatgactatgccaagctgggcctgagcctggtggtgcctgggggcggcatcaagaagaagagccctgccaccccccaggccaagccagatggagtgacagccacagctgctgatgaggaggaggatgagtacagcggcggcctgtgctag

SEQ ID NO: 36020 - DNA, 693 bp, Artificial Sequence
  Description of Artificial Sequence: Synthetic coding sequence
atgatgctgaaggagatgcagaagctgcctgaggccgtgcagctgattgagaaggcctccatgatgtacctggagaatggcaccccagacacagctgccatggccctggagagagctgggaagctgattgaaaatgtggaccctgagaaggctgtgcagctgtaccagcagacagccaacgtgtttgaaaatgaggagcggctgcggcaggccgtggagctgctgggcaaggccagccggctgctggtgcggggccgccgctttgatgaagctgccctgagcatccagaaggagaagaacatctacaaggagattgagaactaccccacctgctacaagaagaccatcgcccaggtgctggtgcacctgcacagaaatgactatgtggccgctgagcgctgtgtgcgggagagctacagcatccctggcttcaatggaagtgaggactgtgccgccctggagcagctgctggagggctatgaccagcaggaccaggaccaggtgtctgatgtgtgcaacagccccctcttcaagtacatggacaatgactatgccaagctgggcctgagcctggtggtgcctgggggcggcatcaagaagaagagccctgccaccccccaggccaagccagatggagtgacagccacagctgctgatgaggaggaggatgagtacagcggcggcctgtgctag

SEQ ID NO: 36021 - DNA, 1611 bp, Artificial Sequence
  Description of Artificial Sequence: Synthetic coding sequence
atgctgcacctgctggccctcttcctgcactgcctgcccctggccagcggggactatgacatctgcaagtcctgggtgaccacagatgagggccccacctgggagttctacgcctgccagcccaaggtgatgaggctgaaggactatgtgaaggtgaaggtggagcccagcggcatcacctgtggggaccccccagagcgcttctgcagccatgagaacccctacctgtgcagcaatgaatgtgatgccagcaacccagacctggcccaccccccccggctgatgtttgacaaggaggaggagggcctggccacctactggcagagcatcacctggagccgctaccccagccccctggaggccaacatcaccctgtcctggaacaagacagtggagctgacagatgatgtggtgatgacctttgaatatggccggcccaccgtgatggtgctggagaagagcctggacaatggaagaacctggcagccctaccagttctatgcagaggactgcatggaggccttcggcatgtctgcccggcgggcccgggacatgagcagcagcagcgcccaccgggtgctgtgcacagaggagtacagccgctgggccggcagcaagaaggagaagcacgtgcgctttgaggtgcgggacagatttgccatctttgctggccctgacctgaggaacatggacaacctgtacacccggctggagagcgccaagggcctgaaggagttcttcaccctgacagacctgaggatgaggctgctgcggcctgccctgggcggcacctacgtgcagagagaaaatctctacaagtacttctacgccatcagcaacattgaagtcatcggccgctgcaagtgcaacctgcacgccaacctgtgcagcatgagggagggcagcctgcagtgtgaatgtgagcacaacaccaccggccctgactgtgggaagtgcaagaagaacttccgcaccaggtcctggagggctggcagctacctgcccctgccccacggcagccccaatgcctgcacagcccccagcggcaccttcagcaaggatgccttcctgcactgtgagtgctacggccacagcaaccgctgcagctacatcgacttcctgaatgtggtgacctgtgtgtcctgcaagcacaacacccggggccagcactgccagcactgccgcctgggctactacagaaatggatctgctgagctggatgatgaaaatgtgtgcatcgagtgcaactgcaaccagatcggctctgtgcatgaccgctgcaatgagaccggcttctgtgagtgccgggagggcgccgccggccccaagtgtgatgactgcctgcccacccactactggaggcagggctgctaccccaacgtgtgtgatgatgaccagctgctgtgccagaatggaggcacctgcctgcagaaccagagatgtgcctgcccccggggctacacaggagtgcgctgtgagcagccccgctgtgaccctgcagatgatgatggcggcctggactgtgaccgggcccctggggccgcccccaggcctgccaccctgctgggctgcctgctgctgctgggcctggccgcccggctgggccgctag

SEQ ID NO: 36022 - DNA, 1269 bp, Artificial Sequence
  Description of Artificial Sequence: Synthetic coding sequence
atgctgcacctgctggccctcttcctgcactgcctgcccctggccagcggggactatgacatctgcaagtcctgggtgaccacagatgagggccccacctgggagttctacgcctgccagcccaaggtgatgaggctgaaggactatgtgaaggtgaaggtggagcccagcggcatcacctgtggggaccccccagagcgcttctgcagccatgagaacccctacctgtgcagcaatgaatgtgatgccagcaacccagacctggcccaccccccccggctgatgtttgacaaggaggaggagggcctggccacctactggcagagcatcacctggagccgctaccccagccccctggaggccaacatcaccctgtcctggaacaagacagtggagctgacagatgatgtggtgatgacctttgaatatggccggcccaccgtgatggtgctggagaagagcctggacaatggaagaacctggcagccctaccagttctatgcagaggactgcatggaggccttcggcatgtctgcccggcgggcccgggacatgagcagcagcagcgcccaccgggtgctgtgcacagaggagtacagccgctgggccggcagcaagaaggagaagcacgtgcgctttgaggtgcgggacagatttgccatctttgctggccctgacctgaggaacatggacaacctgtacacccggctggagagcgccaagggcctgaaggagttcttcaccctgacagacctgaggatgaggctgctgcggcctgccctgggcggcacctacgtgcagagagaaaatctctacaagtacttctacgccatcagcaacattgaagtcatcggccgctgcaagtgcaacctgcacgccaacctgtgcagcatgagggagggcagcctgcagtgtgaatgtgagcacaacaccaccggccctgactgtgggaagtgcaagaagaacttccgcaccaggtcctggagggctggcagctacctgcccctgccccacggcagccccaatgcctgtgccacagctggcagctttggcaccctgcagaccccacctcctggccgcagccccagcgccctgcggggcagcagaagaggcctggccaacgtgaaggagcctgctggcagccggccccagatcagcgagatgctgctgggctgcaccgtgaccctgcaccagggctctgtgggcccccacatcccccccaagctgagcctgcctgaccccggcggcccctggctgggcagccagtag

SEQ ID NO: 36023 - DNA, 1569 bp, Artificial Sequence
  Description of Artificial Sequence: Synthetic coding sequence
atgctgcacctgctggccctcttcctgcactgcctgcccctggccagcggggactatgacatctgcaagtcctgggtgaccacagatgagggccccacctgggagttctacgcctgccagcccaaggtgatgaggctgaaggactatgtgaaggtgaaggtggagcccagcggcatcacctgtggggaccccccagagcgcttctgcagccatgagaacccctacctgtgcagcaatgaatgtgatgccagcaacccagacctggcccaccccccccggctgatgtttgacaaggaggaggagggcctggccacctactggcagagcatcacctggagccgctaccccagccccctggaggccaacatcaccctgtcctggaacaagacagtggagctgacagatgatgtggtgatgacctttgaatatggccggcccaccgtgatggtgctggagaagagcctggacaatggaagaacctggcagccctaccagttctatgcagaggactgcatggaggccttcggcatgtctgcccggcgggcccgggacatgagcagcagcagcgcccaccgggtgctgtgcacagaggagtacagccgctgggccggcagcaagaaggagaagcacgtgcgctttgaggtgcgggacagatttgccatctttgctggccctgacctgaggaacatggacaacctgtacacccggctggagagcgccaagggcctgaaggagttcttcaccctgacagacctgaggatgaggctgctgcggcctgccctgggcggcacctacgtgcagagagaaaatctctacaagtacttctacgccatcagcaacattgaagtcatcggccgctgcaagtgcaacctgcacgccaacctgtgcagcatgagggagggcagcctgcagtgtgaatgtgagcacaacaccaccggccctgactgtgggaagtgcaagaagaacttccgcaccaggtcctggagggctggcagctacctgcccctgccccacggcagccccaatgcctactgtgagtgctacggccacagcaaccgctgcagctacatcgacttcctgaatgtggtgacctgtgtgtcctgcaagcacaacacccggggccagcactgccagcactgccgcctgggctactacagaaatggatctgctgagctggatgatgaaaatgtgtgcatcgagtgcaactgcaaccagatcggctctgtgcatgaccgctgcaatgagaccggcttctgtgagtgccgggagggcgccgccggccccaagtgtgatgactgcctgcccacccactactggaggcagggctgctaccccaacgtgtgtgatgatgaccagctgctgtgccagaatggaggcacctgcctgcagaaccagagatgtgcctgcccccggggctacacaggagtgcgctgtgagcagccccgctgtgaccctgcagatgatgatggcggcctggactgtgaccgggcccctggggccgcccccaggcctgccaccctgctgggctgcctgctgctgctgggcctggccgcccggctgggccgctag

SEQ ID NO: 36024 - DNA, 1593 bp, Artificial Sequence
  Description of Artificial Sequence: Synthetic coding sequence
atgctgcacctgctggccctcttcctgcactgcctgcccctggccagcggggactatgacatctgcaagtcctgggtgaccacagatgagggccccacctgggagttctacgcctgccagcccaaggtgatgaggctgaaggactatgtgaaggtgaaggtggagcccagcggcatcacctgtggggaccccccagagcgcttctgcagccatgagaacccctacctgtgcagcaatgaatgtgatgccagcaacccagacctggcccaccccccccggctgatgtttgacaaggaggaggagggcctggccacctactggcagagcatcacctggagccgctaccccagccccctggaggccaacatcaccctgtcctggaacaagacagtggagctgacagatgatgtggtgatgacctttgaatatggccggcccaccgtgatggtgctggagaagagcctggacaatggaagaacctggcagccctaccagttctatgcagaggactgcatggaggccttcggcatgtctgcccggcgggcccgggacatgagcagcagcagcgcccaccgggtgctgtgcacagaggagtacagccgctgggccggcagcaagaaggagaagcacgtgcgctttgaggtgcgggacagatttgccatctttgctggccctgacctgaggaacatggacaacctgtacacccggctggagagcgccaagggcctgaaggagttcttcaccctgacagacctgaggatgaggctgctgcggcctgccctgggcggcacctacgtgcagagagaaaatctctacaagtacttctacgccatcagcaacattgaagtcatcggccgctgcaagtgcaacctgcacgccaacctgtgcagcatgagggagggcagcctgcagtgtgaatgtgagcacaacaccaccggccctgactgtgggaagtgcaagaagaacttccgcaccaggtcctggagggctggcagctacctgcccctgccccacggcagccccaatgcctgtgccacagctggcagctttggaaactgtgagtgctacggccacagcaaccgctgcagctacatcgacttcctgaatgtggtgacctgtgtgtcctgcaagcacaacacccggggccagcactgccagcactgccgcctgggctactacagaaatggatctgctgagctggatgatgaaaatgtgtgcatcgagtgcaactgcaaccagatcggctctgtgcatgaccgctgcaatgagaccggcttctgtgagtgccgggagggcgccgccggccccaagtgtgatgactgcctgcccacccactactggaggcagggctgctaccccaacgtgtgtgatgatgaccagctgctgtgccagaatggaggcacctgcctgcagaaccagagatgtgcctgcccccggggctacacaggagtgcgctgtgagcagccccgctgtgaccctgcagatgatgatggcggcctggactgtgaccgggcccctggggccgcccccaggcctgccaccctgctgggctgcctgctgctgctgggcctggccgcccggctgggccgctag

SEQ ID NO: 36025 - DNA, 858 bp, Artificial Sequence
  Description of Artificial Sequence: Synthetic coding sequence
atggctgctgccagcgagcctgtggacagcggggccctgtggggcctggagaggcctgagcccccacccacccgcttccaccgggtgcacggggccaacatccgggtggaccccagcggcacccgggccaccagggtggagagctttgcccatggagtgtgcttcagccgggagcccctggcccctggccaggtgttcctggtggagattgaggagaaggagctgggctggtgtggccacctgcggctgggcctgacagccctggaccctgccagcctggcccctgtgcctgagttcagcctgcctgacctggtgaacctgggccacacctgggtgtttgccatcaccaggcaccacaacagagtgccccgggagggccggcctgaggccgaggccgccgcccccagccggccccccaccctgctggtggagccctacctgagaattgagcagttccgcatcccccgggaccggctggtgggccgcagcaggcctggcctgtacagccacctgctggaccagctgtatgagctgaatgtgctgcccccaacagcccggcgcagccggctgggcgtgctcttctgccccaggccagatggaacagctgacatgcacatcatcatcaatggagaggacatgggccccagcgcccggggcctgcctgctgcccagcccctgtatgctgtggtggatgtgtttgccagcaccaagtctgtgcggctggtgcagctggagtatggcctgcccagcctgcagaccctgtgccgcctggtgatccagaggtccatggtgcaccggctggccattgatggcctgcacctgcccaaggagctgaaggacttctgcaagtatgaatag

SEQ ID NO: 36026 - DNA, 441 bp, Artificial Sequence
  Description of Artificial Sequence: Synthetic coding sequence
atgagcagctgcagcaatgtgtgtggcagccggcaggcccaggccgctgctgagggcggctaccagagatatggagtgcgcagctacctgcaccagttctatgaggactgcacagccagcatctgggagtatgaagatgacttccagatccagaggagccccaaccgctggagctctgtgttctggaagcaggagctgggcttccacaccagcagccacagccaggagtggaacaggaagctgcagcacaagaactgcccccgctgctgcttcggcagcctgagccccccaggagaggccctgctgtgccgccactgggactggccctaccaccccaaggcccctggctgcagcgctgagcccggcggcggccccttccagagcatccccaccctgctgtgtggccccaagaggggctgctttgccagcagcgagctgtag

SEQ ID NO: 36027 - DNA, 534 bp, Artificial Sequence
  Description of Artificial Sequence: Synthetic coding sequence
atgagcagctgcagcaatgtgtgtggcagccggcaggcccaggccgctgctgagggcggctaccagagatatggagtgcgcagctacctgcaccagttctatgaggactgcacagccagcatctgggagtatgaagatgacttccagatccagaggagccccaaccgctggagctctgtgttctggaaggtgggcctcatcagcggcaccgtgtttgtgatcctgggcctgactgtgctggccgtgggcttcctggtgccccccaagattgaggcctttggagaggccgactttgtggtggtggacacccatgctgtgcagttcaacagcgccctggacatgtacaagctggccggggctgtgctcttctgcattggaggcacctccatggccggctgcctgctgatgtctgtgtttgtgaagagctacagcaaggaggagaagttcctgcagcagaagttcaaggagagaattgctgacatcaaggcccacacccagcctgtgaccaaggcccctggcacccccctgtcctag

SEQ ID NO: 36028 - DNA, 441 bp, Artificial Sequence; identical to SEQ ID NO: 36026
  Description of Artificial Sequence: Synthetic coding sequence

SEQ ID NO: 36029 - DNA, 588 bp, Artificial Sequence
  Description of Artificial Sequence: Synthetic coding sequence
atgagcagctgcagcaatgtgtgtggcagccggcaggcccaggccgctgctgagggcggctaccagagatatggagtgcgcagctacctgcaccagttctatgaggactgcacagccagcatctgggagtatgaagatgacttccagatccagaggagccccaaccgctggagctctgtgttctggaaggtgggcctcatcagcggcaccgtgtttgtgatcctgggcctgactgtgctggccgtgggcttcctggtgccccccaagattgaggcctttggagaggccgactttgtggtggtggacacccatgctgtgcagttcaacagcgccctggacatgtacaagctggccggggctgtgctcttctgcattggaggcacctccatggccggctgcctgctgatgtctgtgtttgtgaagagctacagcaaggaggagaagttcctgcagcagaagttcaaggagagaattgctgacatcaaggcccacacccagcctgtgaccaaggcccctggccctggagagaccaagatccctgtgaccctgagccgggtgcagaatgtgcagcccctgctggccacctag

SEQ ID NO: 36030 - DNA, 498 bp, Artificial Sequence
  Description of Artificial Sequence: Synthetic coding sequence
atgatgcgctgctgcagaagacgctgctgctgccggcagcccccccacgccctgcggcccctgctgctgctgcccctggtgctgctgccccccctggccgctgctgctgctggccccaacagatgtgacaccatctaccagggctttgctgaatgtctcatccggctgggggacagcatgggccggggcggggagctggagaccatctgccgctcctggaatgacttccacgcctgtgccagccaggtgctgagcggctgcccagaggaggccgctgctgtgtgggagagcctgcagcaggaggcccggcaggccccccggcccaacaacctgcacaccctgtgtggggcccctgtgcacgtgcgggagcggggcaccggcagcgagaccaaccaggagaccctgcgggccacagccccagccctgcccatggccccagccccacccctgctggccgccgccctggccctggcctacctgctgcggcccctggcctag

SEQ ID NO: 36031 - DNA, 2451 bp, Artificial Sequence
  Description of Artificial Sequence: Synthetic coding sequence
atgagccggccccagggcctgctgtggctgcccctgctcttcacccctgtgtgtgtgatgctgaacagcaatgtgctgctgtggctgacagccctggccatcaagttcaccctgattgacagccaggcccagtaccctgtggtgaacaccaactacggcaagatccggggcctgcggacccccctgcccaatgagatcctgggccctgtggagcagtacctgggcgtgccctatgccagccccccaactggagagcggcgcttccagcccccagagccccccagctcctggacaggcatccggaacaccacccagtttgctgctgtgtgcccccagcacctggatgagaggagcctgctgcatgacatgctgcccatctggttcaccgccaacctggacaccctgatgacctacgtgcaggaccagaatgaagactgcctgtacctgaacatctacgtgcccacagaagatgacatccatgaccagaacagcaagaagcctgtgatggtgtacatccatggaggcagctacatggagggcactggaaacatgattgatggcagcatcctggccagctatggaaatgtgattgtcatcaccatcaactaccgcctgggcatcctgggcttcctgagcactggagaccaggccgccaagggcaactacggcctgctggaccagatccaggccctgcgctggattgaggagaatgtgggcgcctttggaggagaccccaagagggtgaccatctttggaagtggagctggggccagctgtgtgtccctgctgaccctgagccactacagcgagggcctcttccagaaggccatcatccagagcggcacagccctgagctcctgggccgtgaactaccagcctgccaagtacacccgcatcctggccgacaaggtgggctgcaacatgctggacaccacagacatggtggagtgcctgaggaacaagaactacaaggagctgatccagcagaccatcaccccagccacctaccacatcgccttcggccctgtgattgatggagatgtgatcccagatgacccccagatcctgatggagcagggcgagttcctgaactatgacatcatgctgggcgtgaaccagggcgagggcctgaagtttgtggatggcatcgtggacaatgaagatggagtgaccccaaatgactttgacttctctgtgagcaactttgtggacaacctgtatggctacccagagggcaaggacaccctgcgggagaccatcaagttcatgtacacagactgggccgacaaggaaaatcctgagaccaggaggaagaccctggtggccctcttcacagaccaccagtgggtggccccagctgtggccacagctgacctgcacgcccagtatggcagccccacctacttctacgccttctaccaccactgccagagcgagatgaagcccagctgggccgacagcgcccatggagatgaggtgccctacgtgtttggcatccccatgattggccccacagagctgttcagctgcaacttcagcaagaatgatgtgatgctgtctgctgtggtgatgacctactggaccaactttgccaagacaggagaccccaaccagcctgtgccccaggacaccaagttcatccacaccaagcccaacagatttgaggaggtggcctggagcaagtacaaccccaaggaccagctgtacctgcacatcggcctgaagccccgggtgcgggaccactaccgggccaccaaggtggccttctggctggagctggtgccccacctgcacaacctgaatgagatcttccagtatgtgtccaccaccaccaaggtgcccccaccagacatgaccagcttcccctacggcacccggcgcagccctgccaagatctggcccaccaccaagaggcctgccatcaccccagccaacaaccccaagcacagcaaggacccccacaagacaggccctgaggacaccaccgtgctgattgagaccaagagggactacagcacagagctgtctgtgaccatcgctgtgggcgccagcctgctcttcctgaacatcctggcctttgctgccctgtactacaagaaggacaagagaagacatgagacccacagaagacccagcccccagaggaacaccaccaatgacatcgcccacatccagaatgaggagatcatgagcctgcagatgaagcagctggagcatgaccatgaatgtgagagcctgcaggcccatgacaccctgcggctgacctgccccccagactacaccctgaccctgcggcgcagcccagatgacatccccctgatgacccccaacaccatcaccatgatccccaacaccctgaccggcatgcagcccctgcacaccttcaacaccttcagcggcggccagaacagcaccaacctgccccacggccacagcaccaccagggtgtag

SEQ ID NO: 36032 - DNA, 2451 bp, Artificial Sequence; identical to SEQ ID NO: 36031
  Description of Artificial Sequence: Synthetic coding sequence

SEQ ID NO: 36033 - DNA, 2511 bp, Artificial Sequence
  Description of Artificial Sequence: Synthetic coding sequence
atgagccggccccagggcctgctgtggctgcccctgctcttcacccctgtgtgtgtgatgctgaacagcaatgtgctgctgtggctgacagccctggccatcaagttcaccctgattgacagccaggcccagtaccctgtggtgaacaccaactacggcaagatccggggcctgcggacccccctgcccaatgagatcctgggccctgtggagcagtacctgggcgtgccctatgccagccccccaactggagagcggcgcttccagcccccagagccccccagctcctggacaggcatccggaacaccacccagtttgctgctgtgtgcccccagcacctggatgagaggagcctgctgcatgacatgctgcccatctggttcaccgccaacctggacaccctgatgacctacgtgcaggaccagaatgaagactgcctgtacctgaacatctacgtgcccacagaagatggagccaacaccaagaagaatgctgatgacatcaccagcaatgacagaggagaagatgaggacatccatgaccagaacagcaagaagcctgtgatggtgtacatccatggaggcagctacatggagggcactggaaacatgattgatggcagcatcctggccagctatggaaatgtgattgtcatcaccatcaactaccgcctgggcatcctgggcttcctgagcactggagaccaggccgccaagggcaactacggcctgctggaccagatccaggccctgcgctggattgaggagaatgtgggcgcctttggaggagaccccaagagggtgaccatctttggaagtggagctggggccagctgtgtgtccctgctgaccctgagccactacagcgagggcctcttccagaaggccatcatccagagcggcacagccctgagctcctgggccgtgaactaccagcctgccaagtacacccgcatcctggccgacaaggtgggctgcaacatgctggacaccacagacatggtggagtgcctgaggaacaagaactacaaggagctgatccagcagaccatcaccccagccacctaccacatcgccttcggccctgtgattgatggagatgtgatcccagatgacccccagatcctgatggagcagggcgagttcctgaactatgacatcatgctgggcgtgaaccagggcgagggcctgaagtttgtggatggcatcgtggacaatgaagatggagtgaccccaaatgactttgacttctctgtgagcaactttgtggacaacctgtatggctacccagagggcaaggacaccctgcgggagaccatcaagttcatgtacacagactgggccgacaaggaaaatcctgagaccaggaggaagaccctggtggccctcttcacagaccaccagtgggtggccccagctgtggccacagctgacctgcacgcccagtatggcagccccacctacttctacgccttctaccaccactgccagagcgagatgaagcccagctgggccgacagcgcccatggagatgaggtgccctacgtgtttggcatccccatgattggccccacagagctgttcagctgcaacttcagcaagaatgatgtgatgctgtctgctgtggtgatgacctactggaccaactttgccaagacaggagaccccaaccagcctgtgccccaggacaccaagttcatccacaccaagcccaacagatttgaggaggtggcctggagcaagtacaaccccaaggaccagctgtacctgcacatcggcctgaagccccgggtgcgggaccactaccgggccaccaaggtggccttctggctggagctggtgccccacctgcacaacctgaatgagatcttccagtatgtgtccaccaccaccaaggtgcccccaccagacatgaccagcttcccctacggcacccggcgcagccctgccaagatctggcccaccaccaagaggcctgccatcaccccagccaacaaccccaagcacagcaaggacccccacaagacaggccctgaggacaccaccgtgctgattgagaccaagagggactacagcacagagctgtctgtgaccatcgctgtgggcgccagcctgctcttcctgaacatcctggcctttgctgccctgtactacaagaaggacaagagaagacatgagacccacagaagacccagcccccagaggaacaccaccaatgacatcgcccacatccagaatgaggagatcatgagcctgcagatgaagcagctggagcatgaccatgaatgtgagagcctgcaggcccatgacaccctgcggctgacctgccccccagactacaccctgaccctgcggcgcagcccagatgacatccccctgatgacccccaacaccatcaccatgatccccaacaccctgaccggcatgcagcccctgcacaccttcaacaccttcagcggcggccagaacagcaccaacctgccccacggccacagcaccaccagggtgtag

SEQ ID NO: 36034 - DNA, 2451 bp, Artificial Sequence; identical to SEQ ID NO: 36031
  Description of Artificial Sequence: Synthetic coding sequence

SEQ ID NO: 36035 - DNA, 2451 bp, Artificial Sequence; identical to SEQ ID NO: 36031
  Description of Artificial Sequence: Synthetic coding sequence

SEQ ID NO: 36036 - DNA, 558 bp, Artificial Sequence
  Description of Artificial Sequence: Synthetic coding sequence
atggtgaagctgggcaacaactttgctgagaagggcaccaagcagcccctgctggaggatggctttgacaccatccccctgatgacccccctggatgtgaaccagctgcagtttcctcctccagacaaggtggtggtgaagaccaagacagaatatgagccagacaggaagaagggcaaggcccggcccccccagattgctgagttcaccgtgtccatcacagagggcgtgacagagcgcttcaaggtgtctgtgctggtgctgtttgccctggccttcctgacctgtgtggtgttcctggtggtgtacaaggtgtacaagtatgaccgggcctgcccagatggctttgtgctgaagaacacccagtgcatccctgagggcctggagagctactatgcagagcaggacagcagcgcccgggagaagttctacaccgtcatcaaccactacaacctggccaagcagagcatcaccaggtctgtgagcccctggatgtctgtgctgtctgaggagaagctgtctgagcaggagacagaggccgctgagaagagcgcctag

SEQ ID NO: 36037 - DNA, 558 bp, Artificial Sequence; identical to SEQ ID NO: 36036
  Description of Artificial Sequence: Synthetic coding sequence

SEQ ID NO: 36038 - DNA, 558 bp, Artificial Sequence; identical to SEQ ID NO: 36036
  Description of Artificial Sequence: Synthetic coding sequence

SEQ ID NO: 36039 - DNA, 441 bp, Artificial Sequence
  Description of Artificial Sequence: Synthetic coding sequence
atggtgaagctgggcaacaactttgctgagaagggcaccaagcagcccctgctggaggatggctttgacaccatccccctgatgacccccctggatgtgaaccagctgcagtttcctcctccagacaaggtgtctgtgctggtgctgtttgccctggccttcctgacctgtgtggtgttcctggtggtgtacaaggtgtacaagtatgaccgggcctgcccagatggctttgtgctgaagaacacccagtgcatccctgagggcctggagagctactatgcagagcaggacagcagcgcccgggagaagttctacaccgtcatcaaccactacaacctggccaagcagagcatcaccaggtctgtgagcccctggatgtctgtgctgtctgaggagaagctgtctgagcaggagacagaagctgctgagaagagcgcctag

SEQ ID NO: 36040 - DNA, 558 bp, Artificial Sequence; identical to SEQ ID NO: 36036
  Description of Artificial Sequence: Synthetic coding sequence

SEQ ID NO: 36041 - DNA, 558 bp, Artificial Sequence; identical to SEQ ID NO: 36036
  Description of Artificial Sequence: Synthetic coding sequence

SEQ ID NO: 36042 - DNA, 558 bp, Artificial Sequence; identical to SEQ ID NO: 36036
  Description of Artificial Sequence: Synthetic coding sequence

SEQ ID NO: 36043 - DNA, 558 bp, Artificial Sequence; identical to SEQ ID NO: 36036
  Description of Artificial Sequence: Synthetic coding sequence

SEQ ID NO: 36044 - DNA, 516 bp, Artificial Sequence
  Description of Artificial Sequence: Synthetic coding sequence
atggtgaagctgaacagcaaccccagcgagaagggcaccaagcccccatctgtggaggatggcttccagacagtgcccctcatcacccccctggaggtgaaccacctgcagctgcctgcccctgagaaggtgattgtgaagaccaggacagagtaccagcctgagcagaagaacaagggcaagttccgggtgcccaagattgctgagttcaccgtgaccatcctggtgtccctggccctggccttcctggcctgcatcgtgttcctggtggtgtacaaggccttcacctatgaccacagctgcccagagggctttgtgtacaagcacaagcgctgcatcccagccagcctggatgcctactacagcagccaggaccccaacagccgcagccgcttctacaccgtcatcagccactacagcgtggccaagcagagcacagcccgggccatcggcccctggctgtctgctgctgctgtgattcatgagcccaagccacccaagacccagggccactag

SEQ ID NO: 36045 - DNA, 516 bp, Artificial Sequence; identical to SEQ ID NO: 36044
  Description of Artificial Sequence: Synthetic coding sequence

SEQ ID NO: 36046 - DNA, 441 bp, Artificial Sequence
  Description of Artificial Sequence: Synthetic coding sequence
atggtgaagctgaacagcaaccccagcgagaagggcaccaagcccccatctgtggaggatggcttccagacagtgcccctcatcacccccctggaggtgaaccacctgcagctgcctgcccctgagaaggtgattgtgaagaccaggacagagtaccagcctgagcagaagaacaagggcaagttccgggtgcccaagattgctgagttcaccgtgaccatcctggtgtccctggccctggccttcctggcctgcatcgtgttcctggtggtgtacaaggccttcacctatgaccacagctgcccagagggctttgtgtacaagcacaagcgctgcatcccagccagcctggatgcctactacagcagccaggaccccaacagccgcagccgcttctacaccgtcatcagccactacagcgtggccaagcagagcacctag

SEQ ID NO: 36047 - DNA, 480 bp, Artificial Sequence
  Description of Artificial Sequence: Synthetic coding sequence
atggtgaagctgaacagcaaccccagcgagaagggcaccaagcccccatctgtggaggatggcttccagacagtgcccctcatcacccccctggaggtgaaccacctgcagctgcctgcccctgagaaggtgattgtgaagaccaggacagagtaccagcctgagcagaagaacaagggcaagttccgggtgcccaagattgctgagttcaccgtgaccatcctggtgtccctggccctggccttcctggcctgcatcgtgttcctggtggtgtacaaggccttcacctatgaccacagctgcccagagggctttgtgtacaagcacaagcgctgcatcccagccagcctggatgcctactacagcagccaggaccccaacagccgcagccgcttctacaccgtcatcagccactacagcgtggccaagcagagcacagcccgggccatcggcccctggctgtctgctgctgctgtgtag

SEQ ID NO: 36048 - DNA, 1293 bp, Artificial Sequence
  Description of Artificial Sequence: Synthetic coding sequence
atggagggggagcccagccagccccccaacagctcctggcccctgagccagaatggcaccaacacagaggccaccccagccaccaacctgaccttcagcagctactaccagcacaccagccctgtggccgccatgtttattgtggcctatgccctgatcttcctgctgtgcatggtgggcaacaccctggtgtgcttcatcgtgctgaagaacagacacatgcacacagtgaccaacatgttcatcctgaacctggccgtgtctgacctgctggtgggcatcttctgcatgcccaccaccctggtggacaacctgatcaccggctggccctttgacaatgccacctgcaagatgagcggcctggtgcagggcatgtctgtgtctgccagcgtcttcaccctggtggccatcgctgtggagcgcttccgctgcatcgtgcaccccttccgggagaagctgaccctgaggaaggccctggtgaccatcgctgtgatctgggccctggccctgctgatcatgtgccccagcgctgtgaccctgactgtgacccgggaggagcaccacttcatggtggatgccaggaacagaagctaccccctgtacagctgctgggaggcctggccagagaagggcatgagaagagtgtacaccaccgtgctcttcagccacatctacctggcccccctggccctgattgtggtgatgtatgccagaattgccaggaagctgtgccaggcccctggccctgcccctggaggagaggaggccgctgacccccgggccagcagaagaagagcccgggtggtgcacatgctggtgatggtggccctcttcttcaccctgtcctggctgcccctgtgggccctgctgctgctgattgattatggccagctgagcgccccccagctgcacctggtgacagtgtatgccttcccctttgcccactggctggccttcttcaacagcagcgccaaccccatcatctacggctacttcaatgaaaacttcagaagaggcttccaggccgccttccgggcccggctgtgcccccggcccagcggcagccacaaggaggcctacagcgagaggcctgggggcctgctgcaccggcgggtgtttgtggtggtgcggcccagcgacagcggcctgcccagcgagagcggccccagcagcggggccccccggcccggccgcctgcccctgagaaatggccgggtggcccaccacggcctgccccgggagggccctggctgcagccacctgcccctgaccatcccagcctgggacatctag

SEQ ID NO: 36049 - DNA, 1287 bp, Artificial Sequence
  Description of Artificial Sequence: Synthetic coding sequence
ggggagcccagccagccccccaacagctcctggcccctgagccagaatggcaccaacacagaggccaccccagccaccaacctgaccttcagcagctactaccagcacaccagccctgtggccgccatgtttattgtggcctatgccctgatcttcctgctgtgcatggtgggcaacaccctggtgtgcttcatcgtgctgaagaacagacacatgcacacagtgaccaacatgttcatcctgaacctggccgtgtctgacctgctggtgggcatcttctgcatgcccaccaccctggtggacaacctgatcaccggctggccctttgacaatgccacctgcaagatgagcggcctggtgcagggcatgtctgtgtctgccagcgtcttcaccctggtggccatcgctgtggagcgcttccgctgcatcgtgcaccccttccgggagaagctgaccctgaggaaggccctggtgaccatcgctgtgatctgggccctggccctgctgatcatgtgccccagcgctgtgaccctgactgtgacccgggaggagcaccacttcatggtggatgccaggaacagaagctaccccctgtacagctgctgggaggcctggccagagaagggcatgagaagagtgtacaccaccgtgctcttcagccacatctacctggcccccctggccctgattgtggtgatgtatgccagaattgccaggaagctgtgccaggcccctggccctgcccctggaggagaggaggccgctgacccccgggccagcagaagaagagcccgggtggtgcacatgctggtgatggtggccctcttcttcaccctgtcctggctgcccctgtgggccctgctgctgctgattgattatggccagctgagcgccccccagctgcacctggtgacagtgtatgccttcccctttgcccactggctggccttcttcaacagcagcgccaaccccatcatctacggctacttcaatgaaaacttcagaagaggcttccaggccgccttccgggcccggctgtgcccccggcccagcggcagccacaaggaggcctacagcgagaggcctgggggcctgctgcaccggcgggtgtttgtggtggtgcggcccagcgacagcggcctgcccagcgagagcggccccagcagcggggccccccggcccggccgcctgcccctgagaaatggccgggtggcccaccacggcctgccccgggagggccctggctgcagccacctgcccctgaccatcccagcctgggacatctag

SEQ ID NO: 36050 - DNA, 1569 bp, Artificial Sequence
  Description of Artificial Sequence: Synthetic coding sequence
atgaacagcttcttcggcaccccagctgcctcctggtgcctgctggagagtgatgtgtcctctgccccagacaaggaggccggccgggagcggcgggccctgtctgtgcagcagaggggcggccctgcctggagcggcagcctggagtggagccggcagagcgctggggacagaagaaggctgggcctgagccggcagacagccaagagctcctggagccgcagccgggacaggacctgctgctgcagaagagcctggtggatcctggtgcctgctgctgaccgggcccggcgggagcgcttcatcatgaatgagaagtgggacaccaacagcagcgagaactggcaccccatctggaatgtgaatgacaccaagcaccacctgtacagcgacatcaacatcacctacgtgaactactacctgcaccagccccaggtggccgccatcttcatcatctcctacttcctgatcttcttcctgtgcatgatgggcaacacagtggtgtgcttcatcgtgatgaggaacaagcacatgcacacagtgaccaacctcttcatcctgaacctggccatcagtgacctgctggtgggcatcttctgcatgcccatcaccctgctggacaacatcatcgccggctggccctttggaaacaccatgtgcaagatcagcggcctggtgcagggcatctctgtggccgccagcgtcttcaccctggtggccatcgctgtggaccgcttccagtgtgtggtgtaccccttcaagcccaagctgaccatcaagacagcctttgtgatcatcatgatcatctgggtgctggccatcaccatcatgagccccagcgctgtgatgctgcacgtgcaggaggagaagtactacagagtgcggctgaacagccagaacaagaccagccctgtgtactggtgccgggaggactggcccaaccaggagatgaggaagatctacaccaccgtgctgtttgccaacatctacctggcccccctgagcctgattgtcatcatgtatggccgcatcggcatcagcctcttccgggctgctgtgccccacacaggcaggaagaaccaggagcagtggcacgtggtgtccaggaagaagcagaagatcatcaagatgctgctgattgtggccctgctcttcatcctgtcctggctgcccctgtggaccctgatgatgctgagtgactatgctgacctgagccccaatgagctgcagatcatcaacatctacatctacccctttgcccactggctggcctttggaaacagctctgtgaaccccatcatctacggcttcttcaatgaaaacttcagaagaggcttccaggaggccttccagctgcagctgtgccagaagagggccaagcccatggaggcctatgccctgaaggccaagagccacgtgctgatcaacaccagcaaccagctggtgcaggagagcaccttccagaacccccatggagagaccctgctgtacaggaagtctgctgagaagccccagcaggagctggtgatggaggagctgaaggagaccaccaacagcagcgagatctag

SEQ ID NO: 36051 - DNA, 399 bp, Artificial Sequence
  Description of Artificial Sequence: Synthetic coding sequence
atgaacagcttcttcggcaccccagctgcctcctggtgcctgctggagagtgatgtgtcctctgccccagacaaggaggccggccgggagcggcgggccctgtctgtgcagcagaggggcggccctgcctggagcggcagcctggagtggagccggcagagcgctggggacagaagaaggctgggcctgagccggcagacagccaagagctcctggagccgcagccgggacaggacctgctgctgcagaagagcctggtggatcctggtgcctgctgctgaccgggcccggcgggagaggatggccatctggaagcatgatgtgcaggaccagtggattggccctggcaacatctgccgctccttcagcctgtatgtgtcctgcaactgctgcaggtag

SEQ ID NO: 36052 - DNA, 1263 bp, Artificial Sequence
  Description of Artificial Sequence: Synthetic coding sequence
atgaatgagaagtgggacaccaacagcagcgagaactggcaccccatctggaatgtgaatgacaccaagcaccacctgtacagcgacatcaacatcacctacgtgaactactacctgcaccagccccaggtggccgccatcttcatcatctcctacttcctgatcttcttcctgtgcatgatgggcaacacagtggtgtgcttcatcgtgatgaggaacaagcacatgcacacagtgaccaacctcttcatcctgaacctggccatcagtgacctgctggtgggcatcttctgcatgcccatcaccctgctggacaacatcatcgccggctggccctttggaaacaccatgtgcaagatcagcggcctggtgcagggcatctctgtggccgccagcgtcttcaccctggtggccatcgctgtggaccgcttccagtgtgtggtgtaccccttcaagcccaagctgaccatcaagacagcctttgtgatcatcatgatcatctgggtgctggccatcaccatcatgagccccagcgctgtgatgctgcacgtgcaggaggagaagtactacagagtgcggctgaacagccagaacaagaccagccctgtgtactggtgccgggaggactggcccaaccaggagatgaggaagatctacaccaccgtgctgtttgccaacatctacctggcccccctgagcctgattgtcatcatgtatggccgcatcggcatcagcctcttccgggctgctgtgccccacacaggcaggaagaaccaggagcagtggcacgtggtgtccaggaagaagcagaagatcatcaagatgctgctgattgtggccctgctcttcatcctgtcctggctgcccctgtggaccctgatgatgctgagtgactatgctgacctgagccccaatgagctgcagatcatcaacatctacatctacccctttgcccactggctggcctttggaaacagctctgtgaaccccatcatctacggcttcttcaatgaaaacttcagaagaggcttccaggaggccttccagctgcagctgtgccagaagagggccaagcccatggaggcctatgccctgaaggccaagagccacgtgctgatcaacaccagcaaccagctggtgcaggagagcaccttccagaacccccatggagagaccctgctgtacaggaagtctgctgagaagccccagcaggagctggtgatggaggagctgaaggagaccaccaacagcagcgagatctag

SEQ ID NO: 36053 - DNA, 1272 bp, Artificial Sequence
  Description of Artificial Sequence: Synthetic coding sequence
atgttcatcatgaatgagaagtgggacaccaacagcagcgagaactggcaccccatctggaatgtgaatgacaccaagcaccacctgtacagcgacatcaacatcacctacgtgaactactacctgcaccagccccaggtggccgccatcttcatcatctcctacttcctgatcttcttcctgtgcatgatgggcaacacagtggtgtgcttcatcgtgatgaggaacaagcacatgcacacagtgaccaacctcttcatcctgaacctggccatcagtgacctgctggtgggcatcttctgcatgcccatcaccctgctggacaacatcatcgccggctggcccttcggcaacaccatgtgcaagatcagcggcctggtgcagggcatctctgtggccgcctctgtgttcaccctggtggccatcgctgtggaccgcttccagtgtgtggtgtaccccttcaagcccaagctgaccatcaagacagccttcgtcatcatcatgatcatctgggtgctggccatcaccatcatgagccccagcgctgtgatgctgcacgtgcaggaggagaagtactacagagtgcggctgaacagccagaacaagaccagccctgtgtactggtgccgggaggactggcccaaccaggagatgaggaagatctacaccaccgtgctgtttgccaacatctacctggcccccctgagcctcatcgtcatcatgtatggaagaattggcatcagcctcttccgggctgctgtgccccacactggaaggaagaaccaggagcagtggcacgtggtgtccaggaagaagcagaagatcatcaagatgctgctgattgtggccctgctcttcatcctgtcctggctgcccctgtggaccctgatgatgctgagtgactatgctgacctgagccccaatgagctgcagatcatcaacatctacatctacccctttgcccactggctggccttcggcaacagctctgtgaaccccatcatctacggcttcttcaatgaaaacttccggcggggcttccaggaggccttccagctgcagctgtgccagaagagggccaagcccatggaggcctatgccctgaaggccaagagccacgtgctgatcaacaccagcaaccagctggtgcaggagagcaccttccagaacccccacggggagaccctgctgtacaggaagtctgctgagaagccccagcaggagctggtgatggaggagctgaaggagaccaccaacagcagcgagatctag

SEQ ID NO: 36054 - DNA, 1002 bp, Artificial Sequence
  Description of Artificial Sequence: Synthetic coding sequence
atgcaggccgccggccaccctgagcccctggacagccggggcagcttcagcctgcccaccatgggcgccaacgtgtcccaggacaatggaacaggccacaatgccaccttcagcgagcccctgcccttcctgtatgtgctgctgcctgctgtgtacagcggcatctgtgctgtgggcctgactggaaacacagctgtgatcctggtgatcctgcgggcccccaagatgaagacagtgaccaacgtgttcatcctgaacctggccgtggctgatggcctcttcaccctggtgctgcctgtgaacattgctgagcacctgctgcagtactggccctttggagagctgctgtgcaagctggtgctggccgtggaccactacaacatcttcagcagcatctacttcctggccgtgatgtctgtggaccgctacctggtggtgctggccaccgtgcgcagccgccacatgccctggaggacctacagaggagccaaggtggccagcctgtgtgtgtggctgggcgtgacagtgctggtgctgcccttcttctcctttgctggggtgtacagcaatgagctgcaggtgcccagctgtggcctgtccttcccctggccagagcaggtgtggttcaaggccagccgggtgtacaccctggtgctgggctttgtgctgcctgtgtgcaccatctgtgtgctgtacacagacctgctgcggcggctgcgggctgtgcggctgcggagcggggccaaggccctgggcaaggcccggaggaaggtgacagtgctggtgctggtggtgctggccgtgtgcctgctgtgctggacccccttccacctggcctctgtggtggccctgaccacagacctgccccagacccccctggtgatctccatgtcctatgtgatcaccagcctgtcctatgccaacagctgcctgaaccccttcctgtatgccttcctggatgacaacttcaggaagaacttccgcagcatcctgcgctgctag

SEQ ID NO: 36055 - DNA, 1578 bp, Artificial Sequence
  Description of Artificial Sequence: Synthetic coding sequence
atggccctggagcggctgtgcagcgtgctgaaggtgctgctgatcaccgtgctggtggtggagggcattgctgtggcccagaagacccaggacggccagaacatcggcatcaagcacatcccagccacccagtgtggcatctgggtgaggaccagcaatggaggccactttgccagccccaactacccagacagctacccacccaacaaggagtgcatctacatcctggaggccgccccccggcagagaattgagctgacctttgatgagcactactacatcgagcccagctttgaatgtagatttgaccacctggaggtgagagatggccccttcggcttcagccccctgattgaccgctactgcggcgtgaagagccccccactcatccgcagcacaggccgcttcatgtggatcaagttcagcagtgatgaggagctggagggcctgggcttccgggccaagtacagcttcatcccagaccctgacttcacctacctgggcggcatcctgaaccccatcccagactgccagtttgagctgagcggggctgatggcatcgtgcgcagcagccaggtggagcaggaggagaagaccaagccaggccaggccgtggactgcatctggaccatcaaggccacccccaaggccaagatctacctgcgcttcctggactaccagatggagcacagcaatgaatgcaagaggaactttgtggccgtgtatgatggcagcagcagcattgagaacctgaaggccaagttctgcagcacagtggccaatgatgtgatgctgaagacaggaattggagtcatccgcatgtgggcagatgagggcagccggctgagccgcttcaggatgctgttcaccagctttgtggagcccccctgcaccagcagcaccttcttctgccacagcaacatgtgcatcaacaacagcctggtgtgcaatggagtgcagaactgtgcctacccctgggatgagaaccactgcaaggagaagaagaaggccggcgtgtttgagcagatcaccaagacccacggcaccatcatcggcatcaccagcggcatcgtgctggtgctgctgatcatcagcatcctggtgcaggtgaagcagcccaggaagaaggtgatggcctgcaagacagccttcaacaagacaggcttccaggaggtgtttgatcctccccactatgagctgttcagcctgcgggacaaggagatctctgctgacctggccgacctgtctgaggagctggacaactaccagaagatgaggaggagcagcacagccagccgctgcatccatgaccaccactgcggcagccaggccagctctgtgaagcagagcaggaccaacctgagctccatggagctgcccttcagaaatgactttgcccagccccagcccatgaagaccttcaacagcaccttcaagaagagcagctacaccttcaagcagggccacgagtgcccagagcaggccctggaggacagagtgatggaggagatcccctgtgagatctacgtgcggggccgggaggacagcgcccaggccagcatcagcattgacttctag

SEQ ID NO: 36056 - DNA, 1578 bp, Artificial Sequence; identical to SEQ ID NO: 36055
  Description of Artificial Sequence: Synthetic coding sequence

SEQ ID NO: 36057 - DNA, 1233 bp, Artificial Sequence
  Description of Artificial Sequence: Synthetic coding sequence
atggagaccagcagcccccggcccccccggcccagcagcaaccctggcctgagcctggatgcccggctgggcgtggacacccggctgtgggccaaggtgctcttcaccgccctgtatgccctgatctgggccctgggcgctgctggaaatgccctgagcgcccacgtggtgctgaaggcccgggccggccgggccggccgcctgcggcaccacgtgctgagcctggccctggccggcctgctgctgctgctggtgggcgtgcctgtggagctgtacagctttgtgtggttccactacccctgggtgtttggagacctgggctgccggggctactactttgtgcatgagctgtgtgcctatgccaccgtgctgtctgtggccggcctgtctgctgagcgctgcctggccgtgtgccagcccctgcgggcccggagcctgctgacccccaggaggacccgctggctggtggccctgtcctgggccgccagcctgggcctggccctgcccatggctgtgatcatgggccagaagcatgagctggagacagcagatggagagcctgagcccgccagccgggtgtgcaccgtgctggtgtccaggacagccctgcaggtgttcatccaggtgaatgtgctggtgtcctttgtgctgcccctggccctgacagccttcctgaatggagtgacagtgagccacctgctggccctgtgcagccaggtgcccagcaccagcaccccaggcagcagcacccccagccggctggagctgctgtctgaggagggcctgctgtccttcatcgtgtggaagaagaccttcatccagggcggccaggtgtccctggtgcgccacaaggatgtgcggcgcatccgcagcctgcagaggtctgtgcaggtgctgcgggccatcgtggtgatgtatgtgatctgctggctgccctaccacgcccggcggctgatgtactgctacgtgcctgatgatgcctggacagaccccctgtacaacttctaccactacttctacatggtgaccaacaccctcttctacgtgtcctctgctgtgacccccctgctgtacaatgctgtgagcagcagcttcaggaagctgttcctggaggccgtgagcagcctgtgtggggagcaccaccccatgaagaggctgccccccaagccccagagccccaccctgatggacacagccagcggctttggagaccccccagagaccaggacatag

SEQ ID NO: 36058 - DNA, 1692 bp, Artificial Sequence
  Description of Artificial Sequence: Synthetic coding sequence
atgctggaggaggccggggaggtgctggagaacatgctgaaggccagctgcctgcccctgggcttcatcgtgttcctgcctgctgtgctgctgctggtggccccacccctgcctgctgctgatgctgcccacgagttcaccgtgtacaggatgcagcagtatgacctgcagggccagccctacggcaccagaaatgctgtgctgaacacagaggcccggaccatggctgctgaggtgctgagccgccgctgtgtgctgatgaggctgctggacttctcctatgagcagtaccagaaggccctgcggcagagcgctggagctgtggtgatcatcctgccccgggccatggctgctgtgccccaggatgtggtgcggcagttcatggagattgagcctgagatgctggccatggagacagctgtgcctgtgtactttgctgtggaggatgaggccctgctgagcatctacaagcagacccaggccgccagcgccagccagggcagcgccagcgctgctgaggtgctgctgaggacagccacagccaacggcttccagatggtgaccagcggcgtgcagagcaaggctgtgtctgactggctgattgcctctgtggagggccgcctgaccggcctgggcggggaggacctgcccaccatcgtgattgtggcccactatgatgccttcggcgtggccccctggctgagcctgggcgctgacagcaatggaagtggagtgtctgtgctgctggagctggcccggctcttcagccggctgtacacctacaagaggacccacgccgcctacaacctgctcttctttgccagcggcggcggcaagttcaactaccagggcaccaagcgctggctggaggacaacctggaccacacagacagcagcctgctgcaggacaacgtggcctttgtgctgtgcctggacacagtgggccggggcagcagcctgcacctgcacgtgtccaagccaccccgggagggcaccctgcagcacgccttcctgcgggagctggagaccgtggccgcccaccagtttcctgaggtgcgcttctccatggtgcacaagaggatcaacctggctgaagatgtgctggcctgggagcacgagagatttgccatccggcggctgcctgccttcaccctgagccacctggagagccacagagatggccagaggagcagcatcatggatgtgcgcagccgggtggacagcaagaccctgaccaggaacacccgcatcatcgccgaggccctgaccagggtcatctacaacctgacagagaagggcaccccaccagacatgcctgtgttcacagagcagatgcagatccagcaggagcagctggacagcgtgatggactggctgaccaaccagcccagggctgcccagctggtggacaaggacagcaccttcctgagcaccctggagcaccacctgagccgctacctgaaggatgtgaagcagcaccacgtgaaggctgacaagagggaccctgagtttgtgttctatgaccagctgaagcaggtgatgaatgcctacagagtgaagccagctgtgtttgacctgctgctggccgtgggcattgctgcctacctgggcatggcctacgtggccgtgcagcacttcagcctgctgtacaagacagtgcagaggctgctggtgaaggccaagacccagtag

SEQ ID NO: 36059 - DNA, 1233 bp, Artificial Sequence
  Description of Artificial Sequence: Synthetic coding sequence
atgggcgcccaggtgcggctgcccccaggagagccctgccgggagggctacgtgctgagcctggtgtgccccaacagcagccaggcctggtgtgagatcaccaacgtgtcccagctgctggccagccctgtgctgtacacagacctgaactacagcatcaacaacctgagcatcagcgccaacgtggagaacaagtacagcctgtatgtgggcctggtgctggccgtgagcagcagcatcttcatcggcagcagcttcatcctgaagaagaagggcctgctgcagctggccagcaagggcttcacccgggccggccagggcggccacagctacctgaaggagtggctgtggtgggtgggcctgctgtccatgggcgctggggaggccgccaactttgctgcctatgcctttgccccagccaccctggtgacccccctgggcgccctgtctgtgctgatcagcgccatcctgagcagctacttcctgaatgagcacctgaacatccacggcaagattggctgcatcctgagcatcctgggcagcacagtgatggtgattcatgccccccaggaggaggaggtgaccagcctgcacgagatggagatgaagctgcgggaccccggcttcatcagctttgctgtgatcatcaccgtcatcagcctggtgctgatcctgattgtggcccccaagaagggccagaccaacatcctggtgtacatcagcatctgcagcctcatcggggccttctctgtgtcctctgtgaagggcctgggcatcgccatcaaggagctgattgagtggaagcctgtgtacaagcaccccctggtgtttgtgctgctggccgtgctggtgctgtctgtgaccacccagatcaactacctgaacaaggccctggacaccttcaacaccagcctggtgacccccatctactacgtgttcttcacctccatggtggtgacctgcagcgccatcctcttccaggagtggtacggcatgacagctggggacatcatcggcaccctgagcggcttcttcaccatcatcatcggcatcttcctgctgcacgccttcaagaacacagacatcacctggagcgagctgaccagcacagccaagaaggaggccgtgtccctgaatgtgaatgaaaacaactacgtgctgctggagaacctggagtgcagcgcccctggctacaatgatgatgtgaccctcttcagcaggacagatgactag

SEQ ID NO: 36060 - DNA, 1107 bp, Artificial Sequence
  Description of Artificial Sequence: Synthetic coding sequence
atggctgctgtggccccagctggccctggggacagcgccagcgctgccctggatgagctgagcctgaacttcacctacggggcccctggagctggaaatggcagcctgagcggggactggtacagaagaaaccagatccacctgtttggagtgctgctggccatcctgggcaacctggtgatcagcatcagcctgaacatccagaagtacagccacctgcagctggcccagcaggagcacccccggccctacttcaagtctgtgctgtggtggggcggcgtgctgctgatggctgtgggggagaccggcaactttgctgcctacggctttgcccccatcaccctcatcgcccccctgggctgtgtgtctgtgactggaagtgccatcatctctgtgaccttcctgaaggacaacctgcgggccagtgacctgctgggcaccaccctggcctttgctggcacctacctgctggtgaactttgcccccaacatcacccaggccatcagcgccaggacagtgcagtactacctggtgggctggcagttcctgatctacgtgatcctggagatcctgatcttctgcatcctgctgtacttctacaagaggaagggcatgaagcacatggtgatcctgctgaccctggtggccatcctggccagcctgaccgtcatctctgtgaaggctgtgtctggcatgatcaccttctctgtgatggacaagatgcagctgacctaccccatcttctacatcatgttcatcatcatgattgccagctgtgtgttccaggtgaagttcctgaaccaggccaccaagctgtacaacaccaccaccgtggtgcctgtgaaccacatcttcttcaccatcagcgccatcatcgccggcatcatcttctaccaggagttcctgggcgcccccttcctgaccgtcttcatctacctgtttggctgcttcctgtccttcctgggcgtcttcctggtgaccaggaaccgggagaaggagcacctgcagcagagctacatcgactttggaaacatcccagacaccaccccagagaggaaggcctggagggagaccaacgtgggccagaacaccacccgcttcacctag

SEQ ID NO: 36061 - DNA, 975 bp, Artificial Sequence
  Description of Artificial Sequence: Synthetic coding sequence
atgctgctgggggagctgggcgtgtttgccagctatgcctttgcccccctgagcctcatcgtgcccctgtctgctgtgtctgtgattgccagcgccatcatcggcatcatcttcatcaaggagaagtggaagcccaaggacttcctgcggcgctacgtgctgagctttgtgggctgcggcctggccgtggtgggcacctacctgctggtgacctttgcccccaacagccatgagaagatgactggagaaaatgtgaccaggcacctggtgtcctggcccttcctgctgtacatgctggtggagatcatcctcttctgcctgctgctgtacttctacaaggagaagaatgccaacaacatcgtggtgatcctgctgctggtggccctgctgggctccatgacagtggtgacagtgaaggctgtggccggcatgctggtgctgagcatccagggcaacctgcagctggactaccccatcttctacgtgatgtttgtgtgcatggtggccacagctgtgtaccaggccgccttcctgagccaggccagccagatgtatgacagcagcctcatcgcctctgtgggctacatcctgagcaccaccatcgccatcacagctggggccatcttctacctggacttcatcggggaggatgtgctgcacatctgcatgtttgccctgggctgcctgattgccttcctgggcgtcttcctgatcaccaggaacaggaagaagcccatcccctttgagccctacatctccatggatgccatgcctggcatgcagaacatgcatgacaagggcatgacagtgcagcctgagctgaaggccagcttctcctatggagccctggagaacaatgacaacatcagcgagatctatgccccagccaccctgcctgtgatgcaggaggagcacggcagccgcagcgccagcggcgtgccctacagagtgctggagcacaccaagaaggagtag

SEQ ID NO: 36062 - DNA, 1107 bp, Artificial Sequence
  Description of Artificial Sequence: Synthetic coding sequence
atggatggcagccacagcgctgccctgaagctgcagcagctgccccccaccagcagcagcagcgctgtgtctgaggccagcttctcctacaaggagaacctgattggagccctgctggccatcttcggccacctggtggtgtccatcgccctgaacctgcagaagtactgccacatccggctggccggcagcaaggacccccgggcctacttcaagaccaagacctggtggctgggcctcttcctgatgctgctgggggagctgggcgtgtttgccagctatgcctttgcccccctgagcctcatcgtgcccctgtctgctgtgtctgtgattgccagcgccatcatcggcatcatcttcatcaaggagaagtggaagcccaaggacttcctgcggcgctacgtgctgagctttgtgggctgcggcctggccgtggtgggcacctacctgctggtgacctttgcccccaacagccatgagaagatgactggagaaaatgtgaccaggcacctggtgtcctggcccttcctgctgtacatgctggtggagatcatcctcttctgcctgctgctgtacttctacaaggagaagaatgccaacaacatcgtggtgatcctgctgctggtggccctgctgggctccatgacagtggtgacagtgaaggctgtggccggcatgctggtgctgagcatccagggcaacctgcagctggactaccccatcttctacgtgatgtttgtgtgcatggtggccacagctgtgtaccaggccgccttcctgagccaggccagccagatgtatgacagcagcctcatcgcctctgtgggctacatcctgagcaccaccatcgccatcacagctggggccatcttctacctggacttcatcggggaggatgtgctgcacatctgcatgtttgccctgggctgcctgattgccttcctgggcgtcttcctgatcaccaggaacaggaagaagcccatcccctttgagccctacatctccatggatgccatgccagacagctacctgcacaaccggcagctgctcttcaagcgctacagcaacagcaggaacctgccccaccacaacctggagagcctgtag

SEQ ID NO: 36063 - DNA, 681 bp, Artificial Sequence
  Description of Artificial Sequence: Synthetic coding sequence
atggatggcagccacagcgctgccctgaagctgcagcagctgccccccaccagcagcagcagcgctgtgtctgaggccagcttctcctacaaggagaacctgattggagccctgctggccatcttcggccacctggtggtgtccatcgccctgaacctgcagaagtactgccacatccggctggccggcagcaaggacccccgggcctacttcaagaccaagacctggtggctgggcctcttcctgatgctgctgggggagctgggcgtgtttgccagctatgcctttgcccccctgagcctcatcgtgcccctgtctgctgtgtctgtgattgccagcgccatcatcggcatcatcttcatcaaggagaagtggaagcccaaggacttcctgcggcgctacgtgctgagctttgtgggctgcggcctggccgtggtgggcacctacctgctggtgacctttgcccccaacagccatgagaagatgactggagaaaatgtgaccaggcacctggtgtcctggcccttcctgctgtacatgctggtggagatcatcctcttctgcctgctgctgtacttctacaaggagaagaatgccaacaacatcgtggtgatcctgctgctggtggccctgctggtgctgctgtgccaccctggctggagcgctgtggtgcagagctag

SEQ ID NO: 36064 - DNA, 1221 bp, Artificial Sequence
  Description of Artificial Sequence: Synthetic coding sequence
atggatggcagccacagcgctgccctgaagctgcagcagctgccccccaccagcagcagcagcgctgtgtctgaggccagcttctcctacaaggagaacctgattggagccctgctggccatcttcggccacctggtggtgtccatcgccctgaacctgcagaagtactgccacatccggctggccggcagcaaggacccccgggcctacttcaagaccaagacctggtggctgggcctcttcctgatgctgctgggggagctgggcgtgtttgccagctatgcctttgcccccctgagcctcatcgtgcccctgtctgctgtgtctgtgattgccagcgccatcatcggcatcatcttcatcaaggagaagtggaagcccaaggacttcctgcggcgctacgtgctgagctttgtgggctgcggcctggccgtggtgggcacctacctgctggtgacctttgcccccaacagccatgagaagatgactggagaaaatgtgaccaggcacctggtgtcctggcccttcctgctgtacatgctggtggagatcatcctcttctgcctgctgctgtacttctacaaggagaagaatgccaacaacatcgtggtgatcctgctgctggtggccctgctgggctccatgacagtggtgacagtgaaggctgtggccggcatgctggtgctgagcatccagggcaacctgcagctggactaccccatcttctacgtgatgtttgtgtgcatggtggccacagctgtgtaccaggccgccttcctgagccaggccagccagatgtatgacagcagcctcatcgcctctgtgggctacatcctgagcaccaccatcgccatcacagctggggccatcttctacctggacttcatcggggaggatgtgctgcacatctgcatgtttgccctgggctgcctgattgccttcctgggcgtcttcctgatcaccaggaacaggaagaagcccatcccctttgagccctacatctccatggatgccatgcctggcatgcagaacatgcatgacaagggcatgacagtgcagcctgagctgaaggccagcttctcctatggagccctggagaacaatgacaacatcagcgagatctatgccccagccaccctgcctgtgatgcaggaggagcacggcagccgcagcgccagcggcgtgccctacagagtgctggagcacaccaagaaggagtag

SEQ ID NO: 36065 - DNA, 681 bp, Artificial Sequence; identical to SEQ ID NO: 36063
  Description of Artificial Sequence: Synthetic coding sequence

SEQ ID NO: 36066 - DNA, 405 bp, Artificial Sequence
  Description of Artificial Sequence: Synthetic coding sequence
tgagtggccggcatgctggtgctgagcatccagggcaacctgcagctggactaccccatcttctacgtgatgtttgtgtgcatggtggccacagctgtgtaccaggccgccttcagcaagacagacagcagccctgccaatgaaaacaacagcccctacctgcgggagagccatgaggccctgatgaggatgagcctgggcaagtgccctgtgtttgagagcagcctgacagatgtgcggctgctgtttgactgccagtgtggcctgcacagcgtgcacaaccactgctaccacagccgctgcaacatcctgcccggcctgcaccggggcggccgggccgcccacctgcacgtgtgcaccggggtgccccactgcatcctgggccgcctgctgaaccacgcctag

SEQ ID NO: 36067 - DNA, 4515 bp, Artificial Sequence
  Description of Artificial Sequence: Synthetic coding sequence
atggccacagcccggacctttggacctgagcgggaggccgagcccgccaaggaggcccgggtggtgggcagcgagctggtggacacctacacagtgtacatcatccaggtgacagatggcagccatgagtggacagtgaagcaccgctacagcgacttccatgacctgcacgagaagctggtggccgagaggaagattgacaagaacctgctgccccccaagaagatcatcggcaagaacagccgcagcctggtggagaagcgggagaaggacctggaggtgtacctgcagaagctgctggccgccttccctggggtgaccccccgggtgctggcccacttcctgcacttccacttctatgagatcaatggcatcacagctgccctggccgaggagctgtttgagaagggggagcagctgctgggcgctggggaggtgtttgccatcggccccctgcagctgtatgctgtgacagagcagctgcagcagggcaagcccacctgtgccagcggagatgccaagacagacctgggccacatcctggacttcacctgccgcctgaagtacctgaaggtgtctggaacagagggccccttcggcaccagcaacatccaggagcagctgctgccctttgacctgagcatcttcaagagcctgcaccaggtggagatcagccactgtgatgccaagcacatccggggcctggtggccagcaagcccaccctggccaccctgtctgtgcgcttcagcgccacctccatgaaggaggtgctggtgcctgaggccagcgagtttgatgagtgggagcctgagggcaccaccctggagggccctgtgacagctgtgatccccacctggcaggccctgaccaccctggacctgagccacaacagcgtgtctgaaattgatgaatctgtgaagctgatccccaagattgagttcctggacctgagccacaacggcctgctggtggtggacaacctgcagcacctgtacaacctggtgcacctggacctgagctacaacaagctgagcagcctggagggcctgcacaccaagctgggcaacatcaagaccctgaacctggccggcaacctgctggagagcctgagcggcctgcacaagctgtacagcctggtgaacctggacctgcgggacaacagaattgagcagatggaggaggtgcgcagcatcggcagcctgccctgcctggagcacgtgtccctgctgaacaaccccctgagcatcatcccagactaccgcaccaaggtgctggcccagtttggagagcgggccagcgaggtgtgcctggatgacacagtgaccacagagaaggagctggacacagtggaggtgctgaaggccatccagaaggccaaggaggtgaagagcaagctgagcaaccctgagaagaagggaggagaggacagccggctgtctgctgccccctgcatccggcccagcagcagccccccaacagtggccccagccagcgccagcctgccccagcccatcctgagcaaccagggcatcatgtttgtgcaggaggaggccctggccagcagcctgagcagcacagacagcctgaccccagagcaccagcccatcgcccagggctgcagcgacagcctggagagcatcccagctggccaggccgccagtgatgacctgagagatgtgcctggagctgtgggcggggccagccctgagcacgccgagcctgaggtgcaggtggtgcccggcagcggccagatcatcttcctgcccttcacctgcatcggctacacagccaccaaccaggacttcatccagaggctgagcaccctcatccggcaggccatcgagcggcagctgcctgcctggattgaggccgccaaccagcgggaggagggccagggcgagcagggcgaggaggaggatgaggaggaggaggaggaggaggatgtggctgaaaatcgctactttgagatgggccccccagatgtggaggaggaggagggcggcggccagggcgaggaggaggaggaggaggaggaggatgaggaggccgaggaggagcggctggccctggagtgggccctgggcgcagatgaggacttcctgctggagcacatccgcatcctgaaggtgctgtggtgcttcctgattcatgtgcagggcagcatccggcagtttgctgcctgcctggtgctgacagactttggaattgctgtgtttgagatcccccaccaggagagccggggcagcagccagcacatcctgagcagcctgcgctttgtgttctgcttcccccatggagacctgacagaatttggcttcctgatgcctgagctgtgcctggtgctgaaggtgcgccacagcgagaacaccctcttcatcatcagtgatgctgccaacctgcacgagttccacgccgacctgcggagctgctttgccccccagcacatggccatgctgtgcagccccatcctgtatggcagccacaccagcctgcaggagttcctgcggcagctgctgaccttctacaaggtggccggcggctgccaggagaggagccagggctgcttccctgtgtacctggtgtacagcgacaagaggatggtgcagacagctgctggggactacagcggcaacatcgagtgggccagctgcaccctgtgcagcgctgtgagaagaagctgctgtgcccccagcgaggccgtgaagtctgctgccatcccctactggctgctgctgaccccccagcacctgaatgtcatcaaggctgacttcaaccccatgcccaacagaggcacccacaactgcaggaacagaaacagcttcaagctgagccgggtgcccctgagcacagtgctgctggaccccaccaggagctgcacccagcccaggggggcctttgctgatggccacgtgctggagctgctggtgggctacagatttgtgacagccatctttgtgctgccccatgagaagttccacttcctgcgggtgtacaaccagctgcgggccagcctgcaggacctgaagacagtggtgattgccaagaccccaggcactggaggcagcccccagggcagctttgctgatggccagcctgctgagcggcgggccagcaatgaccagaggccccaggaggtgcctgctgaggccctggccccagccccagctgaggtgcctgccccagccccagctgctgccagcgccagcggccctgccaagaccccagccccagctgaggccagcaccagcgccctggtgcctgaggagacccctgtggaggccccagcccctcctcctgctgaggccccagcccagtaccccagcgagcacctgatccaggccaccagcgaggagaaccagatccccagccacctgcctgcctgccccagcctgcggcacgtggccagcctgcggggcagcgccatcatcgagctgttccacagcagcattgctgaggtggagaatgaggagctgcggcacctgatgtggagctctgtggtgttctaccagaccccaggcctggaggtgacagcctgtgtgctgctgagcaccaaggctgtgtactttgtgctgcatgatggcctgcggcgctacttcagcgagcccctgcaggacttctggcaccagaagaacacagactacaacaacagccccttccacatcagccagtgctttgtgctgaagctgagtgacctgcagagcgtgaatgtgggcctgtttgaccagcacttccggctgaccggcagcacccccatgcaggtggtgacctgcctgacccgggacagctacctgacccactgcttcctgcagcacctgatggtggtgctgagcagcctggagaggacccccagccctgagcctgtggacaaggacttctacagcgagtttggaaacaagaccaccgggaagatggagaactatgagctgatccacagcagccgggtgaagttcacctaccccagcgaggaggagattggagacctgaccttcaccgtggcccagaagatggccgagcctgagaaggccccagccctgagcatcctgctgtatgtgcaggccttccaggtgggcatgcctcctcctggctgctgccggggccccctgcggcccaagaccctgctgctgaccagcagcgagatcttcctgctggatgaggactgtgtgcactaccccctgcctgagtttgccaaggagcccccccagagggaccgctaccgcctggatgatggaagaagagtgcgggacctggacagagtgctgatgggctaccagacctacccccaggccctgaccctggtgtttgatgatgtgcagggccatgacctgatgggctctgtgaccctggaccactttggagaggtgcctgggggccctgcccgggccagccagggccgggaggtgcagtggcaggtgtttgtgcccagcgctgagagccgggagaagctgatcagcctgctggcccggcagtgggaggccctgtgtggccgggagctgcctgtggagctgactggatag

SEQ ID NO: 36068 - DNA, 2457 bp, Artificial Sequence
  Description of Artificial Sequence: Synthetic coding sequence
atgggccccccagatgtggaggaggaggagggcggcggccagggcgaggaggaggaggaggaggaggaggatgaggaggccgaggaggagcggctggccctggagtgggccctgggcgcagatgaggacttcctgctggagcacatccgcatcctgaaggtgctgtggtgcttcctgattcatgtgcagggcagcatccggcagtttgctgcctgcctggtgctgacagactttggaattgctgtgtttgagatcccccaccaggagagccggggcagcagccagcacatcctgagcagcctgcgctttgtgttctgcttcccccatggagacctgacagaatttggcttcctgatgcctgagctgtgcctggtgctgaaggtgcgccacagcgagaacaccctcttcatcatcagtgatgctgccaacctgcacgagttccacgccgacctgcggagctgctttgccccccagcacatggccatgctgtgcagccccatcctgtatggcagccacaccagcctgcaggagttcctgcggcagctgctgaccttctacaaggtggccggcggctgccaggagaggagccagggctgcttccctgtgtacctggtgtacagcgacaagaggatggtgcagacagctgctggggactacagcggcaacatcgagtgggccagctgcaccctgtgcagcgctgtgagaagaagctgctgtgcccccagcgaggccgtgaagtctgctgccatcccctactggctgctgctgaccccccagcacctgaatgtcatcaaggctgacttcaaccccatgcccaacagaggcacccacaactgcaggaacagaaacagcttcaagctgagccgggtgcccctgagcacagtgctgctggaccccaccaggagctgcacccagcccaggggggcctttgctgatggccacgtgctggagctgctggtgggctacagatttgtgacagccatctttgtgctgccccatgagaagttccacttcctgcgggtgtacaaccagctgcgggccagcctgcaggacctgaagacagtggtgattgccaagaccccaggcactggaggcagcccccagggcagctttgctgatggccagcctgctgagcggcgggccagcaatgaccagaggccccaggaggtgcctgctgaggccctggccccagccccagctgaggtgcctgccccagccccagctgctgccagcgccagcggccctgccaagaccccagccccagctgaggccagcaccagcgccctggtgcctgaggagacccctgtggaggccccagcccctcctcctgctgaggccccagcccagtaccccagcgagcacctgatccaggccaccagcgaggagaaccagatccccagccacctgcctgcctgccccagcctgcggcacgtggccagcctgcggggcagcgccatcatcgagctgttccacagcagcattgctgaggtggagaatgaggagctgcggcacctgatgtggagctctgtggtgttctaccagaccccaggcctggaggtgacagcctgtgtgctgctgagcaccaaggctgtgtactttgtgctgcatgatggcctgcggcgctacttcagcgagcccctgcaggacttctggcaccagaagaacacagactacaacaacagccccttccacatcagccagtgctttgtgctgaagctgagtgacctgcagagcgtgaatgtgggcctgtttgaccagcacttccggctgaccggcagcacccccatgcaggtggtgacctgcctgacccgggacagctacctgacccactgcttcctgcagcacctgatggtggtgctgagcagcctggagaggacccccagccctgagcctgtggacaaggacttctacagcgagtttggaaacaagaccaccgggaagatggagaactatgagctgatccacagcagccgggtgaagttcacctaccccagcgaggaggagattggagacctgaccttcaccgtggcccagaagatggccgagcctgagaaggccccagccctgagcatcctgctgtatgtgcaggccttccaggtgggcatgcctcctcctggctgctgccggggccccctgcggcccaagaccctgctgctgaccagcagcgagatcttcctgctggatgaggactgtgtgcactaccccctgcctgagtttgccaaggagcccccccagagggaccgctaccgcctggatgatggaagaagagtgcgggacctggacagagtgctgatgggctaccagacctacccccaggccctgaccctggtgtttgatgatgtgcagggccatgacctgatgggcagcgctgagagccgggagaagctgatcagcctgctggcccggcagtgggaggccctgtgtggccgggagctgcctgtggagctgactggatag

SEQ ID NO: 36069 - DNA, 1287 bp, Artificial Sequence
  Description of Artificial Sequence: Synthetic coding sequence
atggccacagcccggacctttggacctgagcgggaggccgagcccgccaaggaggcccgggtggtgggcagcgagctggtggacacctacacagtgtacatcatccaggtgacagatggcagccatgagtggacagtgaagcaccgctacagcgacttccatgacctgcacgagaagctggtggccgagaggaagattgacaagaacctgctgccccccaagaagatcatcggcaagaacagccgcagcctggtggagaagcgggagaaggacctggaggtgtacctgcagaagctgctgacagcctgtgtgctgctgagcaccaaggctgtgtactttgtgctgcatgatggcctgcggcgctacttcagcgagcccctgcaggacttctggcaccagaagaacacagactacaacaacagccccttccacatcagccagtgctttgtgctgaagctgagtgacctgcagagcgtgaatgtgggcctgtttgaccagcacttccggctgaccggcagcacccccatgcaggtggtgacctgcctgacccgggacagctacctgacccactgcttcctgcagcacctgatggtggtgctgagcagcctggagaggacccccagccctgagcctgtggacaaggacttctacagcgagtttggaaacaagaccaccgggaagatggagaactatgagctgatccacagcagccgggtgaagttcacctaccccagcgaggaggagattggagacctgaccttcaccgtggcccagaagatggccgagcctgagaaggccccagccctgagcatcctgctgtatgtgcaggccttccaggtgggcatgcctcctcctggctgctgccggggccccctgcggcccaagaccctgctgctgaccagcagcgagatcttcctgctggatgaggactgtgtgcactaccccctgcctgagtttgccaaggagcccccccagagggaccgctaccgcctggatgatggaagaagagtgcgggacctggacagagtgctgatgggctaccagacctacccccaggccctgaccctggtgtttgatgatgtgcagggccatgacctgatgggctctgtgaccctggaccactttggagaggtgcctgggggccctgcccgggccagccagggccgggaggtgcagtggcaggtgtttgtgcccagcgctgagagccgggagaagctgatcagcctgctggcccggcagtgggaggccctgtgtggccgggagctgcctgtggagctgactggatag

SEQ ID NO: 36070 - DNA, 4515 bp, Artificial Sequence; identical to SEQ ID NO: 36067
  Description of Artificial Sequence: Synthetic coding sequence

SEQ ID NO: 36071 - DNA, 1752 bp, Artificial Sequence
  Description of Artificial Sequence: Synthetic coding sequence
atggccacagcccggacctttggacctgagcgggaggccgagcccgccaaggaggcccgggtggtgggcagcgagctggtggacacctacacagtgtacatcatccaggtgacagatggcagccatgagtggacagtgaagcaccgctacagcgacttccatgacctgcacgagaagctggtggccgagaggaagattgacaagaacctgctgccccccaagaagatcatcggcaagaacagccgcagcctggtggagaagcgggagaaggacctggaggtgtacctgcagaagctgctggccgccttccctggggtgaccccccgggtgctggcccacttcctgcacttccacttctatgagatcaatggcatcacagctgccctggccgaggagctgtttgagaagggggagcagctgctgggcgctggggaggtgtttgccatcggccccctgcagctgtatgctgtgacagagcagctgcagcagggcaagcccacctgtgccagcggagatgccaagacagacctgggccacatcctggacttcacctgccgcctgaagtacctgaaggtgtctggaacagagggccccttcggcaccagcaacatccaggagcagctgctgccctttgacctgagcatcttcaagagcctgcaccaggtggagatcagccactgtgatgccaagcacatccggggcctggtggccagcaagcccaccctggccaccctgtctgtgcgcttcagcgccacctccatgaaggaggtgctggtgcctgaggccagcgagtttgatgagtgggagcctgagggcaccaccctggagggccctgtgacagctgtgatccccacctggcaggccctgaccaccctggacctgagccacaacagcgtgtctgaaattgatgaatctgtgaagctgatccccaagattgagttcctggacctgagccacaacggcctgctggtggtggacaacctgcagcacctgtacaacctggtgcacctggacctgagctacaacaagctgagcagcctggagggcctgcacaccaagctgggcaacatcaagaccctgaacctggccggcaacctgctggagagcctgagcggcctgcacaagctgtacagcctggtgaacctggacctgcgggacaacagaattgagcagatggaggaggtgcgcagcatcggcagcctgccctgcctggagcacgtgtccctgctgaacaaccccctgagcatcatcccagactaccgcaccaaggtgctggcccagtttggagagcgggccagcgaggtgtgcctggatgacacagtgaccacagagaaggagctggacacagtggaggtgctgaaggccatccagaaggccaaggaggtgaagagcaagctgagcaaccctgagaagaagggaggagaggacagccggctgtctgctgccccctgcatccggcccagcagcagccccccaacagtggccccagccagcgccagcctgccccagcccatcctgagcaaccagggcaacagagtgtgcatcctgctgctggtggagccccacagccctgcctgggccccctggctgggctggggctggggccgcggggccagcacctgcttccagcagggccagacccagggcggccagtgcctgctgcaggccggcccccggggcggcacccacggccgcggggcctggccagatgccagctgctgcctgctgggggaggacagccagctgctgtag

SEQ ID NO: 36072 - DNA, 2097 bp, Artificial Sequence
  Description of Artificial Sequence: Synthetic coding sequence
atgctgcctgcccggctgcccttccggctgctgagcctcttcctgcggggcagcgcccccacagctgcccggcacggcctgcgggagcccctgctggagcggcgctgtgccgccgccagcagcttccagcacagcagcagcctgggccgggagctgccctatgaccctgtggacacagagggctttggagagggcggggacatgcaggagcgcttcctgtttcctgagtacatcctggaccctgagccccagcccacccgggagaagcagctgcaggagctgcagcagcagcaggaggaggaggagcggcagaggcagcagaggcgggaggagcggcggcagcagaacctgcgggcccggagccgggagcaccctgtggtgggccacccagaccctgccctgcccccatctggagtgaactgcagcggctgtggggctgagctgcactgccaggatgctggggtgcccggctacctgccccgggagaagttcctgaggacagctgaggctgatggcggcctggccaggacagtgtgccagcgctgctggctgctgagccaccacagaagagccctgcggctgcaggtgtcccgggagcagtacctggagctggtgtctgctgccctgcggcggcccggccccagcctggtgctgtacatggtggacctgctggacctgcctgatgccctgctgcctgacctgcctgccctggtgggccccaagcagctgattgtgctgggcaacaaggtggacctgctgccccaggatgcccctggctaccggcagaggctgcgggagcggctgtgggaggactgtgcccgggccggcctgctgctggcccctggccaccagggcccccagaggcctgtgaaggatgagccccaggatggagagaaccccaacccccccaactggagcaggacagtggtgagagatgtgcggctcatcagcgccaagacaggctacggcgtggaggagctgatcagcgccctgcagaggtcctggagatacagaggagatgtgtacctggtgggcgccaccaatgccggcaagagcaccctcttcaacaccctgctggagagtgactactgcacagccaagggcagcgaggccatcgaccgggccaccatcagcccctggccaggcaccaccctgaacctgctgaagttccccatctgcaaccccaccccctacaggatgttcaagaggcaccagaggctgaagaaggacagcacccaggccgaggaggacctgtctgagcaggagcagaaccagctgaatgtgctgaagaagcacggctacgtggtgggccgggtgggccgcaccttcctgtacagcgaggagcagaaggacaacatcccctttgaatttgatgctgacagcctggcctttgacatggagaatgaccctgtgatgggcacccacaagagcaccaagcaggtggagctgacagcccaggatgtgaaggatgcccactggttctatgacaccccaggcatcaccaaggagaactgcatcctgaacctgctgacagagaaggaggtgaacatcgtgctgcccacccagagcatcgtgcccaggacctttgtgctgaagccaggcatggtgctcttcctgggcgccatcggcagaattgacttcctgcagggcaaccagagcgcctggttcaccgtggtggccagcaacatcctgcctgtgcacatcaccagcctggacagagcagatgccctgtaccagaagcacgccggccacaccctgctgcagatccccatgggcggcaaggagaggatggccggcttcccccccctggtggccgaggacatcatgctgaaggagggcctgggcgccagcgaggccgtggccgacatcaagttcagcagcgctggctgggtgtctgtgacccccaacttcaaggaccggctgcacctgcggggctacaccccagagggcaccgtgctgactgtgcggccccccctgctgccctacatcgtgaacatcaagggccagaggatcaagaagtctgtggcctacaagaccaagaagccacccagcctgatgtacaacgtgaggaagaagaagggcaagatcaacgtgtag

SEQ ID NO: 36073 - DNA, 3669 bp, Artificial Sequence
  Description of Artificial Sequence: Synthetic coding sequence
atgctggtgggccagggcgccggccccctgggccctgctgtggtgacagctgctgtggtgctgctgctgagcggcgtgggccctgcccacggctctgaagatattgtggtgggctgcggcggctttgtgaagagtgatgtggagatcaactacagcctcatcgagatcaagctgtacaccaagcacggcaccctgaagtaccagacagactgtgcccccaacaacggctacttcatgatccccctgtatgacaagggggacttcatcctgaagattgagccccccctgggctggagctttgagcccaccaccgtggagctgcacgtggatggagtgtctgacatctgcaccaagggcggggacatcaactttgtgttcaccggcttctctgtgaatggcaaggtgctgagcaagggccagcccctgggccctgctggggtgcaggtgtccctgaggaacacaggaacagaggccaagatccagagcacagtgacccagcccggcggcaagtttgccttcttcaaggtgctgcccggggactatgagatcctggccacccaccccacctgggccctgaaggaggccagcaccaccgtgcgggtgaccaacagcaatgccaatgctgccagccccctgattgtggccggctacaacgtgtctggctctgtgcggagtgatggagagcccatgaagggcgtgaagttcctgctcttcagcagcctggtgaccaaggaggatgtgctgggctgcaatgtgtcccctgtgcccggcttccagccccaggatgagagcctggtgtacctgtgctacacagtgtccagagaagatggcagcttctccttctacagcctgcccagcggcggctacaccgtcatccccttctacagaggagagcgcatcacctttgatgtggcccccagccggctggacttcaccgtggagcatgacagcctgaagattgagcccgtcttccacgtgatgggcttctctgtgacaggccgggtgctgaatggaccagaaggagatggagtgcctgaggccgtggtgaccctgaacaaccagatcaaggtgaagaccaaggcagatggcagcttccggctggagaacatcaccaccggcacctacaccatccacgcccagaaggagcacctgtactttgagaccgtgaccatcaagatcgcccccaacaccccccagctggccgacatcatcgccaccggcttctctgtgtgtggccagatcagcatcatccgcttcccagacacagtgaagcagatgaacaagtacaaggtggtgctgagcagccaggacaaggacaagagcctggtgacagtggagacagatgcccacggcagcttctgcttcaaggccaagccaggcacctacaaggtgcaggtgatggtgcctgaggccgagaccagggctggcctgaccctgaagccccagaccttccccctgactgtgaccaaccggcccatgatggatgtggcctttgtgcagttcctggcctctgtgtctgggaaggtgtcctgcctggacacctgtggggacctgctggtgaccctgcagagcctgagccggcagggcgagaagaggagcctgcagctgagcggcaaggtgaatgccatgaccttcacctttgacaacgtgctgcccgggaagtacaagatcagcatcatgcatgaggactggtgctggaagaacaagagcctggaggtggaggtgctggaggatgacatgtctgctgtggagttccggcagacaggctacatgctgcgctgcagcctgagccacgccatcaccctggagttctaccaggatggaaatggccgggagaatgtgggcatctacaacctgagcaaaggagtgaaccgcttctgcctgagcaagccaggagtgtacaaggtgacccccaggagctgccacagatttgagcaggccttctacacctatgacaccagcagccccagcatcctgaccctgacagccatccgccaccacgtgctgggcaccatcaccacagacaagatgatggatgtgacagtgaccatcaagagcagcattgacagcgagcccgccctggtgctgggccccctgaagtctgtgcaggagctgcggcgggagcagcagctggccgagattgaggcccggcggcaggagcgggagaagaatggaaatgaggagggggaggagaggatgaccaagccccctgtgcaggagatggtggatgagctgcagggccccttctcctatgacttctcctactgggcccggtctggagagaagatcaccgtgacccccagcagcaaggagctgctcttctacccacccagcatggaggccgtggtgtctggagagagctgccctgggaagctgattgagatccacggcaaggccggcctcttcctggagggccagatccaccctgagctggagggcgtggagatcgtcatcagcgagaagggggccagcagccccctcatcaccgtcttcacagatgacaagggggcctacagcgtgggccccctgcacagcgacctggagtacacagtgaccagccagaaggagggctacgtgctgacagctgtggagggcaccatcggggacttcaaggcctatgccctggccggcgtgtcctttgagatcaaggcagaagatgaccagcccctgcccggggtgctgctgagcctgagcggcggcctcttccgcagcaacctgctgacccaggacaatggcatcctgaccttcagcaacctgagccctggccagtactacttcaagcccatgatgaaggagttccgctttgagcccagcagccagatgattgaggtgcaggagggccagaacctgaagatcaccatcaccggctacagaacagcctacagctgctacggcaccgtgagcagcctgaatggagagcctgagcagggcgtggccatggaggccgtgggccagaatgactgcagcatctatggagaagatactgtgacagatgaggagggcaagttccggctgcggggcctgctgcccggctgtgtgtaccacgtgcagctgaaggccgagggcaatgaccacatcgagcgggccctgccccaccacagggtcatcgaggtgggcaacaatgacattgatgatgtgaacatcatcgtgttccggcagatcaaccagtttgacctgtctggaaatgtcatcaccagcagcgagtacctgcccaccctgtgggtgaagctgtacaagtctgagaacctggacaaccccatccagacagtgtccctgggccagagcctcttcttccacttcccccccctgctgagagatggagagaactacgtggtgctgctggacagcaccctgcccaggagccagtatgactacatcctgccccaggtgtccttcaccgctgtgggctaccacaagcacatcaccctcatcttcaaccccaccaggaagctgcctgagcaggacatcgcccagggcagctacatcgccctgcccctgaccctgctggtgctgctggccggctacaaccacgacaagctgatccccctgctgctgcagctgaccagccggctgcagggcgtgcgggccctgggccaggccgccagtgacaacagcggcccagaagatgccaagaggcaggccaagaagcagaagaccaggagaacatag

SEQ ID NO: 36074 - DNA, 3804 bp, Artificial Sequence
  Description of Artificial Sequence: Synthetic coding sequence
atgctggtgggccagggcgccggccccctgggccctgctgtggtgacagctgctgtggtgctgctgctgagcggcgtgggccctgcccacggctctgaagatattgtggtgggctgcggcggctttgtgaagagtgatgtggagatcaactacagcctcatcgagatcaagctgtacaccaagcacggcaccctgaagtaccagacagactgtgcccccaacaacggctacttcatgatccccctgtatgacaagggggacttcatcctgaagattgagccccccctgggctggagctttgagcccaccaccgtggagctgcacgtggatggagtgtctgacatctgcaccaagggcggggacatcaactttgtgttcaccggcttctctgtgaatggcaaggtgctgagcaagggccagcccctgggccctgctggggtgcaggtgtccctgaggaacacaggaacagaggccaagatccagagcacagtgacccagcccggcggcaagtttgccttcttcaaggtgctgcccggggactatgagatcctggccacccaccccacctgggccctgaaggaggccagcaccaccgtgcgggtgaccaacagcaatgccaatgctgccagccccctgattgtggccggctacaacgtgtctggctctgtgcggagtgatggagagcccatgaagggcgtgaagttcctgctcttcagcagcctggtgaccaaggaggatgtgctgggctgcaatgtgtcccctgtgcccggcttccagccccaggatgagagcctggtgtacctgtgctacacagtgtccagagaagatggcagcttctccttctacagcctgcccagcggcggctacaccgtcatccccttctacagaggagagcgcatcacctttgatgtggcccccagccggctggacttcaccgtggagcatgacagcctgaagattgagcccgtcttccacgtgatgggcttctctgtgacaggccgggtgctgaatggaccagaaggagatggagtgcctgaggccgtggtgaccctgaacaaccagatcaaggtgaagaccaaggcagatggcagcttccggctggagaacatcaccaccggcacctacaccatccacgcccagaaggagcacctgtactttgagaccgtgaccatcaagatcgcccccaacaccccccagctggccgacatcatcgccaccggcttctctgtgtgtggccagatcagcatcatccgcttcccagacacagtgaagcagatgaacaagtacaaggtggtgctgagcagccaggacaaggacaagagcctggtgacagtggagacagatgcccacggcagcttctgcttcaaggccaagccaggcacctacaaggtgcaggtgatggtgcctgaggccgagaccagggctggcctgaccctgaagccccagaccttccccctgactgtgaccaaccggcccatgatggatgtggcctttgtgcagttcctggcctctgtgtctgggaaggtgtcctgcctggacacctgtggggacctgctggtgaccctgcagagcctgagccggcagggcgagaagaggagcctgcagctgagcggcaaggtgaatgccatgaccttcacctttgacaacgtgctgcccgggaagtacaagatcagcatcatgcatgaggactggtgctggaagaacaagagcctggaggtggaggtgctggaggatgacatgtctgctgtggagttccggcagacaggctacatgctgcgctgcagcctgagccacgccatcaccctggagttctaccaggatggaaatggccgggagaatgtgggcatctacaacctgagcaaaggagtgaaccgcttctgcctgagcaagccaggagtgtacaaggtgacccccaggagctgccacagatttgagcaggccttctacacctatgacaccagcagccccagcatcctgaccctgacagccatccgccaccacgtgctgggcaccatcaccacagacaagatgatggatgtgacagtgaccatcaagagcagcattgacagcgagcccgccctggtgctgggccccctgaagtctgtgcaggagctgcggcgggagcagcagctggccgagattgaggcccggcggcaggagcgggagaagaatggaaatgaggagggggaggagaggatgaccaagccccctgtgcaggagatggtggatgagctgcagggccccttctcctatgacttctcctactgggcccggtctggagagaagatcaccgtgacccccagcagcaaggagctgctcttctacccacccagcatggaggccgtggtgtctggagagagctgccctgggaagctgattgagatccacggcaaggccggcctcttcctggagggccagatccaccctgagctggagggcgtggagatcgtcatcagcgagaagggggccagcagccccctcatcaccgtcttcacagatgacaagggggcctacagcgtgggccccctgcacagcgacctggagtacacagtgaccagccagaaggagggctacgtgctgacagctgtggagggcaccatcggggacttcaaggcctatgccctggccggcgtgtcctttgagatcaaggcagaagatgaccagcccctgcccggggtgctgctgagcctgagcggcggcctcttccgcagcaacctgctgacccaggacaatggcatcctgaccttcagcaacctgagccctggccagtactacttcaagcccatgatgaaggagttccgctttgagcccagcagccagatgattgaggtgcaggagggccagaacctgaagatcaccatcaccggctacagaacagcctacagctgctacggcaccgtgagcagcctgaatggagagcctgagcagggcgtggccatggaggccgtgggccagaatgactgcagcatctatggagaagatactgtgacagatgaggagggcaagttccggctgcggggcctgctgcccggctgtgtgtaccacgtgcagctgaaggccgagggcaatgaccacatcgagcgggccctgccccaccacagggtcatcgaggtgggcaacaatgacattgatgatgtgaacatcatcgtgttccggcagatcaaccagtttgacctgtctggaaatgtcatcaccagcagcgagtacctgcccaccctgtgggtgaagctgtacaagtctgagaacctggacaaccccatccagacagtgtccctgggccagagcctcttcttccacttcccccccctgctgagagatggagagaactacgtggtgctgctggacagcaccctgcccaggagccagtatgactacatcctgccccaggtgtccttcaccgctgtgggctaccacaagcacatcaccctcatcttcaaccccaccaggaagctgcctgagcaggacatcgcccagggcagctacatcgccctgcccctgaccctgctggtgctgctggccggctacaaccacgacaagctgatccccctgctgctgcagctgaccagccggctgcagggcgtgcgggccctgggccaggccgccagtgacaacagcggcccagaagatgccaagaggcaggccaagaagcagaagaccaggaggaccctgcggctgcagggcgagttccagctgacctggtgcctggtgccctggaggggcaccctgggcatccacctgttcagcagcctgccctttgccagcgagatcctgctggagaccacagccacctgcatccactactag

SEQ ID NO: 36075 - DNA, 3303 bp, Artificial Sequence
  Description of Artificial Sequence: Synthetic coding sequence
atggccaggtttgccttcttcaaggtgctgcccggggactatgagatcctggccacccaccccacctgggccctgaaggaggccagcaccaccgtgcgggtgaccaacagcaatgccaatgctgccagccccctcatcgtggccggctacaacgtgtctggctctgtgcggagtgatggagagcccatgaagggcgtgaagttcctgctcttcagcagcctggtgaccaaggaggatgtgctgggctgcaatgtgtcccctgtgcccggcttccagccccaggatgagagcctggtgtacctgtgctacacagtgtcccgggaggatggcagcttctccttctacagcctgcccagcggcggctacaccgtcatccccttctacagaggagagcgcatcacctttgatgtggcccccagccggctggacttcaccgtggagcatgacagcctgaagattgagcctgtgttccacgtgatgggcttctctgtgacaggccgggtgctgaatggaccagaaggagatggagtgcctgaggccgtggtgaccctgaacaaccagatcaaggtgaagaccaaggcagatggcagcttccggctggagaacatcaccaccggcacctacaccatccacgcccagaaggagcacctgtactttgaaacagtgaccatcaagatcgcccccaacaccccccagctggccgacatcatcgccaccggcttctctgtgtgtggccagatcagcatcatccgcttcccagacacagtgaagcagatgaacaagtacaaggtggtgctgagcagccaggacaaggacaagagcctggtgacagtggagacagatgcccacggcagcttctgcttcaaggccaagccaggcacctacaaggtgcaggtgatggtgcctgaggccgagacccgggccggcctgaccctgaagccccagaccttccccctgactgtgaccaaccggcccatgatggatgtggcctttgtgcagttcctggcctctgtgtctgggaaggtgtcctgcctggacacctgtggggacctgctggtgaccctgcagagcctgagccggcagggcgagaagaggagcctgcagctgagcggcaaggtgaatgccatgaccttcacctttgacaacgtgctgcccgggaagtacaagatcagcatcatgcatgaggactggtgctggaagaacaagagcctggaggtggaggtgctggaggatgacatgtctgctgtggagttccggcagacaggctacatgctgcgctgcagcctgagccacgccatcaccctggagttctaccaggatggaaatggaagagaaaatgtgggcatctacaacctgagcaagggcgtgaaccgcttctgcctgagcaagccaggagtgtacaaggtgacccccaggagctgccacagatttgagcaggccttctacacctatgacaccagcagccccagcatcctgaccctgacagccatccgccaccacgtgctgggcaccatcaccacagacaagatgatggatgtgacagtgaccatcaagagcagcattgattctgagcccgccctggtgctgggccccctgaagtctgtgcaggagctgcggcgggagcagcagctggccgagattgaggcccggcggcaggagcgggagaagaatggaaatgaggagggggaggagaggatgaccaagccccctgtgcaggagatggtggatgagctgcagggccccttctcctatgacttctcctactgggcccggagcggggagaagatcaccgtgacccccagcagcaaggagctgctcttctacccacccagcatggaggccgtggtgtctggagagagctgccctgggaagctgattgagatccacggcaaggccggcctcttcctggagggccagatccaccctgagctggagggcgtggagatcgtcatcagcgagaagggggccagcagccccctcatcaccgtcttcacagatgacaagggggcctacagcgtgggccccctgcacagcgacctggagtacacagtgaccagccagaaggagggctacgtgctgacagctgtggagggcaccatcggggacttcaaggcctatgccctggccggcgtgtcctttgagatcaaggccgaggatgaccagcccctgcccggggtgctgctgagcctgagcggcggcctcttccgcagcaacctgctgacccaggacaatggcatcctgaccttcagcaacctgagccctggccagtactacttcaagcccatgatgaaggagttccgctttgagcccagcagccagatgattgaggtgcaggagggccagaacctgaagatcaccatcaccggctacagaacagcctacagctgctatggaacagtgagcagcctgaatggagagcctgagcagggcgtggccatggaggccgtgggccagaatgactgcagcatctacggggaggacacagtgacagatgaggagggcaagttccggctgcggggcctgctgcccggctgtgtgtaccacgtgcagctgaaggccgagggcaatgaccacatcgagcgggccctgccccaccaccgggtgattgaggtgggcaacaatgacattgatgatgtgaacatcatcgtgttccggcagatcaaccagtttgacctgtctggaaatgtcatcaccagcagcgagtacctgcccaccctgtgggtgaagctgtacaagtctgagaacctggacaaccccatccagacagtgtccctgggccagagcctcttcttccacttcccccccctgctgagagatggagaaaattatgtggtgctgctggacagcaccctgcccaggagccagtatgactacatcctgccccaggtgtccttcaccgctgtgggctaccacaagcacatcaccctcatcttcaaccccaccaggaagctgcctgagcaggacatcgcccagggcagctacatcgccctgcccctgaccctgctggtgctgctggccggctacaaccacgacaagctgatccccctgctgctgcagctgaccagccggctgcagggcgtgcgggccctgggccaggccgccagtgacaacagcggcccagaagatgccaagaggcaggccaagaagcagaagaccaggaggaccctgcggctgcagggcgagttccagctgacctggtgcctggtgccctggaggggcaccctgggcatccacctgttcagcagcctgccctttgccagcgagatcctgctggagaccacagccacctgcatccactactag

SEQ ID NO: 36076 - DNA, 3669 bp, Artificial Sequence
  Description of Artificial Sequence: Synthetic coding sequence
atgctggtgggccagggcgccggcctgctgggccctgctgtggtgacagctgctgtggtgctgctgctgagcggcgtgggccctgcccacggctctgaagatattgtggtgggctgcggcggctttgtgaagagtgatgtggagatcaactacagcctcatcgagatcaagctgtacaccaagcacggcaccctgaagtaccagacagactgtgcccccaacaacggctacttcatgatccccctgtatgacaagggggacttcatcctgaagattgagccccccctgggctggagctttgagcccaccaccgtggagctgcacgtggatggagtgtctgacatctgcaccaagggcggggacatcaactttgtgttcaccggcttctctgtgaatggcaaggtgctgagcaagggccagcccctgggccctgctggggtgcaggtgtccctgaggaacacaggaacagaggccaagatccagagcacagtgacccagcccggcggcaagtttgccttcttcaaggtgctgcccggggactatgagatcctggccacccaccccacctgggccctgaaggaggccagcaccaccgtgcgggtgaccaacagcaatgccaatgctgccagccccctgattgtggccggctacaacgtgtctggctctgtgcggagtgatggagagcccatgaagggcgtgaagttcctgctcttcagcagcctggtgaccaaggaggatgtgctgggctgcaatgtgtcccctgtgcccggcttccagccccaggatgagagcctggtgtacctgtgctacacagtgtccagagaagatggcagcttctccttctacagcctgcccagcggcggctacaccgtcatccccttctacagaggagagcgcatcacctttgatgtggcccccagccggctggacttcaccgtggagcatgacagcctgaagattgagcccgtcttccacgtgatgggcttctctgtgacaggccgggtgctgaatggaccagaaggagatggagtgcctgaggccgtggtgaccctgaacaaccagatcaaggtgaagaccaaggcagatggcagcttccggctggagaacatcaccaccggcacctacaccatccacgcccagaaggagcacctgtactttgagaccgtgaccatcaagatcgcccccaacaccccccagctggccgacatcgtggccaccggcttctctgtgtgtggccgcatcagcatcatccgcttcccagacacagtgaagcagatgaacaagtacaaggtggtgctgagcagccaggacaaggacaagagcctggtgacagtggagacagatgcccacggcagcttctgcttcaaggccaagccaggcacctacaaggtgcaggtgatggtgcctgaggccgagaccagggctggcctgaccctgaagccccagaccttccccctgactgtgacagacaggcctgtgatggatgtggcctttgtgcagttcctggcctctgtgtctgggaaggtgtcctgcctggacacctgtggggacctgctggtgaccctgcagagcctgagccggcagggcgagaagaggagcctgcagctgagcggcaaggtgaatgccatgaccttcacctttgacaacgtgctgcccgggaagtacaagatcagcatcatgcatgaggactggtgctggaagaacaagagcctggaggtggaggtgctggaggatgatgtgtctgctgtggagttccggcagacaggctacatgctgcgctgcagcctgagccacgccatcaccctggagttctaccaggatggaaatggccgggagaatgtgggcatctacaacctgagcaaaggagtgaaccgcttctgcctgagcaagccaggagtgtacaaggtgacccccaggagctgccacagatttgagcaggccttctacacctatgacaccagcagccccagcatcctgaccctgacagccatccgccaccacgtgctgggcaccatcaccacagacaagatgatggatgtgacagtgaccatcaagagcagcattgacagcgagcccgccctggtgctgggccccctgaagtctgtgcaggagctgcggcgggagcagcagctggccgagattgaggcccggcggcaggagcgggagaagaatggaaatgaggagggggaggagaggatgaccaagccccctgtgcaggagatggtggatgagctgcagggccccttctcctatgacttctcctactgggcccggtctggagagaagatcaccgtgacccccagcagcaaggagctgctcttctacccacccagcatggaggccgtggtgtctggagagagctgccctgggaagctgattgagatccacggcaaggccggcctcttcctggagggccagatccaccctgagctggagggcgtggagatcgtcatcagcgagaagggggccagcagccccctcatcaccgtcttcacagatgacaagggggcctacagcgtgggccccctgcacagcgacctggagtacacagtgaccagccagaaggagggctacgtgctgacagctgtggagggcaccatcggggacttcaaggcctatgccctggccggcgtgtcctttgagatcaaggcagaagatgaccagcccctgcccggggtgctgctgagcctgagcggcggcctcttccgcagcaacctgctgacccaggacaatggcatcctgaccttcagcaacctgagccctggccagtactacttcaagcccatgatgaaggagttccgctttgagcccagcagccagatgattgaggtgcaggagggccagaacctgaagatcaccatcaccggctacagaacagcctacagctgctacggcaccgtgagcagcctgaatggagagcctgagcagggcgtggccatggaggccgtgggccagaatgactgcagcatctatggagaagatactgtgacagatgaggagggcaagttccggctgcggggcctgctgcccggctgtgtgtaccacgtgcagctgaaggccgagggcaatgaccacatcgagcgggccctgccccaccacagggtcatcgaggtgggcaacaatgacattgatgatgtgaacatcatcgtgttccggcagatcaaccagtttgacctgtctggaaatgtcatcaccagcagcgagtacctgcccaccctgtgggtgaagctgtacaagtctgagaacctggacaaccccatccagacagtgtccctgggccagagcctcttcttccacttcccccccctgctgagagatggagagaactacgtggtgctgctggacagcaccctgcccaggagccagtatgactacatcctgccccaggtgtccttcaccgctgtgggctaccacaagcacatcaccctcatcttcaaccccaccaggaagctgcctgagcaggacatcgcccagggcagctacatcgccctgcccctgaccctgctggtgctgctggccggctacaaccacgacaagctgatccccctgctgctgcagctgaccagccggctgcagggcgtgggcgccctgggccaggccgccagtgacaacagcggcccagaagatgccaagaggcaggccaagaagcagaagaccaggagaacatag

SEQ ID NO: 36077 - DNA, 3804 bp, Artificial Sequence
  Description of Artificial Sequence: Synthetic coding sequence
atgctggtgggccagggcgccggcctgctgggccctgctgtggtgacagctgctgtggtgctgctgctgagcggcgtgggccctgcccacggctctgaagatattgtggtgggctgcggcggctttgtgaagagtgatgtggagatcaactacagcctcatcgagatcaagctgtacaccaagcacggcaccctgaagtaccagacagactgtgcccccaacaacggctacttcatgatccccctgtatgacaagggggacttcatcctgaagattgagccccccctgggctggagctttgagcccaccaccgtggagctgcacgtggatggagtgtctgacatctgcaccaagggcggggacatcaactttgtgttcaccggcttctctgtgaatggcaaggtgctgagcaagggccagcccctgggccctgctggggtgcaggtgtccctgaggaacacaggaacagaggccaagatccagagcacagtgacccagcccggcggcaagtttgccttcttcaaggtgctgcccggggactatgagatcctggccacccaccccacctgggccctgaaggaggccagcaccaccgtgcgggtgaccaacagcaatgccaatgctgccagccccctgattgtggccggctacaacgtgtctggctctgtgcggagtgatggagagcccatgaagggcgtgaagttcctgctcttcagcagcctggtgaccaaggaggatgtgctgggctgcaatgtgtcccctgtgcccggcttccagccccaggatgagagcctggtgtacctgtgctacacagtgtccagagaagatggcagcttctccttctacagcctgcccagcggcggctacaccgtcatccccttctacagaggagagcgcatcacctttgatgtggcccccagccggctggacttcaccgtggagcatgacagcctgaagattgagcccgtcttccacgtgatgggcttctctgtgacaggccgggtgctgaatggaccagaaggagatggagtgcctgaggccgtggtgaccctgaacaaccagatcaaggtgaagaccaaggcagatggcagcttccggctggagaacatcaccaccggcacctacaccatccacgcccagaaggagcacctgtactttgagaccgtgaccatcaagatcgcccccaacaccccccagctggccgacatcgtggccaccggcttctctgtgtgtggccgcatcagcatcatccgcttcccagacacagtgaagcagatgaacaagtacaaggtggtgctgagcagccaggacaaggacaagagcctggtgacagtggagacagatgcccacggcagcttctgcttcaaggccaagccaggcacctacaaggtgcaggtgatggtgcctgaggccgagaccagggctggcctgaccctgaagccccagaccttccccctgactgtgacagacaggcctgtgatggatgtggcctttgtgcagttcctggcctctgtgtctgggaaggtgtcctgcctggacacctgtggggacctgctggtgaccctgcagagcctgagccggcagggcgagaagaggagcctgcagctgagcggcaaggtgaatgccatgaccttcacctttgacaacgtgctgcccgggaagtacaagatcagcatcatgcatgaggactggtgctggaagaacaagagcctggaggtggaggtgctggaggatgatgtgtctgctgtggagttccggcagacaggctacatgctgcgctgcagcctgagccacgccatcaccctggagttctaccaggatggaaatggccgggagaatgtgggcatctacaacctgagcaaaggagtgaaccgcttctgcctgagcaagccaggagtgtacaaggtgacccccaggagctgccacagatttgagcaggccttctacacctatgacaccagcagccccagcatcctgaccctgacagccatccgccaccacgtgctgggcaccatcaccacagacaagatgatggatgtgacagtgaccatcaagagcagcattgacagcgagcccgccctggtgctgggccccctgaagtctgtgcaggagctgcggcgggagcagcagctggccgagattgaggcccggcggcaggagcgggagaagaatggaaatgaggagggggaggagaggatgaccaagccccctgtgcaggagatggtggatgagctgcagggccccttctcctatgacttctcctactgggcccggtctggagagaagatcaccgtgacccccagcagcaaggagctgctcttctacccacccagcatggaggccgtggtgtctggagagagctgccctgggaagctgattgagatccacggcaaggccggcctcttcctggagggccagatccaccctgagctggagggcgtggagatcgtcatcagcgagaagggggccagcagccccctcatcaccgtcttcacagatgacaagggggcctacagcgtgggccccctgcacagcgacctggagtacacagtgaccagccagaaggagggctacgtgctgacagctgtggagggcaccatcggggacttcaaggcctatgccctggccggcgtgtcctttgagatcaaggcagaagatgaccagcccctgcccggggtgctgctgagcctgagcggcggcctcttccgcagcaacctgctgacccaggacaatggcatcctgaccttcagcaacctgagccctggccagtactacttcaagcccatgatgaaggagttccgctttgagcccagcagccagatgattgaggtgcaggagggccagaacctgaagatcaccatcaccggctacagaacagcctacagctgctacggcaccgtgagcagcctgaatggagagcctgagcagggcgtggccatggaggccgtgggccagaatgactgcagcatctatggagaagatactgtgacagatgaggagggcaagttccggctgcggggcctgctgcccggctgtgtgtaccacgtgcagctgaaggccgagggcaatgaccacatcgagcgggccctgccccaccacagggtcatcgaggtgggcaacaatgacattgatgatgtgaacatcatcgtgttccggcagatcaaccagtttgacctgtctggaaatgtcatcaccagcagcgagtacctgcccaccctgtgggtgaagctgtacaagtctgagaacctggacaaccccatccagacagtgtccctgggccagagcctcttcttccacttcccccccctgctgagagatggagagaactacgtggtgctgctggacagcaccctgcccaggagccagtatgactacatcctgccccaggtgtccttcaccgctgtgggctaccacaagcacatcaccctcatcttcaaccccaccaggaagctgcctgagcaggacatcgcccagggcagctacatcgccctgcccctgaccctgctggtgctgctggccggctacaaccacgacaagctgatccccctgctgctgcagctgaccagccggctgcagggcgtgggcgccctgggccaggccgccagtgacaacagcggcccagaagatgccaagaggcaggccaagaagcagaagaccaggaggaccctgcggctgcaggaggagttccagctgatgtggtgcctggtgccctggaggggcaccctgggcatccacctgttcagcagcctgccctttgccagcgagatcctgctggagaccacagccacctgcatccactactag

SEQ ID NO: 36078 - DNA, 3303 bp, Artificial Sequence
  Description of Artificial Sequence: Synthetic coding sequence
atggccaggtttgccttcttcaaggtgctgcccggggactatgagatcctggccacccaccccacctgggccctgaaggaggccagcaccaccgtgcgggtgaccaacagcaatgccaatgctgccagccccctcatcgtggccggctacaacgtgtctggctctgtgcggagtgatggagagcccatgaagggcgtgaagttcctgctcttcagcagcctggtgaccaaggaggatgtgctgggctgcaatgtgtcccctgtgcccggcttccagccccaggatgagagcctggtgtacctgtgctacacagtgtcccgggaggatggcagcttctccttctacagcctgcccagcggcggctacaccgtcatccccttctacagaggagagcgcatcacctttgatgtggcccccagccggctggacttcaccgtggagcatgacagcctgaagattgagcctgtgttccacgtgatgggcttctctgtgacaggccgggtgctgaatggaccagaaggagatggagtgcctgaggccgtggtgaccctgaacaaccagatcaaggtgaagaccaaggcagatggcagcttccggctggagaacatcaccaccggcacctacaccatccacgcccagaaggagcacctgtactttgaaacagtgaccatcaagatcgcccccaacaccccccagctggccgacatcgtggccaccggcttctctgtgtgtggccgcatcagcatcatccgcttcccagacacagtgaagcagatgaacaagtacaaggtggtgctgagcagccaggacaaggacaagagcctggtgacagtggagacagatgcccacggcagcttctgcttcaaggccaagccaggcacctacaaggtgcaggtgatggtgcctgaggccgagacccgggccggcctgaccctgaagccccagaccttccccctgactgtgacagacaggcctgtgatggatgtggcctttgtgcagttcctggcctctgtgtctgggaaggtgtcctgcctggacacctgtggggacctgctggtgaccctgcagagcctgagccggcagggcgagaagaggagcctgcagctgagcggcaaggtgaatgccatgaccttcacctttgacaacgtgctgcccgggaagtacaagatcagcatcatgcatgaggactggtgctggaagaacaagagcctggaggtggaggtgctggaggatgatgtgtctgctgtggagttccggcagacaggctacatgctgcgctgcagcctgagccacgccatcaccctggagttctaccaggatggaaatggaagagaaaatgtgggcatctacaacctgagcaagggcgtgaaccgcttctgcctgagcaagccaggagtgtacaaggtgacccccaggagctgccacagatttgagcaggccttctacacctatgacaccagcagccccagcatcctgaccctgacagccatccgccaccacgtgctgggcaccatcaccacagacaagatgatggatgtgacagtgaccatcaagagcagcattgattctgagcccgccctggtgctgggccccctgaagtctgtgcaggagctgcggcgggagcagcagctggccgagattgaggcccggcggcaggagcgggagaagaatggaaatgaggagggggaggagaggatgaccaagccccctgtgcaggagatggtggatgagctgcagggccccttctcctatgacttctcctactgggcccggagcggggagaagatcaccgtgacccccagcagcaaggagctgctcttctacccacccagcatggaggccgtggtgtctggagagagctgccctgggaagctgattgagatccacggcaaggccggcctcttcctggagggccagatccaccctgagctggagggcgtggagatcgtcatcagcgagaagggggccagcagccccctcatcaccgtcttcacagatgacaagggggcctacagcgtgggccccctgcacagcgacctggagtacacagtgaccagccagaaggagggctacgtgctgacagctgtggagggcaccatcggggacttcaaggcctatgccctggccggcgtgtcctttgagatcaaggccgaggatgaccagcccctgcccggggtgctgctgagcctgagcggcggcctcttccgcagcaacctgctgacccaggacaatggcatcctgaccttcagcaacctgagccctggccagtactacttcaagcccatgatgaaggagttccgctttgagcccagcagccagatgattgaggtgcaggagggccagaacctgaagatcaccatcaccggctacagaacagcctacagctgctatggaacagtgagcagcctgaatggagagcctgagcagggcgtggccatggaggccgtgggccagaatgactgcagcatctacggggaggacacagtgacagatgaggagggcaagttccggctgcggggcctgctgcccggctgtgtgtaccacgtgcagctgaaggccgagggcaatgaccacatcgagcgggccctgccccaccaccgggtgattgaggtgggcaacaatgacattgatgatgtgaacatcatcgtgttccggcagatcaaccagtttgacctgtctggaaatgtcatcaccagcagcgagtacctgcccaccctgtgggtgaagctgtacaagtctgagaacctggacaaccccatccagacagtgtccctgggccagagcctcttcttccacttcccccccctgctgagagatggagaaaattatgtggtgctgctggacagcaccctgcccaggagccagtatgactacatcctgccccaggtgtccttcaccgctgtgggctaccacaagcacatcaccctcatcttcaaccccaccaggaagctgcctgagcaggacatcgcccagggcagctacatcgccctgcccctgaccctgctggtgctgctggccggctacaaccacgacaagctgatccccctgctgctgcagctgaccagccggctgcagggcgtgggcgccctgggccaggccgccagtgacaacagcggcccagaagatgccaagaggcaggccaagaagcagaagaccaggaggaccctgcggctgcaggaggagttccagctgatgtggtgcctggtgccctggaggggcaccctgggcatccacctgttcagcagcctgccctttgccagcgagatcctgctggagaccacagccacctgcatccactactag

SEQ ID NO: 36079 - DNA, 3804 bp, Artificial Sequence
  Description of Artificial Sequence: Synthetic coding sequence
atgctggtgggccagggcgccggccccctgggccctgctgtggtgacagctgctgtggtgctgctgctgagcggcgtgggccctgcccacggctctgaagatattgtggtgggctgcggcggctttgtgaagagtgatgtggagatcaactacagcctcatcgagatcaagctgtacaccaagcacggcaccctgaagtaccagacagactgtgcccccaacaacggctacttcatgatccccctgtatgacaagggggacttcatcctgaagattgagccccccctgggctggagctttgagcccaccaccgtggagctgcacgtggatggagtgtctgacatctgcaccaagggcggggacatcaactttgtgttcaccggcttctctgtgaatggcaaggtgctgagcaagggccagcccctgggccctgctggggtgcaggtgtccctgaggaacacaggaacagaggccaagatccagagcacagtgacccagcccggcggcaagtttgccttcttcaaggtgctgcccggggactatgagatcctggccacccaccccacctgggccctgaaggaggccagcaccaccgtgcgggtgaccaacagcaatgccaatgctgccagccccctgattgtggccggctacaacgtgtctggctctgtgcggagtgatggagagcccatgaagggcgtgaagttcctgctcttcagcagcctggtgaccaaggaggatgtgctgggctgcaatgtgtcccctgtgcccggcttccagccccaggatgagagcctggtgtacctgtgctacacagtgtccagagaagatggcagcttctccttctacagcctgcccagcggcggctacaccgtcatccccttctacagaggagagcgcatcacctttgatgtggcccccagccggctggacttcaccgtggagcatgacagcctgaagattgagcccgtcttccacgtgatgggcttctctgtgacaggccgggtgctgaatggaccagaaggagatggagtgcctgaggccgtggtgaccctgaacaaccagatcaaggtgaagaccaaggcagatggcagcttccggctggagaacatcaccaccggcacctacaccatccacgcccagaaggagcacctgtactttgagaccgtgaccatcaagatcgcccccaacaccccccagctggccgacatcgtggccaccggcttctctgtgtgtggccagatcagcatcatccgcttcccagacacagtgaagcagatgaacaagtacaaggtggtgctgagcagccaggacaaggacaagagcctggtgacagtggagacagatgcccacggcagcttctgcttcaaggccaaccctggcacctacaaggtgcaggtgatggtgcctgaggccgagaccagggctggcctgaccctgaagccccagaccttccccctgactgtgacagacaggcctgtgatggatgtggcctttgtgcagttcctggcctctgtgtctgggaaggtgtcctgcctggacacctgtggggacctgctggtgaccctgcagagcctgagccggcagggcgagaagaggagcctgcagctgagcggcaaggtgaatgccatgaccttcacctttgacaacgtgctgcccgggaagtacaagatcagcatcatgcatgaggactggtgctggaagaacaagagcctggaggtggaggtgctggaggatgatgtgtctgctgtggagttccggcagacaggctacatgctgcgctgcagcctgagccacgccatcaccctggagttctaccaggatggaaatggccgggagaatgtgggcatctacaacctgagcaaaggagtgaaccgcttctgcctgagcaagccaggagtgtacaaggtgacccccaggagctgccacagatttgagcaggccttctacacctatgacaccagcagccccagcatcctgaccctgacagccatccgccaccacgtgctgggcaccatcaccacagacaagatgatggatgtgacagtgaccatcaagagcagcattgacagcgagcccgccctggtgctgggccccctgaagtctgtgcaggagctgcggcgggagcagcagctggccgagattgaggcccggcggcaggagcgggagaagaatggaaatgaggagggggaggagaggatgaccaagccccctgtgcaggagatggtggatgagctgcagggccccttctcctatgacttctcctactgggcccggtctggagagaagatcaccgtgacccccagcagcaaggagctgctcttctacccacccagcatggaggccgtggtgtctggagagagctgccctgggaagctgattgagatccacggcaaggccggcctcttcctggagggccagatccaccctgagctggagggcgtggagatcgtcatcagcgagaagggggccagcagccccctcatcaccgtcttcacagatgacaagggggcctacagcgtgggccccctgcacagcgacctggagtacacagtgaccagccagaaggagggctacgtgctgacagctgtggagggcaccatcggggacttcaaggcctatgccctggccggcgtgtcctttgagatcaaggcagaagatgaccagcccctgcccggggtgctgctgagcctgagcggcggcctcttccgcagcaacctgctgacccaggacaatggcatcctgaccttcagcaacctgagccctggccagtactacttcaagcccatgatgaaggagttccgctttgagcccagcagccagatgattgaggtgcaggagggccagaacctgaagatcaccatcaccggctacagaacagcctacagctgctacggcaccgtgagcagcctgaatggagagcctgagcagggcgtggccatggaggccgtgggccagaatgactgcagcatctatggagaagatactgtgacagatgaggagggcaagttccggctgcggggcctgctgcccggctgtgtgtaccacgtgcagctgaaggccgagggcaatgaccacatcgagcgggccctgccccaccacagggtcatcgaggtgggcaacaatgacattgatgatgtgaacatcatcgtgttccggcagatcaaccagtttgacctgtctggaaatgtcatcaccagcagcgagtacctgcccaccctgtgggtgaagctgtacaagtctgagaacctggacaaccccatccagacagtgtccctgggccagagcctcttcttccacttcccccccctgctgagagatggagagaactacgtggtgctgctggacagcaccctgcccaggagccagtatgactacatcctgccccaggtgtccttcaccgctgtgggctaccacaagcacatcaccctcatcttcaaccccaccaggaagctgcctgagcaggacatcgcccagggcagctacatcgccctgcccctgaccctgctggtgctgctggccggctacaaccacgacaagctgatccccctgctgctgcagctgaccagccggctgcagggcgtgggcgccctgggccaggccgccagtgacaacagcggcccagaagatgccaagaggcaggccaagaagcagaagaccaggaggaccctgcggctgcaggaggagttccagctgatgtggtgcctggtgccctggaggggcaccctgggcatccacctgttcagcagcctgccctttgccagcgagatcctgctggagaccacagccacctgcatccactactag

SEQ ID NO: 36080 - DNA, 3669 bp, Artificial Sequence
  Description of Artificial Sequence: Synthetic coding sequence
atgctggtgggccagggcgccggccccctgggccctgctgtggtgacagctgctgtggtgctgctgctgagcggcgtgggccctgcccacggctctgaagatattgtggtgggctgcggcggctttgtgaagagtgatgtggagatcaactacagcctcatcgagatcaagctgtacaccaagcacggcaccctgaagtaccagacagactgtgcccccaacaacggctacttcatgatccccctgtatgacaagggggacttcatcctgaagattgagccccccctgggctggagctttgagcccaccaccgtggagctgcacgtggatggagtgtctgacatctgcaccaagggcggggacatcaactttgtgttcaccggcttctctgtgaatggcaaggtgctgagcaagggccagcccctgggccctgctggggtgcaggtgtccctgaggaacacaggaacagaggccaagatccagagcacagtgacccagcccggcggcaagtttgccttcttcaaggtgctgcccggggactatgagatcctggccacccaccccacctgggccctgaaggaggccagcaccaccgtgcgggtgaccaacagcaatgccaatgctgccagccccctgattgtggccggctacaacgtgtctggctctgtgcggagtgatggagagcccatgaagggcgtgaagttcctgctcttcagcagcctggtgaccaaggaggatgtgctgggctgcaatgtgtcccctgtgcccggcttccagccccaggatgagagcctggtgtacctgtgctacacagtgtccagagaagatggcagcttctccttctacagcctgcccagcggcggctacaccgtcatccccttctacagaggagagcgcatcacctttgatgtggcccccagccggctggacttcaccgtggagcatgacagcctgaagattgagcccgtcttccacgtgatgggcttctctgtgacaggccgggtgctgaatggaccagaaggagatggagtgcctgaggccgtggtgaccctgaacaaccagatcaaggtgaagaccaaggcagatggcagcttccggctggagaacatcaccaccggcacctacaccatccacgcccagaaggagcacctgtactttgagaccgtgaccatcaagatcgcccccaacaccccccagctggccgacatcgtggccaccggcttctctgtgtgtggccagatcagcatcatccgcttcccagacacagtgaagcagatgaacaagtacaaggtggtgctgagcagccaggacaaggacaagagcctggtgacagtggagacagatgcccacggcagcttctgcttcaaggccaaccctggcacctacaaggtgcaggtgatggtgcctgaggccgagaccagggctggcctgaccctgaagccccagaccttccccctgactgtgacagacaggcctgtgatggatgtggcctttgtgcagttcctggcctctgtgtctgggaaggtgtcctgcctggacacctgtggggacctgctggtgaccctgcagagcctgagccggcagggcgagaagaggagcctgcagctgagcggcaaggtgaatgccatgaccttcacctttgacaacgtgctgcccgggaagtacaagatcagcatcatgcatgaggactggtgctggaagaacaagagcctggaggtggaggtgctggaggatgatgtgtctgctgtggagttccggcagacaggctacatgctgcgctgcagcctgagccacgccatcaccctggagttctaccaggatggaaatggccgggagaatgtgggcatctacaacctgagcaaaggagtgaaccgcttctgcctgagcaagccaggagtgtacaaggtgacccccaggagctgccacagatttgagcaggccttctacacctatgacaccagcagccccagcatcctgaccctgacagccatccgccaccacgtgctgggcaccatcaccacagacaagatgatggatgtgacagtgaccatcaagagcagcattgacagcgagcccgccctggtgctgggccccctgaagtctgtgcaggagctgcggcgggagcagcagctggccgagattgaggcccggcggcaggagcgggagaagaatggaaatgaggagggggaggagaggatgaccaagccccctgtgcaggagatggtggatgagctgcagggccccttctcctatgacttctcctactgggcccggtctggagagaagatcaccgtgacccccagcagcaaggagctgctcttctacccacccagcatggaggccgtggtgtctggagagagctgccctgggaagctgattgagatccacggcaaggccggcctcttcctggagggccagatccaccctgagctggagggcgtggagatcgtcatcagcgagaagggggccagcagccccctcatcaccgtcttcacagatgacaagggggcctacagcgtgggccccctgcacagcgacctggagtacacagtgaccagccagaaggagggctacgtgctgacagctgtggagggcaccatcggggacttcaaggcctatgccctggccggcgtgtcctttgagatcaaggcagaagatgaccagcccctgcccggggtgctgctgagcctgagcggcggcctcttccgcagcaacctgctgacccaggacaatggcatcctgaccttcagcaacctgagccctggccagtactacttcaagcccatgatgaaggagttccgctttgagcccagcagccagatgattgaggtgcaggagggccagaacctgaagatcaccatcaccggctacagaacagcctacagctgctacggcaccgtgagcagcctgaatggagagcctgagcagggcgtggccatggaggccgtgggccagaatgactgcagcatctatggagaagatactgtgacagatgaggagggcaagttccggctgcggggcctgctgcccggctgtgtgtaccacgtgcagctgaaggccgagggcaatgaccacatcgagcgggccctgccccaccacagggtcatcgaggtgggcaacaatgacattgatgatgtgaacatcatcgtgttccggcagatcaaccagtttgacctgtctggaaatgtcatcaccagcagcgagtacctgcccaccctgtgggtgaagctgtacaagtctgagaacctggacaaccccatccagacagtgtccctgggccagagcctcttcttccacttcccccccctgctgagagatggagagaactacgtggtgctgctggacagcaccctgcccaggagccagtatgactacatcctgccccaggtgtccttcaccgctgtgggctaccacaagcacatcaccctcatcttcaaccccaccaggaagctgcctgagcaggacatcgcccagggcagctacatcgccctgcccctgaccctgctggtgctgctggccggctacaaccacgacaagctgatccccctgctgctgcagctgaccagccggctgcagggcgtgggcgccctgggccaggccgccagtgacaacagcggcccagaagatgccaagaggcaggccaagaagcagaagaccaggagaacatag

SEQ ID NO: 36081 - DNA, 3303 bp, Artificial Sequence
  Description of Artificial Sequence: Synthetic coding sequence
atggccaggtttgccttcttcaaggtgctgcccggggactatgagatcctggccacccaccccacctgggccctgaaggaggccagcaccaccgtgcgggtgaccaacagcaatgccaatgctgccagccccctcatcgtggccggctacaacgtgtctggctctgtgcggagtgatggagagcccatgaagggcgtgaagttcctgctcttcagcagcctggtgaccaaggaggatgtgctgggctgcaatgtgtcccctgtgcccggcttccagccccaggatgagagcctggtgtacctgtgctacacagtgtcccgggaggatggcagcttctccttctacagcctgcccagcggcggctacaccgtcatccccttctacagaggagagcgcatcacctttgatgtggcccccagccggctggacttcaccgtggagcatgacagcctgaagattgagcctgtgttccacgtgatgggcttctctgtgacaggccgggtgctgaatggaccagaaggagatggagtgcctgaggccgtggtgaccctgaacaaccagatcaaggtgaagaccaaggcagatggcagcttccggctggagaacatcaccaccggcacctacaccatccacgcccagaaggagcacctgtactttgaaacagtgaccatcaagatcgcccccaacaccccccagctggccgacatcgtggccaccggcttctctgtgtgtggccagatcagcatcatccgcttcccagacacagtgaagcagatgaacaagtacaaggtggtgctgagcagccaggacaaggacaagagcctggtgacagtggagacagatgcccacggcagcttctgcttcaaggccaaccctggcacctacaaggtgcaggtgatggtgcctgaggccgagacccgggccggcctgaccctgaagccccagaccttccccctgactgtgacagacaggcctgtgatggatgtggcctttgtgcagttcctggcctctgtgtctgggaaggtgtcctgcctggacacctgtggggacctgctggtgaccctgcagagcctgagccggcagggcgagaagaggagcctgcagctgagcggcaaggtgaatgccatgaccttcacctttgacaacgtgctgcccgggaagtacaagatcagcatcatgcatgaggactggtgctggaagaacaagagcctggaggtggaggtgctggaggatgatgtgtctgctgtggagttccggcagacaggctacatgctgcgctgcagcctgagccacgccatcaccctggagttctaccaggatggaaatggaagagaaaatgtgggcatctacaacctgagcaagggcgtgaaccgcttctgcctgagcaagccaggagtgtacaaggtgacccccaggagctgccacagatttgagcaggccttctacacctatgacaccagcagccccagcatcctgaccctgacagccatccgccaccacgtgctgggcaccatcaccacagacaagatgatggatgtgacagtgaccatcaagagcagcattgattctgagcccgccctggtgctgggccccctgaagtctgtgcaggagctgcggcgggagcagcagctggccgagattgaggcccggcggcaggagcgggagaagaatggaaatgaggagggggaggagaggatgaccaagccccctgtgcaggagatggtggatgagctgcagggccccttctcctatgacttctcctactgggcccggagcggggagaagatcaccgtgacccccagcagcaaggagctgctcttctacccacccagcatggaggccgtggtgtctggagagagctgccctgggaagctgattgagatccacggcaaggccggcctcttcctggagggccagatccaccctgagctggagggcgtggagatcgtcatcagcgagaagggggccagcagccccctcatcaccgtcttcacagatgacaagggggcctacagcgtgggccccctgcacagcgacctggagtacacagtgaccagccagaaggagggctacgtgctgacagctgtggagggcaccatcggggacttcaaggcctatgccctggccggcgtgtcctttgagatcaaggccgaggatgaccagcccctgcccggggtgctgctgagcctgagcggcggcctcttccgcagcaacctgctgacccaggacaatggcatcctgaccttcagcaacctgagccctggccagtactacttcaagcccatgatgaaggagttccgctttgagcccagcagccagatgattgaggtgcaggagggccagaacctgaagatcaccatcaccggctacagaacagcctacagctgctatggaacagtgagcagcctgaatggagagcctgagcagggcgtggccatggaggccgtgggccagaatgactgcagcatctacggggaggacacagtgacagatgaggagggcaagttccggctgcggggcctgctgcccggctgtgtgtaccacgtgcagctgaaggccgagggcaatgaccacatcgagcgggccctgccccaccaccgggtgattgaggtgggcaacaatgacattgatgatgtgaacatcatcgtgttccggcagatcaaccagtttgacctgtctggaaatgtcatcaccagcagcgagtacctgcccaccctgtgggtgaagctgtacaagtctgagaacctggacaaccccatccagacagtgtccctgggccagagcctcttcttccacttcccccccctgctgagagatggagaaaattatgtggtgctgctggacagcaccctgcccaggagccagtatgactacatcctgccccaggtgtccttcaccgctgtgggctaccacaagcacatcaccctcatcttcaaccccaccaggaagctgcctgagcaggacatcgcccagggcagctacatcgccctgcccctgaccctgctggtgctgctggccggctacaaccacgacaagctgatccccctgctgctgcagctgaccagccggctgcagggcgtgggcgccctgggccaggccgccagtgacaacagcggcccagaagatgccaagaggcaggccaagaagcagaagaccaggaggaccctgcggctgcaggaggagttccagctgatgtggtgcctggtgccctggaggggcaccctgggcatccacctgttcagcagcctgccctttgccagcgagatcctgctggagaccacagccacctgcatccactactag

SEQ ID NO: 36082 - DNA, 4206 bp, Artificial Sequence
  Description of Artificial Sequence: Synthetic coding sequence
atggccccccagatgtatgagttccacctgcccctgagccctgaggagctgctgaagagcggcggcgtgaaccagtatgtggtgcaggaggtgctgagcatcaagcacctgcccccccagctgcgggccttccaggccgccttccgggcccagggccccctggccatgctgcagcactttgacaccatctacagcatcctgcaccacttccgcagcattgatcctggcctgaaggaggacaccctgcagttcctgatcaaggtggtgagccgccacagccaggagctgcctgccatcctggatgacaccaccctgagcggcagtgacagaaatgcccacctgaatgccctgaagatgaactgctacgccctgatccggctgctggagagctttgagaccatggccagccagaccaacctggtggacctggacctgggcggcaagggcaagaaggcccggaccaaggccgcccacggctttgactgggaggaggagcggcagcccatcctgcagctgctgacccagctgctgcagctggacatccgccacctgtggaaccacagcatcatcgaggaggagtttgtgtccctggtgacaggctgctgctaccgcctgctggagaaccccaccatcaaccaccagaagaaccggcccacccgggaggccatcacccacctgctgggcgtggccctgacccgctacaaccacatgctgagcgccaccgtgaagatcatccagatgctgcagcactttgagcacctggcccctgtgctggtggccgctgtgtccctgtgggccacagattatggcatgaagagcatcgtgggggagatcgtgcgggagatcggccagaagtgcccccaggagctgagccgggaccccagcggcaccaagggctttgctgccttcctgacagagctggccgagcgggtgcctgccatcctgatgagctccatgtgcatcctgctggaccacctggatggagagaactacatgatgagaaatgctgtgctggccgccatggccgagatggtgctgcaggtgctgagcggggaccagctggaggccgccgcccgggacacccgggaccagttcctggacaccctgcaggcccacggccatgatgtgaacagctttgtgcgcagccgggtgctgcagctgttcaccagaattgtgcagcagaaggccctgcccctgacccgcttccaggccgtggtggccctggccgtgggccgcctggccgacaagtctgtgctggtgtgcaagaatgccatccagctgctggccagcttcctggccaacaaccccttcagctgcaagctgagtgatgctgacctggccggccccctgcagaaggagacccagaagctgcaggagatgagggcccagaggagaacagctgctgccagcgctgtgctggaccctgaggaggagtgggaggccatgctgcctgagctgaagagcaccctgcagcagctgctgcagctgccccagggcgaggaggagatccctgagcagatcgccaacacagagaccacagaagatgtgaagggccgcatctaccagctgctggccaaggccagctacaagaaggccatcatcctgacccgggaggccaccggccacttccaggagagcgagcccttcagccacatcgaccctgaggagagcgaggagacccggctgctgaacatcctgggcctcatcttcaagggccctgctgccagcacccaggagaagaacccccgggagagcacaggcaacatggtgacaggccagacagtgtgcaagaacaagcccaacatgtctgaccctgaggagagcagaggaaatgatgagctggtgaagcaggagatgctggtgcagtacctgcaggatgcctacagcttcagcaggaagatcacagaggccatcggcatcatcagcaagatgatgtatgagaacaccaccaccgtggtgcaggaggtgattgagttctttgtgatggtgttccagtttggagtgccccaggccctgtttggagtgcggaggatgctgcccctcatctggagcaaggagcccggggtgcgggaggccgtgctgaatgcctaccggcagctgtacctgaaccccaagggggacagcgcccgggccaaggcccaggccctgatccagaacctgagcctgctgctggtggatgcctctgtgggcaccatccagtgcctggaggagatcctgtgtgaatttgtgcagaaggatgagctgaagccagctgtgacccagctgctgtgggagcgggccacagagaaggtggcctgctgccccctggagcgctgcagctctgtgatgctgctgggcatgatggcccggggcaagccagagatcgtgggcagcaacctggacaccctggtgtccatcggcctggatgagaagttcccccaggactaccgcctggcccagcaggtgtgccacgccatcgccaacatcagtgacaggaggaagcccagcctgggcaagaggcacccccccttccggctgccccaggagcaccggctgtttgagcggctgcgggagaccgtgaccaagggctttgtgcacccagaccccctgtggatccccttcaaggaggtggccgtgaccctcatctaccagctggccgagggccctgaggtgatctgtgcccagatcctgcagggctgtgccaagcaggccctggagaagctggaggagaagaggaccagccaggaggaccccaaggagagccctgccatgctgcccaccttcctgctgatgaacctgctgagcctggccggagatgtggccctgcagcagctggtgcacctggagcaggccgtgtctggagagctgtgcagaagaagagtgctgcgggaggagcaggagcacaagaccaaggaccccaaggagaagaacaccagcagcgagaccaccatggaggaggagctgggcctggtgggcgccacagcagatgacacagaagctgagctgatccggggcatctgtgagatggagctgctggatggcaagcagaccctggccgcctttgtgcccctgctgctgaaggtgtgcaacaaccctggcctgtacagcaacccagacctgtctgctgctgccagcctggccctgggcaagttctgcatgatcagcgccaccttctgtgacagccagctgcggctgctcttcaccatgctggagaagagccccctgcccatcgtgcgcagcaacctgatggtggccactggagacctggccatccgcttccccaacctggtggacccctggaccccccacctgtatgcccggctgcgggaccctgcccagcaggtgaggaagacagctggcctggtgatgacccacctgatcctgaaggacatggtgaaggtgaagggccaggtgtctgagatggctgtgctgctgattgatcctgagccccagattgctgccctggccaagaacttcttcaatgagctgagccacaagggaaatgccatctacaacctgctgcctgacatcatcagccggctgagtgaccctgagctgggcgtggaggaggagcccttccacaccatcatgaagcagctgctgagctacatcaccaaggacaagcagacagagagcctggtggagaagctgtgccagcgcttccgcaccagcaggacagagcggcagcagagggacctggcctactgtgtgtcccagctgcccctgacagagcggggcctgaggaagatgctggacaactttgactgcttcggggacaagctgagtgatgagagcatcttcagcgccttcctgtctgtggtgggcaagctgcggcggggggccaagccagagggcaaggccatcattgatgaatttgagcagaagctgcgggcctgccacacccggggcctggatggcatcaaggagctggagatcggccaggccggcagccagagggcccccagcgccaagaagcccagcacaggcagccgctaccagcccctggccagcacagccagtgacaatgactttgtgaccccagagcccaggaggaccaccaggaggcaccccaacacccagcagagggccagcaagaagaagcccaaggtggtgttcagcagtgatgagagcagcgaggaggacctgtctgctgagatgacagaagatgagacccccaagaagaccacccccatcctgcgggccagcgcccggcggcacaggagctag

SEQ ID NO: 36083 - DNA, 2820 bp, Artificial Sequence
  Description of Artificial Sequence: Synthetic coding sequence
atggccccccagatgtatgagttccacctgcccctgagccctgaggagctgctgaagagcggcggcgtgaaccagtatgtggtgcaggaggtgctgagcatcaagcacctgcccccccagctgcgggccttccaggccgccttccgggcccagggccccctggccatgctgcagcactttgacaccatctacagcatcctgcacctggtgacaggctgctgctaccgcctgctggagaaccccaccatcaaccaccagaagaaccggcccacccgggaggccatcacccacctgctgggcgtggccctgacccgctacaaccacatgctgagcgccaccgtgaagatcatccagatgctgcagcactttgagcacctggcccctgtgctggtggccgctgtgtccctgtgggccacagattatggcatgaagagcatcgtgggggagatcgtgcgggagatcggccagaagtgcccccaggagctgagccgggaccccagcggcaccaagggctttgctgccttcctgacagagctggccgagcgggtgcctgccatcctgatgagctccatgtgcatcctgctggaccacctggatggagagaactacatgatgagaaatgctgtgctggccgccatggccgagatggtgctgcaggtgctgagcggggaccagctggaggccgccgcccgggacacccgggaccagttcctggacaccctgcaggcccacggccatgatgtgaacagctttgtgcgcagccgggtgctgcagctgttcaccagaattgtgcagcagaaggccctgcccctgacccgcttccaggccgtggtggccctggccgtgggccgcctggccgacaagtctgtgctggtgtgcaagaatgccatccagctgctggccagcttcctggccaacaaccccttcagctgcaagctgagtgatgctgacctggccggccccctgcagaaggagacccagaagctgcaggagatgagggcccagaggagaacagctgctgccagcgctgtgctggaccctgaggaggagtgggaggccatgctgcctgagctgaagagcaccctgcagcagctgctgcagctgccccagggcgaggaggagatccctgagcagatcgccaacacagagaccacagaagatgtgaagggccgcatctaccagctgctggccaaggccagctacaagaaggccatcatcctgacccgggaggccaccggccacttccaggagagcgagcccttcagccacatcgaccctgaggagagcgaggagacccggctgctgaacatcctgggcctcatcttcaagggccctgctgccagcacccaggagaagaacccccgggagagcacaggcaacatggtgacaggccagacagtgtgcaagaacaagcccaacatgtctgaccctgaggagagcagaggaaatgatgagctggtgaagcaggagatgctggtgcagtacctgcaggatgcctacagcttcagcaggaagatcacagaggccatcggcatcatcagcaagatgatgtatgagaacaccaccaccgtggtgcaggaggtgattgagttctttgtgatggtgttccagtttggagtgccccaggccctgtttggagtgcggaggatgctgcccctcatctggagcaaggagcccggggtgcgggaggccgtgctgaatgcctaccggcagctgtacctgaaccccaagggggacagcgcccgggccaaggcccaggccctgatccagaacctgagcctgctgctggtggatgcctctgtgggcaccatccagtgcctggaggagatcctgtgtgaatttgtgcagaaggatgagctgaagccagctgtgacccagctgctgtgggagcgggccacagagaaggtggcctgctgccccctggagcgctgcagctctgtgatgctgctgggcatgatggcccggggcaagccagagatcgtgggcagcaacctggacaccctggtgtccatcggcctggatgagaagttcccccaggactaccgcctggcccagcaggtgtgccacgccatcgccaacatcagtgacaggaggaagcccagcctgggcaagaggcacccccccttccggctgccccaggagcaccggctgtttgagcggctgcgggagaccgtgaccaagggctttgtgcacccagaccccctgtggatccccttcaaggaggtggccgtgaccctcatctaccagctggccgagggccctgaggtgatctgtgcccagatcctgcagggctgtgccaagcaggccctggagaagctggaggagaagaggaccagccaggaggaccccaaggagagccctgccatgctgcccaccttcctgctgatgaacctgctgagcctggccggagatgtggccctgcagcagctggtgcacctggagcaggccgtgtctggagagctgtgcagaagaagagtgctgcgggaggagcaggagcacaagaccaaggaccccaaggagaagaacaccagcagcgagaccaccatggaggaggagctgggcctggtgggcgccacagcagatgacacagaagctgagctgatccggggcatctgtgagatggagctgctggatggcaagcagaccctggccgcctttgtgcccctgctgctgaaggtgtgcaacaaccctggcctgtacagcaacccagacctgtctgctgctgccagcctggccctgggcaagttctgcatgatcagcgccaccttctgtgacagccagcactttgccatccccaggagagtggacaacctgaggtag

SEQ ID NO: 36084 - DNA, 4071 bp, Artificial Sequence
  Description of Artificial Sequence: Synthetic coding sequence
atgctgtgcaagcgctactgccccagcaacatcttccaccacagcctggagctgttccggctgccctttgagctgcggggcccctggctgtgctgcagcaccctcatcctgagcacagccttctgcatggtgagccgccacagccaggagctgcctgccatcctggatgacaccaccctgagcggcagtgacagaaatgcccacctgaatgccctgaagatgaactgctacgccctgatccggctgctggagagctttgagaccatggccagccagaccaacctggtggacctggacctgggcggcaagggcaagaaggcccggaccaaggccgcccacggctttgactgggaggaggagcggcagcccatcctgcagctgctgacccagctgctgcagctggacatccgccacctgtggaaccacagcatcatcgaggaggagtttgtgtccctggtgacaggctgctgctaccgcctgctggagaaccccaccatcaaccaccagaagaaccggcccacccgggaggccatcacccacctgctgggcgtggccctgacccgctacaaccacatgctgagcgccaccgtgaagatcatccagatgctgcagcactttgagcacctggcccctgtgctggtggccgctgtgtccctgtgggccacagattatggcatgaagagcatcgtgggggagatcgtgcgggagatcggccagaagtgcccccaggagctgagccgggaccccagcggcaccaagggctttgctgccttcctgacagagctggccgagcgggtgcctgccatcctgatgagctccatgtgcatcctgctggaccacctggatggagagaactacatgatgagaaatgctgtgctggccgccatggccgagatggtgctgcaggtgctgagcggggaccagctggaggccgccgcccgggacacccgggaccagttcctggacaccctgcaggcccacggccatgatgtgaacagctttgtgcgcagccgggtgctgcagctgttcacccgcatcgtgcagcagaaggccctgcccctgacccgcttccaggccgtggtggccctggccgtgggccgcctggccgacaagtctgtgctggtgtgcaagaatgccatccagctgctggccagcttcctggccaacaaccccttcagctgcaagctgagtgatgctgacctggccggccccctgcagaaggagacccagaagctgcaggagatgagggcccagaggagaacagctgctgccagcgctgtgctggaccctgaggaggagtgggaggccatgctgcctgagctgaagagcaccctgcagcagctgctgcagctgccccagggcgaggaggagatccctgagcagatcgccaacacagagaccacagaagatgtgaagggccgcatctaccagctgctggccaaggccagctacaagaaggccatcatcctgacccgggaggccaccggccacttccaggagagcgagcccttcagccacattgatcctgaggagagcgaggagacccggctgctgaacatcctgggcctcatcttcaagggccctgctgccagcacccaggagaagaacccccgggagagcactggaaacatggtgacaggccagacagtgtgcaagaacaagcccaacatgtctgaccctgaggagagcagaggaaatgatgagctggtgaagcaggagatgctggtgcagtacctgcaggatgcctacagcttcagcaggaagatcacagaggccatcggcatcatcagcaagatgatgtatgagaacaccaccaccgtggtgcaggaggtgattgagttctttgtgatggtgttccagtttggagtgccccaggccctgtttggagtgcggaggatgctgcccctcatctggagcaaggagcccggggtgcgggaggccgtgctgaatgcctaccggcagctgtacctgaaccccaagggggacagcgcccgggccaaggcccaggccctgatccagaacctgagcctgctgctggtggatgcctctgtgggcaccatccagtgcctggaggagatcctgtgtgaatttgtgcagaaggatgagctgaagccagctgtgacccagctgctgtgggagcgggccacagagaaggtggcctgctgccccctggagcgctgcagctctgtgatgctgctgggcatgatggcccggggcaagccagaaattgtgggcagcaacctggacaccctggtgtccatcggcctggatgagaagttcccccaggactaccgcctggcccagcaggtgtgccacgccatcgccaacatcagtgacaggaggaagcccagcctgggcaagaggcacccccccttccggctgccccaggagcaccggctgtttgagcggctgcgggagaccgtgaccaagggctttgtgcacccagaccccctgtggatccccttcaaggaggtggccgtgaccctcatctaccagctggccgagggccctgaggtgatctgtgcccagatcctgcagggctgtgccaagcaggccctggagaagctggaggagaagaggaccagccaggaggaccccaaggagagccctgccatgctgcccaccttcctgctgatgaacctgctgagcctggccggagatgtggccctgcagcagctggtgcacctggagcaggccgtgtctggagagctgtgcagaagaagagtgctgcgggaggagcaggagcacaagaccaaggaccccaaggagaagaacaccagcagcgagaccaccatggaggaggagctgggcctggtgggcgccacagcagatgacacagaggccgagctgatccggggcatctgtgagatggagctgctggatggcaagcagaccctggccgcctttgtgcccctgctgctgaaggtgtgcaacaaccctggcctgtacagcaacccagacctgtctgctgctgccagcctggccctgggcaagttctgcatgatcagcgccaccttctgtgacagccagctgcggctgctcttcaccatgctggagaagagccccctgcccatcgtgcgcagcaacctgatggtggccaccggggacctggccatccgcttccccaacctggtggacccctggaccccccacctgtatgcccggctgcgggaccctgcccagcaggtgaggaagacagctggcctggtgatgacccacctgatcctgaaggacatggtgaaggtgaagggccaggtgtctgagatggctgtgctgctgattgatcctgagccccagattgctgccctggccaagaacttcttcaatgagctgagccacaagggaaatgccatctacaacctgctgcctgacatcatcagccggctgagtgaccctgagctgggcgtggaggaggagcccttccacaccatcatgaagcagctgctgagctacatcaccaaggacaagcagacagagagcctggtggagaagctgtgccagcgcttccgcaccagcaggacagagcggcagcagagggacctggcctactgtgtgtcccagctgcccctgacagagcggggcctgaggaagatgctggacaactttgactgctttggagacaagctgagtgatgagagcatcttcagcgccttcctgtctgtggtgggcaagctgcggcggggggccaagccagagggcaaggccatcattgatgaatttgagcagaagctgcgggcctgccacacccggggcctggatggcatcaaggagctggagatcggccaggccggcagccagagggcccccagcgccaagaagcccagcacaggcagccgctaccagcccctggccagcacagccagtgacaatgactttgtgaccccagagcccaggaggaccacccggcggcaccccaacacccagcagagggccagcaagaagaagcccaaggtggtgttcagcagtgatgagagcagcgaggaggacctgtctgctgagatgacagaagatgagacccccaagaagaccacccccatcctgcgggccagcgcccggcggcacaggagctag

SEQ ID NO: 36085 - DNA, 2382 bp, Artificial Sequence
  Description of Artificial Sequence: Synthetic coding sequence
atggacagctggttcatcctggtgctgctgggcagcggcctcatctgtgtgtctgccaacaatgccaccaccgtggcccccagcgtgggcatcaccaggctcatcaacagcagcacagctgagcctgtgaaggaggaggccaagaccagcaaccccaccagcagcctgaccagcctgtctgtggcccccaccttcagccccaacatcaccctgggccccacctacctgaccaccgtgaacagcagtgacagcgacaatggcaccaccaggacagccagcaccaacagcatcggcatcaccatcagccccaacggcacctggctgcctgacaaccagttcacagatgccaggacagagccctgggagggcaacagcagcacagctgccaccaccccagagaccttccccccatctgatgagacccccatcatcgctgtgatggtggccctgagcagcctgctggtgattgtgttcatcatcatcgtgctgtacatgctgcgcttcaagaagtacaagcaggccggcagccacagcaacagcttccggctgagcaatggaagaacagaagatgtggagccccagagcgtgcccctgctggcccggagccccagcaccaacaggaagtacccacccctgcctgtggacaagctggaggaggagatcaacagaaggatggctgatgacaacaagctgttccgggaggagttcaatgccctgcctgcctgccccatccaggccacctgtgaggccgccagcaaggaggagaacaaggagaagaaccgctacgtgaacatcctgccctatgaccacagccgggtgcacctgacccctgtggagggcgtgcctgacagcgactacatcaatgccagcttcatcaatggctaccaggagaagaacaagttcatcgccgcccagggccccaaggaggagaccgtgaatgacttctggaggatgatctgggagcagaacacagccaccatcgtgatggtgaccaacctgaaggagaggaaggagtgcaagtgtgcccagtactggccagaccagggctgctggacctacggcaacatccgggtgtctgtggaggatgtgacagtgctggtggactacacagtgaggaagttctgcatccagcaggtgggggacatgaccaacaggaagccccagaggctcatcacccagttccacttcacctcctggccagactttggagtgcccttcacccccatcggcatgctgaagttcctgaagaaggtgaaggcctgcaacccccagtatgctggggccatcgtggtgcactgcagcgctggggtgggccgcacaggcacctttgtggtgattgatgccatgctggacatgatgcacacagagaggaaggtggatgtgtatggctttgtgagccgcatccgggcccagcgctgccagatggtgcagacagacatgcagtatgtgttcatctaccaggccctgctggagcactacctgtatggagacacagagctggaggtgaccagcctggagacccacctgcagaagatctacaacaagatccctggcaccagcaacaacggcctggaggaggagttcaagaagctgaccagcatcaagatccagaatgacaagatgaggactggaaacctgcctgccaacatgaagaagaacagagtgctgcagatcatcccctatgagttcaacagagtcatcatccctgtgaagagaggagaagaaaatacagattatgtgaatgccagcttcattgatggctaccggcagaaggacagctacatcgccagccagggccccctgctgcacaccatcgaggacttctggaggatgatctgggagtggaagagctgcagcatcgtgatgctgacagagctggaggagcggggccaggagaagtgtgcccagtactggcccagtgatggcctggtgtcctatggagacatcaccgtggagctgaagaaggaggaggagtgtgagagctacacagtgcgggacctgctggtgaccaacacccgggagaacaagagccggcagatccggcagttccacttccacggctggccagaggtgggcatccccagtgatggcaagggcatgatcagcatcatcgctgctgtgcagaagcagcagcagcagagcggcaaccaccccatcaccgtgcactgcagcgctggagctggccgcacaggcaccttctgtgccctgagcacagtgctggagcgggtgaaggccgagggcatcctggatgtgttccagacagtgaagagcctgcggctgcagaggccccacatggtgcagaccctggagcagtatgagttctgctacaaggtggtgcaggagtacattgatgccttcagtgactatgccaacttcaagtag

SEQ ID NO: 36086 - DNA, 1119 bp, Artificial Sequence
  Description of Artificial Sequence: Synthetic coding sequence
atggctgctgagcggcaggaggccctgcgggagtttgtggccgtgactggagctgaggaggaccgggcccgcttcttcctggagagcgctggctgggacctgcagatcgccctggccagcttctatgaagatggaggagatgaggacatcgtgaccatcagccaggccacccccagctctgtgtcccggggcacagcccccagcgacaacagagtgaccagcttccgggacctgattcatgaccaggatgaagatgaggaggaggaggagggccagagggaccgcttctacgccggcggcagcgagaggagcggccagcagatcgtgggcccccccaggaagaagagccccaatgagctggtggatgacctcttcaagggggccaaggagcacggggctgtggccgtggagcgggtgaccaagagccctggagagaccagcaagccccggccctttgctgggggcggctaccgcctgggcgccgcccctgaggaggagagcgcctacgtggccggggagaagaggcagcacagcagccaggatgtgcacgtggtgctgaagctgtggaagagcggcttcagcctggacaatggagagctgcggagctaccaggaccccagcaatgcccagttcctggagagcatccggcggggggaggtgcctgctgagctgcggcggctggcccatggaggccaggtgaacctggacatggaggaccacagagatgaagattttgtgaagcccaagggggccttcaaggccttcaccggggagggccagaagctgggcagcacagccccccaggtgctgagcaccagcagccctgcccagcaggccgagaatgaggccaaggccagcagcagcatcctgattgatgagagcgagcccaccaccaacatccagatccggctggctgatggcggccgcctggtgcagaagttcaaccacagccaccgcatcagtgacatccgcctcttcatcgtggatgcccggcctgccatggccgccaccagcttcatcctgatgaccaccttccccaacaaggagctggctgatgagagccagaccctgaaggaggccaacctgctgaatgctgtgattgtgcagaggctgacctag

SEQ ID NO: 36087 - DNA, 1020 bp, Artificial Sequence
  Description of Artificial Sequence: Synthetic coding sequence
atggctgctgagcggcaggaggccctgcgggagtttgtggccgtgactggagctgaggaggaccgggcccgcttcttcctggagagcgctggctgggacctgcagatcgccctggccagcttctatgaagatggaggagatgaggacatcgtgaccatcagccaggccacccccagctctgtgtcccggggcacagcccccagcgacaacagagtgaccagcttccgggacctgattcatgaccaggatgaagatgaggaggaggaggagggccagcgcttctacgccggcggcagcgagaggagcggccagcagatcgtgggcccccccaggaagaagagccccaatgagctggtggatgacctcttcaagggggccaaggagcacggggctgtggccgtggagcgggtgaccaagagccctggagagaccagcaagccccgggtgcacgtggtgctgaagctgtggaagagcggcttcagcctggacaacggggagctgcggagctaccaggaccccagcaatgcccagttcctggagagcatcagaagaggagaggtgcctgctgagctgcggcggctggcccacggcggccaggtgaacctggacatggaggaccacagagatgaggactttgtgaagcccaagggggccttcaaggccttcaccggggagggccagaagctgggcagcacagccccccaggtgctgagcaccagcagccctgcccagcaggctgaaaatgaggccaaggccagcagcagcatcctgattgatgaaagtgagcccaccaccaacatccagatccggctggctgatggcggccgcctggtgcagaagttcaaccacagccaccgcatcagtgacatccgcctcttcatcgtggatgcccggcctgccatggccgccaccagcttcatcctgatgaccaccttccccaacaaggagctggctgatgagagccagaccctgaaggaggccaacctgctgaatgctgtgattgtgcagaggctgacctag

SEQ ID NO: 36088 - DNA, 780 bp, Artificial Sequence
  Description of Artificial Sequence: Synthetic coding sequence
atgaccaagatgaagatgaggaggaagaggaaggcccggggggccaaggagcacggggctgtggccgtggagcgggtgaccaagagccctggagagaccagcaagccccggccctttgctgggggcggctaccgcctgggcgccgcccctgaggaggagagcgcctacgtggccggggagaagaggcagcacagcagccaggatgtgcacgtggtgctgaagctgtggaagagcggcttcagcctggacaacggggagctgcggagctaccaggaccccagcaatgcccagttcctggagagcatcagaagaggagaggtgcctgctgagctgcggcggctggcccacggcggccaggtgaacctggacatggaggaccacagagatgaggactttgtgaagcccaagggggccttcaaggccttcaccggggagggccagaagctgggcagcacagccccccaggtgctgagcaccagcagccctgcccagcaggctgaaaatgaggccaaggccagcagcagcatcctgattgatgaaagtgagcccaccaccaacatccagatccggctggctgatggcggccgcctggtgcagaagttcaaccacagccaccgcatcagtgacatccgcctcttcatcgtggatgcccggcctgccatggccgccaccagcttcatcctgatgaccaccttccccaacaaggagctggctgatgagagccagaccctgaaggaggccaacctgctgaatgctgtgattgtgcagaggctgacctag

SEQ ID NO: 36089 - DNA, 1119 bp, Artificial Sequence
  Description of Artificial Sequence: Synthetic coding sequence
atggctgctgagcggcaggaggccctgcgggagtttgtggccgtgactggagctgaggaggaccgggcccgcttcttcctggagagcgctggctgggacctgcagatcgccctggccagcttctatgaagatggaggagatgaggacatcgtgaccatcagccaggccacccccagctctgtgtcccggggcacagcccccagcgacaacagagtgaccagcttccgggacctgattcatgaccaggatgaagatgaggaggaggaggagggccagaggagccgcttctacgccggcggcagcgagaggagcggccagcagatcgtgggcccccccaggaagaagagccccaatgagctggtggatgacctcttcaagggggccaaggagcacggggctgtggccgtggagcgggtgaccaagagccctggagagaccagcaagccccggccctttgctgggggcggctaccgcctgggcgccgcccctgaggaggagagcgcctacgtggccggggagaagaggcagcacagcagccaggatgtgcacgtggtgctgaagctgtggaagagcggcttcagcctggacaatggagagctgcggagctaccaggaccccagcaatgcccagttcctggagagcatccggcggggggaggtgcctgctgagctgcggcggctggcccatggaggccaggtgaacctggacatggaggaccacagagatgaagattttgtgaagcccaagggggccttcaaggccttcaccggggagggccagaagctgggcagcacagccccccaggtgctgagcaccagcagccctgcccagcaggccgagaatgaggccaaggccagcagcagcatcctgattgatgagagcgagcccaccaccaacatccagatccggctggctgatggcggccgcctggtgcagaagttcaaccacagccaccgcatcagtgacatccgcctcttcatcgtggatgcccggcctgccatggccgccaccagcttcatcctgatgaccaccttccccaacaaggagctggctgatgagagccagaccctgaaggaggccaacctgctgaatgctgtgattgtgcagaggctgacctag

SEQ ID NO: 36090 - DNA, 1056 bp, Artificial Sequence
  Description of Artificial Sequence: Synthetic coding sequence
atggaggacagccaggagaccagccccagcagcaacaacagcagcgaggagctgagcagcgccctgcacctgagcaagggcatgagcatcttcctggacatcctgcggcgggctgacaagaatgatgatggcaagctgagctttgaggagttcaaggcctactttgctgatggagtgctgtctggagaggagctgcacgagctgttccacaccatcgacacccacaacaccaacaacctggacacagaggagctgtgtgagtacttcagccagcacctgggggagtatgaaaatgtgctggccgccctggaggacctgaacctgagcatcctgaaggccatgggcaagaccaagaaggactaccaggaggccagcaacctggagcagtttgtgacccgcttcctgctgaaggagaccctgaaccagctgcagagcctgcagaacagcctggagtgtgccatggagaccacagaggagcagacccggcaggagcggcagggccctgccaagccagaggtgctgagcatccagtggccaggcaagaggagcagcagaagagtgcagaggcacaacagcttcagccccaacagcccccagttcaacgtgtctggccctggcctgctggaggaggacaaccagtggatgacccagatcaaccggctgcagaagctgattgaccggctggagaagaaggacctgaagctggagcccccagaggaggagatcatcgagggcaacaccaagagccacatcatgctggtgcagaggcagatgtctgtgattgaggaggacctggaggagttccagctggccctgaagcactacgtggagagcgccagcagccagagcggctgcctgcgcatcagcatccagaagctgagcaatgaaagccgctacatgatctatgagttctgggagaacagctctgtgtggaacagccacctgcagaccaactacagcaagaccttccagaggagcaatgtggacttcctggagaccccagagctgaccagcaccatgctggtgcctgcctcctggtggatcctgaacaactag

SEQ ID NO: 36091 - DNA, 303 bp, Artificial Sequence
  Description of Artificial Sequence: Synthetic coding sequence
atgctggtgcagaggcagatgtctgtcatcgaggaggacctggaggagttccagctggccctgaagcactacgtggagagcgccagcagccagagcggctgcctgcgcatcagcatccagaagctgagcaatgaaagccgctacatgatctatgagttctgggagaacagctctgtgtggaacagccacctgcagaccaactacagcaagaccttccagaggagcaatgtggacttcctggagaccccagagctgaccagcaccatgctggtgcctgcctcctggtggatcctgaacaactag

SEQ ID NO: 36092 - DNA, 303 bp, Artificial Sequence; identical to SEQ ID NO: 36091
  Description of Artificial Sequence: Synthetic coding sequence

SEQ ID NO: 36093 - DNA, 2499 bp, Artificial Sequence
  Description of Artificial Sequence: Synthetic coding sequence
atgcacaagcactacaaggtgcactttgccaaggatgcccagagccccaacggccactacttctgggaccctgagctgggccacaggaagggctgctgccaccagtggaggcaggacagcgctgccctgcgggcccacggcccctgccggcccagcccccagagccactggcagctggcctaccacagccaccaggtgggcggcagcggctggaggcggggcctgctgcccagcgtgctgcagcagcagaggcagccccagagccagcccagcccccccagccccctgcggcagaggctgtgccccatccacgaggcccagaagggcctgcctgccaccagcacagtgcccaaggagcccgccagcgccccccaggcccccaccctgcccaccacagccccagccatggcccggagcggccctgccctgcccagcgctgctggggtgctgctgaagcccagcgagcccacagatgcccggcccctgcctgccccagctgcctgtggcagcttcaccgcctacagcagtgacatcctgacagaagatgatgtgtactgcagctgcctggccaagaccctgtgccacgtgcctgtgcctgtgacagtgggcttctacgcccccttcggctgccgcctgcacatgatgctggacaagatcacagccctgatgcagcaggaggccgcccagcgggagagcgaggagctgcagcacgtgcagtggaggcccagggctgtgtctggctggggcgtgccccagctgctgtggtacctggtgttcctgcagcccatcatcacagaggtgcacctgcggaggagaaatgtgcagttcctgttcatccgcttcagcgcctggcagtatgccggcacagacaagctgtgggccggcctggtgaccaccctgtgtgagggcatcagaagacactacggggccctgcccttctctgtgtacagcgtgctgggcaacaagccagccacccggcaggactgctgccagagcgagtggcactgcagaagaagagtgtgcctgggcctgctggccctgctggccgccctgggcctgggcgtgggcctgctgtacctgagcctgggcggccacgccctgggccacggcagccccagcggcagcctgctgaaggtgtttggaggagctgccaccaccctgagcggcagcggcctgctgatggctgtgtacagcgtgggcaagcacctgtttgtgtcccagaggaagaagattgagcggctggtgtcccgggagaagtttggcagccagctgggcttcatgtgtgaggtgaagaaggaggtggagctgctgacagacttcctgtgcttcctggagatctaccagaggcggcggctgcgggtggtgctggaggtgacaggcctggacacctgctacccagagcgggtggtgggcgtgctgaatgccatcaacaccctgctgagtgacagccacgcccccttcatcttcatcctggtggtggaccccagcatcctggccgcctgcctggagagcgctggcaacatgaagggcacagctgacaatggctacctgttcctgaacagaacagtgaccctgcccttctctgtgcccatcatgggccgccgcaccaagctgcagttcctgcatgatgctgtgcagagcagagatgacctgctgtaccgggagatgaccaggaagccctggctgcctggagatgctggaggagagagcgcccagctgctggccgtgcaggcccaggccggcacagagcggggccagggcagaattgatgatgaagctgcccggcgcatccaggaggccctcttctgcctgcatgatgagcgggactgcctgtatgaatatgtgcctgacaacgtggtgtccatgagaagaattgtgaacacagtgcccatcaccgtgcggctgctgcagcagcagcagcagcagggcgactttggaggccccaccccccggcaggccgtggcctgggtggtgctggccaaccagtggccctgccgcctgtcctgggccctgcagtgcctggaggaccggcagcagacaggaggagcccctgagggccgggcccggctgtgggatgtgttccgggacaacagccgggagctgcacaccatgaccaaggccctgcagaatgtgctggacctggatggagaccctgagctgtttgagcgcttcctgggcgctgacttccccttcaccgtggccgaggcccagagcctgctgcgctgcaccgtgaacctggaccacagcatcagaagaaggatgggcctcatccgggctgtgtctgccctgaagccacccagcccccccaagagccccacccgggacacccctcatgctgcccaccgggccaacagcgccagccgggccccacccagcggccgggccagcggccaggccggggagggccaccacactggagacctggcccaccggggcaagctgtggcctgtggcctgtgccctcttccggcccggccagagcagccctgggggcccctag

SEQ ID NO: 36094 - DNA, 1596 bp, Artificial Sequence
  Description of Artificial Sequence: Synthetic coding sequence
atgcagcaggaggccgcccagcgggagagcgaggagctgcagcacgtgcagtggaggcccagggctgtgtctggctggggcgtgccccagctgctgtggtacctggtgttcctgcagcccatcatcacagaggtgcacctgcggaggagaaatgtgcagttcctgttcatccgcttcagcgcctggcagtatgccggcacagacaagctgtgggccggcctggtgaccaccctgtgtgagggcatcagaagacactacggggccctgcccttctctgtgtacagcgtgctgggcaacaagccagccacccggcaggactgctgccagagcgagtggcactgcagaagaagagtgtgcctgggcctgctggccctgctggccgccctgggcctgggcgtgggcctgctgtacctgagcctgggcggccacgccctgggccacggcagccccagcggcagcctgctgaaggtgtttggaggagctgccaccaccctgagcggcagcggcctgctgatggctgtgtacagcgtgggcaagcacctgtttgtgtcccagaggaagaagattgagcggctggtgtcccgggagaagtttggcagccagctgggcttcatgtgtgaggtgaagaaggaggtggagctgctgacagacttcctgtgcttcctggagatctaccagaggcggcggctgcgggtggtgctggaggtgacaggcctggacacctgctacccagagcgggtggtgggcgtgctgaatgccatcaacaccctgctgagtgacagccacgcccccttcatcttcatcctggtggtggaccccagcatcctggccgcctgcctggagagcgctggcaacatgaagggcacagctgacaatggctacctgttcctgaacagaacagtgaccctgcccttctctgtgcccatcatgggccgccgcaccaagctgcagttcctgcatgatgctgtgcagagcagagatgacctgctgtaccgggagatgaccaggaagccctggctgcctggagatgctggaggagagagcgcccagctgctggccgtgcaggcccaggccggcacagagcggggccagggcagaattgatgatgaagctgcccggcgcatccaggaggccctcttctgcctgcatgatgagcgggactgcctgtatgaatatgtgcctgacaacgtggtgtccatgagaagaattgtgaacacagtgcccatcaccgtgcggctgctgcagcagcagcagcagcagggcgactttggaggccccaccccccggcaggccgtggcctgggtggtgctggccaaccagtggccctgccgcctgtcctgggccctgcagtgcctggaggaccggcagcagacaggaggagcccctgagggccgggcccggctgtgggatgtgttccgggacacccctcatgctgcccaccgggccaacagcgccagccgggcccctccttctggccgggccagcggccaggccggggagggccaccacactggagacctggcccaccggggcaagctgtggcctgtggcctgtgccctcttccggcccggccagagcagccctgggggcccctag

SEQ ID NO: 36095 - DNA, 1833 bp, Artificial Sequence
  Description of Artificial Sequence: Synthetic coding sequence
atgcagcaggaggccgcccagcgggagagcgaggagctgcagcacgtgcagtggaggcccagggctgtgtctggctggggcgtgccccagctgctgtggtacctggtgttcctgcagcccatcatcacagaggtgcacctgcggaggagaaatgtgcagttcctgttcatccgcttcagcgcctggcagtatgccggcacagacaagctgtgggccggcctggtgaccaccctgtgtgagggcatcagaagacactacggggccctgcccttctctgtgtacagcgtgctgggcaacaagccagccacccggcaggactgctgccagagcgagtggcactgcagaagaagagtgtgcctgggcctgctggccctgctggccgccctgggcctgggcgtgggcctgctgtacctgagcctgggcggccacgccctgggccacggcagccccagcggcagcctgctgaaggtgtttggaggagctgccaccaccctgagcggcagcggcctgctgatggctgtgtacagcgtgggcaagcacctgtttgtgtcccagaggaagaagattgagcggctggtgtcccgggagaagtttggcagccagctgggcttcatgtgtgaggtgaagaaggaggtggagctgctgacagacttcctgtgcttcctggagatctaccagaggcggcggctgcgggtggtgctggaggtgacaggcctggacacctgctacccagagcgggtggtgggcgtgctgaatgccatcaacaccctgctgagtgacagccacgcccccttcatcttcatcctggtggtggaccccagcatcctggccgcctgcctggagagcgctggcaacatgaagggcacagctgacaatggctacctgttcctgaacagaacagtgaccctgcccttctctgtgcccatcatgggccgccgcaccaagctgcagttcctgcatgatgctgtgcagagcagagatgacctgctgtaccgggagatgaccaggaagccctggctgcctggagatgctggaggagagagcgcccagctgctggccgtgcaggcccaggccggcacagagcggggccagggcagaattgatgatgaagctgcccggcgcatccaggaggccctcttctgcctgcatgatgagcgggactgcctgtatgaatatgtgcctgacaacgtggtgtccatgagaagaattgtgaacacagtgcccatcaccgtgcggctgctgcagcagcagcagcagcagggcgactttggaggccccaccccccggcaggccgtggcctgggtggtgctggccaaccagtggccctgccgcctgtcctgggccctgcagtgcctggaggaccggcagcagacaggaggagcccctgagggccgggcccggctgtgggatgtgttccgggacaacagccgggagctgcacaccatgaccaaggccctgcagaatgtgctggacctggatggagaccctgagctgtttgagcgcttcctgggcgctgacttccccttcaccgtggccgaggcccagagcctgctgcgctgcaccgtgaacctggaccacagcatcagaagaaggatgggcctcatccgggctgtgtctgccctgaagccacccagcccccccaagagccccacccgggacacccctcatgctgcccaccgggccaacagcgccagccgggccccacccagcggccgggccagcggccaggccggggagggccaccacactggagacctggcccaccggggcaagctgtggcctgtggcctgtgccctcttccggcccggccagagcagccctgggggcccctag

SEQ ID NO: 36096 - DNA, 1062 bp, Artificial Sequence
  Description of Artificial Sequence: Synthetic coding sequence
atgaggctgcgcttctggctgctgatctggctgctgctgggcttcatcagccaccagcccacccctgtgtccttcctgaagaccatcttctggagcagaaatggacatgatggctccatggatgtgcagcagagggcctggaggagcaacagaagccggcagaagggcctgcggagcatctgcatgcacaccaagaagagggtgagcagcttccggggcaacaagattggcctgaaggatgtgatcaccctgcggagacatgtggagaccaaggtgcgggccaagatcaggaagaggaaggtgaccaccaagatcaacagacatgacaagatcaacgggaagaggaagacagccaggaagcagaagatgttccagagggcccaggagctgcggcggcgggcagaggactaccacaagtgcaagatccccccatctgccaggaagcccctgtgcaactgggtgaggatggctgctgctgagcaccgccacagcagcggcctgccctactggctgtacctgacagctgagaccctgaagaacaggatgggccggcagcccccaccacccacccagcagcacagcatcacagacaacagcctgagcctgaagaccccaccagaatgtctgctgacccccctgccccccagcgtggatgacaacatcaaggaatgtcccctggcccccctgccccccagccccctgcccccatctgtggatgacaacctgaaggagtgcctgtttgtgcccctgccccccagccccctgccccccagcgtggatgacaacctgaaggaatgtctgtttgtgcccctgccccccagccccctgcccccatctgtggatgacaacctgaagaccccacccctggccacccaggaggccgaggtggagaagccacccaagcccaagcgctggagggtggatgaggtggagcagagccccaagcccaagaggcagcgggaggccgaggcccagcagctgcccaagcccaagagaagaaggctgagcaagctgcggaccaggcactgcacccaggcctgggccatccgcatcaacccctag

SEQ ID NO: 36097 - DNA, 1827 bp, Artificial Sequence
  Description of Artificial Sequence: Synthetic coding sequence
atggccgagagcatcatcatccgggtgcagagcccagatggagtgaagaggatcacagccaccaagcgggagacagctgccaccttcctgaagaaggtggccaaggagtttggcttccagaacaacggcttctctgtgtacatcaacagaaacaagacaggagagatcacagccagcagcaacaagagcctgaacctgctgaagatcaagcatggagacctgctcttcctgttccccagcagcctggccggccccagcagcgagatggagacctctgtgcccccaggcttcaaggtgtttggagcccccaacgtggtggaggatgaaattgaccagtacctgagcaagcaggacggcaagatctaccgcagccgggacccccagctgtgccgccacggccccctgggcaaatgtgtgcactgtgtgcccctggagccctttgatgaggactacctgaaccacctggagccccctgtgaagcacatgtccttccacgcctacatcaggaagctgaccggcggcgctgacaagggcaagtttgtggccctggagaacatcagctgcaagatcaagagcggctgtgagggccacctgccctggcccaacggcatctgcaccaagtgccagcccagcgccatcaccctgaaccggcagaagtaccgccacgtggacaacatcatgtttgagaaccacacagtggccgaccgcttcctggacttctggaggaagacaggcaaccagcacttcggctacctgtatggccgctacacagagcacaaggacatccccctgggcatccgggcagaggtggccgccatctatgagcccccccagatcggcacccagaacagcctggagctgctggaggaccccaaggccgaggtggtggatgaaattgctgccaagctgggcctgaggaaggtgggctggatcttcacagacctggtgtctgaggacaccaggaagggcaccgtgcgctacagcaggaacaaggacacctacttcctgagcagcgaggagtgcatcacagctggggacttccagaacaagcaccccaacatgtgccgcctgagcccagatggccacttcggcagcaagtttgtgacagctgtggccactggaggccctgacaaccaggtgcactttgagggctaccaggtgagcaaccagtgcatggccctggtgagagatgagtgcctgctgccctgcaaggatgcccctgagctgggctacgccaaggagagcagcagcgagcagtatgtgcctgatgtgttctacaaggatgtggacaagtttggaaatgagatcacccagctggcccggcccctgcctgtggagtacctgatcatcgacatcaccaccaccttccccaaggaccctgtgtacaccttcagcatcagccagaaccccttccccatcgagaacagagatgtgctgggggagacccaggacttccacagcctggccacctacctgagccagaacaccagcagcgtcttcctggacaccatcagtgacttccacctgctgctcttcctggtgaccaatgaggtgatgcccctgcaggacagcatcagcctgctgctggaggccgtgaggaccagaaatgaggagctggcccagacctggaagaggtctgagcagtgggccaccatcgagcagctgtgcagcacagtgggcggccagctgcccggcctgcatgaatatggagctgtgggcggcagcacccacacagccacagctgccatgtgggcctgccagcactgcaccttcatgaaccagcccggcaccggccactgtgagatgtgcagcctgcccaggacatag

SEQ ID NO: 36098 - DNA, 1851 bp, Artificial Sequence
  Description of Artificial Sequence: Synthetic coding sequence
gctgaggtggtgatcatccgggtgcagagcccagatggagtgaagaggatcacagccaccaagcgggagacagctgccaccttcctgaagaaggtggccaaggagtttggcttccagaacaacggcttctctgtgtacatcaacagaaacaagacaggagagatcacagccagcagcaacaagagcctgaacctgctgaagatcaagcacggggacctgctcttcctgttccccagcagcctggccggccccagcagcgagatggagacctctgtgcccccaggcttcaaggtgtttggagccccaaatgtggtggaggatgaaattgaccagtacctgagcaagcaggacggcaagatctaccgcagccgggacccccagctgtgcagacatggccccctgggcaaatgtgtgcactgtgtgcccctggagccctttgatgaggactacctgaaccacctggagccccctgtgaagcacatgtccttccacgcctacatcaggaagctgactggaggagctgacaagggcaagtttgtggccctggagaacatcagctgcaagatcaagagcggctgtgagggccacctgccctggcccaacggcatctgcaccaagtgccagcccagcgccatcaccctgaaccggcagaagtacagacatgtggacaacatcatgtttgagaaccacacagtggccgaccgcttcctggacttctggaggaagacaggcaaccagcacttcggctacctgtatggccgctacacagagcacaaggacatccccctgggcatccgggcagaggtggccgccatctatgagcccccccagatcggcacccagaacagcctggagctgctggaggaccccaaggccgaggtggtggatgaaattgctgccaagctgggcctgaggaaggtgggctggatcttcacagacctggtgtctgaggacaccaggaaaggaacagtgcgctacagcaggaacaaggacacctacttcctgagcagcgaggagtgcatcacagctggggacttccagaacaagcaccccaacatgtgccgcctgagcccagatggccacttcggcagcaagtttgtgacagctgtggccaccggcggccctgacaaccaggtgcactttgagggctaccaggtgagcaaccagtgcatggccctggtgagagatgaatgtctgctgccctgcaaggatgcccctgagctgggctacgccaaggagagcagcagcgagcagtatgtgcctgatgtgttctacaaggatgtggacaagtttggaaatgagatcacccagctggcccggcccctgcctgtggagtacctgatcatcgacatcaccaccaccttccccaaggaccctgtgtacaccttcagcatcagccagaaccccttccccattgaaaatagagatgtgctgggggagacccaggacttccacagcctggccacctacctgagccagaacaccagctctgtgttcctggacaccatcagtgacttccacctgctgctcttcctggtgaccaatgaggtgatgcccctgcaggacagcatcagcctgctgctggaggccgtgaggaccagaaatgaggagctggcccagacctggaagaggtctgagcagtgggccaccatcgagcagctgtgcagcgagtacccccaccccctgcccaggcaccctgtggccggggccggggagcagcccaccctgcacagcagccccctgcctgtggtgccctggatcccccaccctgctgcctcctggcaggtgcccagcgccatgcagagggtggagaccaggcctccctgccaggcccggggccgcctgaggtag

SEQ ID NO: 36099 - DNA, 1371 bp, Artificial Sequence
  Description of Artificial Sequence: Synthetic coding sequence
atgtccttccacgcctacatcaggaagctgactggaggagctgacaagggcaagtttgtggccctggagaacatcagctgcaagatcaagagcggctgtgagggccacctgccctggcccaacggcatctgcaccaagtgccagcccagcgccatcaccctgaaccggcagaagtacagacatgtggacaacatcatgtttgagaaccacacagtggccgaccgcttcctggacttctggaggaagacaggcaaccagcacttcggctacctgtatggccgctacacagagcacaaggacatccccctgggcatccgggcagaggtggccgccatctatgagcccccccagatcggcacccagaacagcctggagctgctggaggaccccaaggccgaggtggtggatgaaattgctgccaagctgggcctgaggaaggtgggctggatcttcacagacctggtgtctgaggacaccaggaaaggaacagtgcgctacagcaggaacaaggacacctacttcctgagcagcgaggagtgcatcacagctggggacttccagaacaagcaccccaacatgtgccgcctgagcccagatggccacttcggcagcaagtttgtgacagctgtggccaccggcggccctgacaaccaggtgcactttgagggctaccaggtgagcaaccagtgcatggccctggtgagagatgaatgtctgctgccctgcaaggatgcccctgagctgggctacgccaaggagagcagcagcgagcagtatgtgcctgatgtgttctacaaggatgtggacaagtttggaaatgagatcacccagctggcccggcccctgcctgtggagtacctgatcatcgacatcaccaccaccttccccaaggaccctgtgtacaccttcagcatcagccagaaccccttccccattgaaaatagagatgtgctgggggagacccaggacttccacagcctggccacctacctgagccagaacaccagctctgtgttcctggacaccatcagtgacttccacctgctgctcttcctggtgaccaatgaggtgatgcccctgcaggacagcatcagcctgctgctggaggccgtgaggaccagaaatgaggagctggcccagacctggaagaggtctgagcagtgggccaccatcgagcagctgtgcagcgagtacccccaccccctgcccaggcaccctgtggccggggccggggagcagcccaccctgcacagcagccccctgcctgtggtgccctggatcccccaccctgctgcctcctggcaggtgcccagcgccatgcagagggtggagaccaggcctccctgccaggcccggggccgcctgaggtag

SEQ ID NO: 36100 - DNA, 2202 bp, Artificial Sequence
  Description of Artificial Sequence: Synthetic coding sequence
atggaggcctcctggaggcaggtggccggcggccggggccgcagccggggccgggccacagctgcccccagcggaaatggagtgcacctgcggggagctgggggcggccgggagaagggctctgtgggcgctgtgcccagcggcaccagccctggaggagtggccaccacagctgctgctggcagccgccacagccctgctggcagccaggccctgcagaccacagctgccagcgagctgatgagccagaagaagtttgaggagatcaagaaggccaaccaggccgccgccaggaagctggtggaggagcagttcagcagcagcagcgaggagggagatgaggactttgagggcaagcagggcaagatcctggccaacaccttcatcacctacaccacccagacagatggagacacccgggagctggagaggaccaagcagtatgtgaatgaggccttccaggccggggccatgacctgcctgatctgcatcgcctctgtgaagaggaaccaggccgtgtggagctgcagcggctgcttctgcatcttccacatgccctgcatccagaagtgggccaaggacagccagttcctggtgtcctctgtgacagatgatgactttgggaagaaggactgcccctggccctgccccaagtgccgctttgagtacaagaggtctgagacccccagccgctactactgctactgtgggaaggtggaggacccccccctggacccctggctggtgccccacagctgtggccaggtgtgtgagcgggagttcaagccaccctgtggccacaagtgcctgctgctgtgccaccctggcccctgccccccctgccccaagatggtgaccaccacctgctactgcaagaaggccaagcccatcccccggcgctgcagcgccaaggagtggagctgccagctgccctgtggccagaagctgctgtgtggccagcacaagtgtgagaacccctgccacgccggcagctgccagccctgcccccgggtgtcccggcagaagtgtgtgtgtgggaagaaggtggccgagaggagctgtgccagccccctgtggcactgtgaccaggtgtgtgggaagaccctgccctgtggcaaccacacctgtgagcaggtgtgccacgtgggcgcctgtggagaatgtcccaggtctgggaagcgcttctgcccctgccagaagagcaagttcagcctgccctgcacagaagatgtgcccacctgtggggacagctgtgacaaggtgctggagtgtggcatccaccgctgcagccagcgctgccaccggggcccctgtgagacctgccggcaggaggtggagaagcactgccgctgtgggaagcacaccaagaggatgccctgccacaagccctacctgtgtgagaccaagtgtgtgaagatgagggactgccagaagcaccagtgcaggaggaagtgctgccccggcaactgccccccctgtgaccagaactgtggccgcaccctgggctgcaggaaccacaagtgccccagcgtgtgccaccggggcagctgctacccctgcccagagaccgtggatgtgaagtgcaactgtggcaacaccaaggtgacagtgccctgtggccgggagaggaccaccaggcctcccaagtgcaaggagcagtgcagcaggcctcccacctgccaccacaccagccaggagaagcaccgctgccacttcggcagctgccccccctgccaccagccctgccagaaggtgctggagaagtgtggccacctgtgcccagccccctgccacgaccaggccctgatcaagcagacaggccgccaccagcccaccggcccctgggagcagcccagcgagcccgccttcatccagacagccctgccctgccccccctgccaggtgcccatccccatggagtgcctgggcaagcatgaggtgagccccctgccctgccacgctgtgggcccctacagctgcaagagggtgtgtggccgcatcctggactgccagaaccacacctgcatgaaggagtgccacaaggtgaccaagacagatggctgcaccgggaagaacaagattggcaagctgaagctgtgtgacctgtccatgatcctgcagcaggagagcagcaagtctgagagcacagtgcctgacctgctgacccccagccccatgtgcagcagcacccacgtgatctag

SEQ ID NO: 36101 - DNA, 2736 bp, Artificial Sequence
  Description of Artificial Sequence: Synthetic coding sequence
atggaggcctcctggaggcaggtggccggcggccggggccgcagccggggccgggccacagctgcccccagcggaaatggagtgcacctgcggggagctgggggcggccgggagaagggctctgtgggcgctgtgcccagcggcaccagccctggaggagtggccaccacagctgctgctggcagccgccacagccctgctggcagccaggccctgcagaccacagctgccagcgagctgatgagccagaagaagtttgaggagatcaagaaggccaaccaggccgccgccaggaagctggtggaggagcagttcagcagcagcagcgaggagggagatgaggactttgagggcaagcagggcaagatcctggccaacaccttcatcacctacaccacccagacagatggagacacccgggagctggagaggaccaagcagtatgtgaatgaggccttccaggccggggccatgacctgcctgatctgcatcgcctctgtgaagaggaaccaggccgtgtggagctgcagcggctgcttctgcatcttccacatgccctgcatccagaagtgggccaaggacagccagttcctggtgtcctctgtgacagatgatgactttgggaagaaggactgcccctggccctgccccaagtgccgctttgagtacaagaggtctgagacccccagccgctactactgctactgtgggaaggtggaggacccccccctggacccctggctggtgccccacagctgtggccaggtgtgtgagcgggagttcaagccaccctgtggccacaagtgcctgctgctgtgccaccctggcccctgccccccctgccccaagatggtgaccaccacctgctactgcaagaaggccaagcccatcccccggcgctgcagcgccaaggagtggagctgccagctgccctgtggccagaagctgctgtgtggccagcacaagtgtgagaacccctgccacgccggcagctgccagccctgcccccgggtgtcccggcagaagtgtgtgtgtgggaagaaggtggccgagaggagctgtgccagccccctgtggcactgtgaccaggtgtgtgggaagaccctgccctgtggcaaccacacctgtgagcaggtgtgccacgtgggcgcctgtggagaatgtcccaggtctgggaagcgcttctgcccctgccagaagagcaagttcagcctgccctgcacagaagatgtgcccacctgtggggacagctgtgacaaggtgctggagtgtggcatccaccgctgcagccagcgctgccaccggggcccctgtgagacctgccggcaggaggtggagaagcactgccgctgtgggaagcacaccaagaggatgccctgccacaagccctacctgtgtgagaccaagtgtgtgaagatgagggactgccagaagcaccagtgcaggaggaagtgctgccccggcaactgccccccctgtgaccagaactgtggccgcaccctgggctgcaggaaccacaagtgccccagcgtgtgccaccggggcagctgctacccctgcccagagaccgtggatgtgaagtgcaactgtggcaacaccaaggtgacagtgccctgtggccgggagaggaccaccaggcctcccaagtgcaaggagcagtgcagcaggcctcccacctgccaccacaccagccaggagaagcaccgctgccacttcggcagctgccccccctgccaccagccctgccagaaggtgctggagaagtgtggccacctgtgcccagccccctgccacgaccaggccctgatcaagcagacaggccgccaccagcccaccggcccctgggagcagcccagcgagcccgccttcatccagacagccctgccctgccccccctgccaggtgcccatccccatggagtgcctgggcaagcatgaggtgagccccctgccctgccacgctgtgggcccctacagctgcaagagggtgtgtggccgcatcctggactgccagaaccacacctgcatgaaggagtgccacaaggtgaccaagacagatggctgcaccgggaagaacaaggccggcccagaatgtctgcactgtgaggagggctgcagcaagagccggcccctgggctgcctgcacccctgcatcctgcgctgccaccctggagaatgtcctccctgtgtgcagatgctgcgcatcaagtgccactgcaagatcaccagcctgtatgtggagtgcaggaagatcaccacagcagatgtgaatgagaagaacctgctgagctgctgcaagaaccagtgccccaaggagctgccctgtggccaccgctgcaaggagatgtgccaccctggagaatgtcccttcaactgcaaccagaaggtgaagctgcgctgcccctgcaagaggatcaagaaggagctgcagtgcaacaaggtgcgggagaaccaggtgtccattgaatgtgacaccacctgcaaggagatgaagaggaaggccagcgagatcaaggaggccgaggccaaggccgccctggaggaggagaagaggcggcagcaggccgagctggaggcctttgaaaatcggctgaagggccgcaggaagaagaacaggaagagagatgaggtggccgtggagctgagcctgtggcagaagcacaagtactacctgatctctgtgtgtggggtggtggtggtggtgtttgcctggtacatcacccatgatgtgaactag

SEQ ID NO: 36102 - DNA, 2736 bp, Artificial Sequence; identical to SEQ ID NO: 36101
  Description of Artificial Sequence: Synthetic coding sequence

SEQ ID NO: 36103 - DNA, 5211 bp, Artificial Sequence
  Description of Artificial Sequence: Synthetic coding sequence
atgacaggctgcccagccagcagcagaagaagaggatttggcctcttcttcttcctgcggctgcaccggctgctgctgctcttcctggtgctgcggggcaccctggccaacaagctgaatgtgccccaggtgctgctgcccttcggccgggagcccggccgggtgcccttcctgctggaggcccagaggggctgctacacctggcacagcacccaccatgatgctgtgacagtggagcccctgtatgaaaatggcaccctgtgcagccagaaggctgtgctgattgctgagagcacccagcccatccggctgagcagcatcatcctggcccgggagatcgtgacagaccacgagctgcgctgtgatgtgaaggtggatgtgatcaacagcattgaaattgtgtcccgggcccgggagctgtatgtggatgacagccccctggagctgatggtgcgggccctggatgctgagggcaacaccttcagcagcctggccggcatgatgtttgagtggagcatcgcccaggacaatgaaagtgcccgggaggagctgagcagcaagatccgcatcctgaagtacagcgaggccgagtatgccccacccatctacatcgccgagatggagaaggaggagaagcagggagatgtgatcctggtgtctggcatcagaactggagctgctgtggtgaaggtgcgcatccacgagcccttctacaagaaggtggccgccgccctgatccggctgctggtgctggagaacatcttcctgatccccagccatgacatctacctgctggtgggcacctacatcaagtaccaggtggccaagatggtgcagggccgggtgacagaggtgaagttccccctggagcactacatcctggagctgcaggaccaccgggtggccctgaatggcagccacagcgagaaggtggccatcctggatgacaagacagccatggtgacagccagccagctgggccagaccaacctggtgtttgtgcacaagaatgtgcacatgaggtctgtgtctggcctgcccaactgcaccatctacgtggtggagcccggcttcctgggcttcaccgtgcagcccggcaaccgctggagcctggaggtgggccaggtgtatgtgatcaccgtggatgtgtttgacaagagcagcaccaaggtgtacatcagtgacaacctgcgcatcacctatgacttccccaaggagtactttgaggagcagctgaccaccgtgaatggcagctaccacatcgtgaaggccctgaaggatggagtggtggtgatcaatgccagcctgaccagcatcatctaccagaacaaggacatccagcccatcaagttcctgatcaagcaccagcaggaggtgaagatctacttccccatcatgctgacccccaagttcctggccttcccccaccaccccatgggcatgctgtaccgctacaaggtgcaggtggagggcggcagcggcaacttcacctggaccagcagcaatgagaccgtggtgattgtgaccaccaagggcgtggtgacagctggccaggtgcggggcaacagcacagtgctggccagagatgtgcagaaccccttccgctacggggagatcaagatccacgtgctgaagctgaacaagatggagctgctgcccttccacgcagatgtggagatcggccagatcatcgagatccccatcgccatgtaccacatcaacaaggagaccaaggaggccatggccttcacagactgcagccacctgagcctggacctgaacatggacaagcagggcgtcttcaccctgctgaaggagggcatccagaggcctggccccatgcactgcagcagcacccacatcgccgccaagagcctgggccacaccctggtgacagtgtctgtgaatgaatgtgacaagtacctggagagcagcgccacctttgctgcctatgagcccctgaaggccctgaaccctgtggaggtggccctggtgacctggcagagcgtgaaggagatggtgtttgaaggaggcccccggccctggatcctggagcccagccgcttcttcctggagctgaatgctgagaagacagagaagattggaattgcccaggtgtggctgcccagcaagaggaagcagaaccagtacatctaccgcatccagtgcctggacctgggggagcaggtgctgaccttcagaattggcaaccaccctggggtgctgaaccccagccctgctgtggaggtgctgcaggtgcgcttcatctgtgcccacccagcctccatgtctgtgacccctgtgtacaaggtgcctgctggggcccagccctgccccctgccccagcacaacaagtggctgatccctgtgtcccggctgcgggacacagtgctggagctggccgtgtttgaccagcacaggaggaagtttgacaacttcagcagcctgatgctggagtggaagagcagcaatgagaccctggcccactttgaggactacaagtctgtggagatggtggccaaggatgatggcagcggccagacccggctgcacggccaccagatcctgaaggtgcaccagatcaagggcaccgtgctgattggagtgaactttgtgggctacagcgagaagaagagccccaaggagatcagcaacctgcccaggtctgtggatgtggagctgctgctggtggatgatgtgacagtggtgcctgaaaatgccaccatctacaaccacccagatgtgaaggagaccttcagcctggtggagggcagcggctacttcctggtgaacagcagcgagcagggcgtggtgaccatcacctacatggaggccgagagctctgtggagctggtgcccctgcaccctggcttcttcaccctggaggtgtatgacctgtgcctggccttcctgggccctgccacagcccacctgcgggtgtctgacatccaggagctggagctggacctgattgacaaggtggagattgacaagacagtgctggtgacagtgcgggtgctgggcagcagcaagaggcccttccagaacaagtacttcaggaacatggagctgaagctgcagctggccagcgccatcgtgaccctgacccccatggagcagcaggatgagtacagcgagaactacatcctgcgggccaccaccatcggccagaccaccctggtggccatcgccaaggacaagatgggcaggaagtacaccagcacccccaggcacatcgaggtgtttcctcccttccggctgctgcctgagaagatgaccctcatccccatgaacatgatgcaggtgatgtctgagggcggcccccagccccagagcatcgtgcacttcagcatcagcaaccagacagtggccgtggtgaacagaagaggccaggtgacaggcaagatcgtgggcacagctgtggtgcacggcaccatccagacagtgaatgaagatactgggaaggtgattgtgttcagccaggatgaggtgcagatcgaggtggtgcagctgcgggctgtgcgcatcctggccgccgccaccaggctcatcacagccaccaagatgcctgtgtatgtgatgggcgtgaccagcacccagacccccttctccttcagcaatgccaaccctggcctgaccttccactggagcatgagcaagagagatgtgctggacctggtgcccaggcacagcgaggtgttcctgcagctgcctgtggagcacaactttgccatggtggtgcacaccaaggccgccggccgcaccagcatcaaggtgacagtgcactgcatgaacagcagcagcggccagtttgagggcaacctgctggagctgagtgatgaggtgcagatcctggtgtttgagaagctgcagctgttctacccagagtgccagcctgagcagatcctgatgcccatcaacagccagctgaagctgcacaccaaccgggagggcgccgcctttgtgagcagccgggtgctgaagtgcttccccaacagcagcgtcatcgaggaggatggagagggcctgctgaaggccggcagcattgctggaacagctgtgctggaggtgaccagcattgagccctttggagtgaaccagaccaccatcactggagtgcaggtggcccctgtgacctacctgcgggtgagcagccagcccaagctgtacacagcccagggccgcaccctgagcgccttccccctgggcatgagcctgaccttcaccgtgcagttctacaacagcatcggggagaagttccacacccacaacacccagctgtacctggccctgaacagagatgacctgctgcacatcggccctggcaacaagaactacacctacatggcccaggccgtgaacagaggcctgaccctggtgggcctgtgggacagaagacaccctggcatggctgactacatccctgtggccgtggagcacgccatcgagccagacaccaagctgacctttgtgggggacatcatctgcttcagcacccacctggtgtcccagcacggggagcccggcatctggatgatcagcgccaacaacatcctgcagacagacatcgtgactggagtgggcgtggcccggagccctggaacagccatgatcttccatgacatccctggggtggtgaagacctaccgggaggtggtggtgaatgccagcagccggctgatgctgtcctatgacctgaagacctacctgaccaacaccctgaacagcacagtgttcaagctgttcatcaccactggaagaaatggagtgaacctgaagggcttctgcacccccaaccaggccctggccatcaccaaggtgctgctgcctgccaccctgatgctgtgccacgtgcagttcagcaacaccctgctggacatcccagccagcaaggtgttccaggtgcacagcgacttctccatggagaaggaccactgtgaagattctgccatcctgaagcgcttcaccggcagctaccagatcctgctgctgaccctgtttgctgtgctggccagcacagccagcatcttcctggcctacaatgccttcctgaacaagatccagacagtgcctgtggtgtatgtgcccaccctgggcaccccccagcccggcttcttcaacagcaccagcagccccccccacttcatgagcctgcagccccccctggcccagagccggctgcagcactggctgtggagcatccgccactag

SEQ ID NO: 36104 - DNA, 2010 bp, Artificial Sequence
  Description of Artificial Sequence: Synthetic coding sequence
atgggcaggaagtacaccagcacccccaggcacatcgaggtgttcccccccttccggctgctgcctgagaagatgaccctcatccccatgaacatgatgcaggtgatgtctgagggcggcccccagccccagagcatcgtgcacttcagcatcagcaaccagacagtggccgtggtgaacagaagaggccaggtgacaggcaagatcgtgggcacagctgtggtgcacggcaccatccagacagtgaatgaagacaccgggaaggtgattgtgttcagccaggatgaggtgcagatcgaggtggtgcagctgcgggctgtgcgcatcctggccgccgccaccaggctcatcacagccaccaagatgcctgtgtatgtgatgggcgtgaccagcacccagacccccttctccttcagcaatgccaaccctggcctgaccttccactggagcatgagcaagagagatgtgctggacctggtgcccaggcacagcgaggtgttcctgcagctgcctgtggagcacaactttgccatggtggtgcacaccaaggctgctggccgcaccagcatcaaggtgacagtgcactgcatgaacagcagcagcggccagtttgagggcaacctgctggagctgagtgatgaggtgcagatcctggtgtttgagaagctgcagctgttctacccagagtgccagcctgagcagatcctgatgcccatcaacagccagctgaagctgcacaccaaccgggagggcgccgcctttgtgagcagccgggtgctgaagtgcttccccaacagctctgtgattgaagaagatggagagggcctgctgaaggccggcagcattgctggaacagctgtgctggaggtgaccagcattgagcccttcggcgtgaaccagaccaccatcaccggggtgcaggtggcccctgtgacctacctgcgggtgagcagccagcccaagctgtacacagcccagggccgcaccctgagcgccttccccctgggcatgagcctgaccttcaccgtgcagttctacaacagcattggagagaagttccacacccacaacacccagctgtacctggccctgaacagagatgacctgctgcacatcggccctggcaacaagaactacacctacatggcccaggccgtgaacagaggcctgaccctggtgggcctgtgggaccggcggcaccctggcatggctgactacatccctgtggccgtggagcacgccattgaaccagacaccaagctgacctttgtgggggacatcatctgcttcagcacccacctggtgtcccagcacggggagcccggcatctggatgatcagcgccaacaacatcctgcagacagacatcgtgactggagtgggcgtggcccggagccctggaacagccatgatcttccatgacatccctggggtggtgaagacctaccgggaggtggtggtgaatgccagcagccggctgatgctgtcctatgacctgaagacctacctgaccaacaccctgaacagcaccgtcttcaagctgttcatcaccaccggcagaaatggagtgaacctgaagggcttctgcacccccaaccaggccctggccatcaccaaggtgctgctgcctgccaccctgatgctgtgccacgtgcagttcagcaacaccctgctggacatcccagccagcaaggtgttccaggtgcacagcgacttctccatggagaaggaccactgtgaggacagcgccatcctgaagcgcttcaccggcagctaccagatcctgctgctgaccctgtttgctgtgctggccagcacagccagcatcttcctggcctacaatgccttcctgaacaagatccagacagtgcctgtggtgtatgtgcccaccctgggcaccccccagcccggcttcttcaacagcaccagcagccccccccacttcatgagcctgcagccccccctggcccagagccggctgcagcactggctgtggagcatccgccactag

SEQ ID NO: 36105 - DNA, 5667 bp, Artificial Sequence
  Description of Artificial Sequence: Synthetic coding sequence
atgacaggctgcccagccagcagcagaagaagaggatttggcctcttcttcttcctgcggctgcaccggctgctgctgctcttcctggtgctgcggggcaccctggccaacaagctgaatgtgccccaggtgctgctgcccttcggccgggagcccggccgggtgcccttcctgctggaggcccagaggggctgctacacctggcacagcacccaccatgatgctgtgacagtggagcccctgtatgaaaatggcaccctgtgcagccagaaggctgtgctgattgctgagagcacccagcccatccggctgagcagcatcatcctggcccgggagatcgtgacagaccacgagctgcgctgtgatgtgaaggtggatgtgatcaacagcattgaaattgtgtcccgggcccgggagctgtatgtggatgacagccccctggagctgatggtgcgggccctggatgctgagggcaacaccttcagcagcctggccggcatgatgtttgagtggagcatcgcccaggacaatgaaagtgcccgggaggagctgagcagcaagatccgcatcctgaagtacagcgaggccgagtatgccccacccatctacatcgccgagatggagaaggaggagaagcagggagatgtgatcctggtgtctggcatcagaactggagctgctgtggtgaaggtgcgcatccacgagcccttctacaagaaggtggccgccgccctgatccggctgctggtgctggagaacatcttcctgatccccagccatgacatctacctgctggtgggcacctacatcaagtaccaggtggccaagatggtgcagggccgggtgacagaggtgaagttccccctggagcactacatcctggagctgcaggaccaccgggtggccctgaatggcagccacagcgagaaggtggccatcctggatgacaagacagccatggtgacagccagccagctgggccagaccaacctggtgtttgtgcacaagaatgtgcacatgaggtctgtgtctggcctgcccaactgcaccatctacgtggtggagcccggcttcctgggcttcaccgtgcagcccggcaaccgctggagcctggaggtgggccaggtgtatgtgatcaccgtggatgtgtttgacaagagcagcaccaaggtgtacatcagtgacaacctgcgcatcacctatgacttccccaaggagtactttgaggagcagctgaccaccgtgaatggcagctaccacatcgtgaaggccctgaaggatggagtggtggtgatcaatgccagcctgaccagcatcatctaccagaacaaggacatccagcccatcaagttcctgatcaagcaccagcaggaggtgaagatctacttccccatcatgctgacccccaagttcctggccttcccccaccaccccatgggcatgctgtaccgctacaaggtgcaggtggagggcggcagcggcaacttcacctggaccagcagcaatgagaccgtggtgattgtgaccaccaagggcgtggtgacagctggccaggtgcggggcaacagcacagtgctggccagagatgtgcagaaccccttccgctacggggagatcaagatccacgtgctgaagctgaacaagatggagctgctgcccttccacgcagatgtggagatcggccagatcatcgagatccccatcgccatgtaccacatcaacaaggagaccaaggaggccatggccttcacagactgcagccacctgagcctggacctgaacatggacaagcagggcgtcttcaccctgctgaaggagggcatccagaggcctggccccatgcactgcagcagcacccacatcgccgccaagagcctgggccacaccctggtgacagtgtctgtgaatgaatgtgacaagtacctggagagcagcgccacctttgctgcctatgagcccctgaaggccctgaaccctgtggaggtggccctggtgacctggcagagcgtgaaggagatggtgtttgaaggaggcccccggccctggatcctggagcccagccgcttcttcctggagctgaatgctgagaagacagagaagattggaattgcccaggtgtggctgcccagcaagaggaagcagaaccagtacatctaccgcatccagtgcctggacctgggggagcaggtgctgaccttcagaattggcaaccaccctggggtgctgaaccccagccctgctgtggaggtgctgcaggtgcgcttcatctgtgcccacccagcctccatgtctgtgacccctgtgtacaaggtgcctgctggggcccagccctgccccctgccccagcacaacaagtggctgatccctgtgtcccggctgcgggacacagtgctggagctggccgtgtttgaccagcacaggaggaagtttgacaacttcagcagcctgatgctggagtggaagagcagcaatgagaccctggcccactttgaggactacaagtctgtggagatggtggccaaggatgatggcagcggccagacccggctgcacggccaccagatcctgaaggtgcaccagatcaagggcaccgtgctgattggagtgaactttgtgggctacagcgagaagaagagccccaaggagatcagcaacctgcccaggtctgtggatgtggagctgctgctggtggatgatgtgacagtggtgcctgaaaatgccaccatctacaaccacccagatgtgaaggagaccttcagcctggtggagggcagcggctacttcctggtgaacagcagcgagcagggcgtggtgaccatcacctacatggaggccgagagctctgtggagctggtgcccctgcaccctggcttcttcaccctggaggtgtatgacctgtgcctggccttcctgggccctgccacagcccacctgcgggtgtctgacatccaggagctggagctggacctgattgacaaggtggagattgacaagacagtgctggtgacagtgcgggtgctgggcagcagcaagaggcccttccagaacaagtacttcaggaacatggagctgaagctgcagctggccagcgccatcgtgaccctgacccccatggagcagcaggatgagtacagcgagaactacatcctgcgggccaccaccatcggccagaccaccctggtggccatcgccaaggacaagatgggcaggaagtacaccagcacccccaggcacatcgaggtgtttcctcccttccggctgctgcctgagaagatgaccctcatccccatgaacatgatgcaggtgatgtctgagggcggcccccagccccagagcatcgtgcacttcagcatcagcaaccagacagtggccgtggtgaacagaagaggccaggtgacaggcaagatcgtgggcacagctgtggtgcacggcaccatccagacagtgaatgaagatactgggaaggtgattgtgttcagccaggatgaggtgcagatcgaggtggtgcagctgcgggctgtgcgcatcctggccgccgccaccaggctcatcacagccaccaagatgcctgtgtatgtgatgggcgtgaccagcacccagacccccttctccttcagcaatgccaaccctggcctgaccttccactggagcatgagcaagagagatgtgctggacctggtgcccaggcacagcgaggtgttcctgcagctgcctgtggagcacaactttgccatggtggtgcacaccaaggccgccggccgcaccagcatcaaggtgacagtgcactgcatgaacagcagcagcggccagtttgagggcaacctgctggagctgagtgatgaggtgcagatcctggtgtttgagaagctgcagctgttctacccagagtgccagcctgagcagatcctgatgcccatcaacagccagctgaagctgcacaccaaccgggagggcgccgcctttgtgagcagccgggtgctgaagtgcttccccaacagcagcgtcatcgaggaggatggagagggcctgctgaaggccggcagcattgctggaacagctgtgctggaggtgaccagcattgagccctttggagtgaaccagaccaccatcactggagtgcaggtggcccctgtgacctacctgcgggtgagcagccagcccaagctgtacacagcccagggccgcaccctgagcgccttccccctgggcatgagcctgaccttcaccgtgcagttctacaacagcatcggggagaagttccacacccacaacacccagctgtacctggccctgaacagagatgacctgctgcacatcggccctggcaacaagaactacacctacatggcccaggccgtgaacagaggcctgaccctggtgggcctgtgggacagaagacaccctggcatggctgactacatccctgtggccgtggagcacgccatcgagccagacaccaagctgacctttgtgggggacatcatctgcttcagcacccacctggtgtcccagcacggggagcccggcatctggatgatcagcgccaacaacatcctgcagacagacatcgtgactggagtgggcgtggcccggagccctggaacagccatgatcttccatgacatccctggggtggtgaagacctaccgggaggtggtggtgaatgccagcagccggctgatgctgtcctatgacctgaagacctacctgaccaacaccctgaacagcacagtgttcaagctgttcatcaccactggaagaaatggagtgaacctgaagggcttctgcacccccaaccaggccctggccatcaccaaggtgctgctgcctgccaccctgatgctgtgccacgtgcagttcagcaacaccctgctggacatcccagccagcaaggtgttccaggtgcacagcgacttctccatggagaagggcgtgtatgtgtgcatcatcaaggtgcggccccagagcgaggagctgctgcaggccctgtctgtggccgacacctctgtgtatggctgggccaccctggtgtctgagaggagcaagaatggcatgcagaggatcctgatccccttcatcccagccttctacatcaaccagagcgagctggtgctgagccacaagcaggacattggagagatccgggtgctgggcgtggacagagtgctgaggaagctggaggtgatcagcagcagccctgtgctggtggtggccggccacagccacagccccctgaccccaggcctggccatctacagcgtgcgggtggtgaacttcaccagcttccagcagatggccagccctgtgttcatcaacatcagctgtgtgctgaccagccagagcgaggccgtggtggtgcgggccatgaaggacaagctgggcgctgaccactgtgaagattctgccatcctgaagcgcttcaccggcagctaccagatcctgctgctgaccctgtttgctgtgctggccagcacagccagcatcttcctggcctacaatgccttcctgaacaagatccagacagtgcctgtggtgtatgtgcccaccctgggcaccccccagcccggcttcttcaacagcaccagcagccccccccacttcatgagcctgcagccccccctggcccagagccggctgcagcactggctgtggagcatccgccactag

SEQ ID NO: 36106 - DNA, 639 bp, Artificial Sequence
  Description of Artificial Sequence: Synthetic coding sequence
atggccagcctcttcagcggccgcatcctgatccggaacaacagcgaccaggatgagctggacacagaggccgaggtgtcccggcggctggagaaccggctggtgctgctcttctttggagctggggcctgcccccagtgccaggcctttgtgcccatcctgaaggacttctttgtgcggctgacagatgagttctacgtgctgcgggccgcccagctggccctggtgtatgtgtcccaggacagcacagaggagcagcaggacctcttcctgaaggacatgcccaagaagtggctgttcctgccctttgaagatgacctgcggcgggacctgggccggcagttctctgtggagcggctgcctgctgtggtggtgctgaagccagatggagatgtgctgaccagagatggagcagatgagatccagaggctgggcacagcctgctttgccaactggcaggaggccgctgaggtgctggacaggaacttccagctgcctgaggacctggaggaccaggagcccaggagcctgacagaatgtctgcggcggcacaagtacagagtggagaaggccgcccggggcggccgggaccccggcggcggcggcggggaggagggcggggccggcggcctcttctag

SEQ ID NO: 36107 - DNA, 423 bp, Artificial Sequence
  Description of Artificial Sequence: Synthetic coding sequence
atgctgcctgactgcctgtctgctgagggggagctgcgctgccggcggctgctggccggggccacagcccggctgcgggcccggcctgccagcgctgctgtgctggtgcccctgtgcagcgtgcggggcgtgcctgccctgctgtacaccctgcggagcagccggctgaccggccgccacaagggagatgtgtccttccctgggggcaaatgtgaccctgctgaccaggatgtggtgcacacagccctgcgggagacccgggaggagctgggcctggccgtgcctgaggagcacgtgtggggcctgctgcggcctgtgtatgacccccagaaggccaccgtggtgcctgtgctggccggcgtgggccccctggacccccagagcctgcggcccaacagcgaggaggtgtcctggggcatctag

SEQ ID NO: 36108 - DNA, 711 bp, Artificial Sequence
  Description of Artificial Sequence: Synthetic coding sequence
atgctgcctgactgcctgtctgctgagggggagctgcgctgccggcggctgctggccggggccacagcccggctgcgggcccggcctgccagcgctgctgtgctggtgcccctgtgcagcgtgcggggcgtgcctgccctgctgtacaccctgcggagcagccggctgaccggccgccacaagggagatgtgtccttccctgggggcaaatgtgaccctgctgaccaggatgtggtgcacacagccctgcgggagacccgggaggagctgggcctggccgtgcctgaggagcacgtgtggggcctgctgcggcctgtgtatgacccccagaaggccaccgtggtgcctgtgctggccggcgtgggccccctggacccccagagcctgcggcccaacagcgaggaggtggatgaggtgtttgccctgcccctggcccacctgctgcagacccagaaccagggctacacccacttctgccggggcggccacttccgctacaccctgcctgtgttcctgcacggcccccaccgggtgtggggcctgacagctgtgatcacagaatttgccctgcagctgctggcccctggcacctaccagccccggctggccggcctgacctgcagcggggctgagggcctggcccggcccaagcagcccctggccagcccctgccaggccagcagcaccccaggcctgaacaagggcctgtag

SEQ ID NO: 36109 - DNA, 1053 bp, Artificial Sequence
  Description of Artificial Sequence: Synthetic coding sequence
atggccggccgcctgctgggcaaggccctggccgctgtgtccctgagcctggccctggcctctgtgaccatccgcagcagccgctgccggggcatccaggccttcaggaacagcttcagcagctcctggttccacctgaacaccaacgtgatgagcggcagcaatggcagcaaagaaaacagccacaacaaggcccggaccagcccctacccaggcagcaaggtggagaggagccaggtgcccaatgagaaggtgggctggctggtggagtggcaggactacaagcctgtggagtacacagctgtgtctgtgctggccggcccccgctgggccgacccccagatcagcgagagcaacttcagccccaagttcaatgagaaggatggccacgtggagaggaagagcaagaatggcctgtatgaaattgaaaatggccggcccaggaacccagctggccgcacaggcctggtgggccggggcctgctgggccgctggggccccaaccacgccgctgaccccatcatcacccgctggaagagggacagcagcggcaacaagatcatgcaccctgtgtctgggaagcacatcctgcagtttgtggccatcaagaggaaggactgtggggagtgggccatccctgggggcatggtggaccctggagagaagatcagcgccaccctgaagcgggagtttggagaggaggccctgaacagcctgcagaagaccagcgctgagaagcgggagattgaggagaagctgcacaagctgttcagccaggaccacctggtgatctacaagggctacgtggatgaccccaggaacacagacaatgcctggatggagacagaggccgtgaactaccatgatgaaacaggagagatcatggacaacctgatgctggaggccggagatgatgctgggaaggtgaagtgggtggacatcaatgacaagctgaagctgtatgccagccacagccagttcatcaagctggtggccgagaagagagatgcccactggagcgaagattctgaggccgactgccacgccctgtag

SEQ ID NO: 36110 - DNA, 903 bp, Artificial Sequence
  Description of Artificial Sequence: Synthetic coding sequence
atgagcggcagcaatggcagcaaagaaaacagccacaacaaggcccggaccagcccctacccaggcagcaaggtggagaggagccaggtgcccaatgagaaggtgggctggctggtggagtggcaggactacaagcctgtggagtacacagctgtgtctgtgctggccggcccccgctgggccgacccccagatcagcgagagcaacttcagccccaagttcaatgagaaggatggccacgtggagaggaagagcaagaatggcctgtatgaaattgaaaatggccggcccaggaacccagctggccgcacaggcctggtgggccggggcctgctgggccgctggggccccaaccacgccgctgaccccatcatcacccgctggaagagggacagcagcggcaacaagatcatgcaccctgtgtctgggaagcacatcctgcagtttgtggccatcaagaggaaggactgtggggagtgggccatccctgggggcatggtggaccctggagagaagatcagcgccaccctgaagcgggagtttggagaggaggccctgaacagcctgcagaagaccagcgctgagaagcgggagattgaggagaagctgcacaagctgttcagccaggaccacctggtgatctacaagggctacgtggatgaccccaggaacacagacaatgcctggatggagacagaggccgtgaactaccatgatgaaacaggagagatcatggacaacctgatgctggaggccggagatgatgctgggaaggtgaagtgggtggacatcaatgacaagctgaagctgtatgccagccacagccagttcatcaagctggtggccgagaagagagatgcccactggagcgaagattctgaggccgactgccacgccctgtag

SEQ ID NO: 36111 - DNA, 621 bp, Artificial Sequence
  Description of Artificial Sequence: Synthetic coding sequence
atgagcggcagcaatggcagcaaagaaaacagccacaacaaggcccggaccagcccctacccaggcagcaaggtggagaggagccaggtgcccaatgagaaggtgggctggctggtggagtggcaggactacaagcctgtggagtacacagctgtgtctgtgctggccggcccccgctgggccgacccccagatcagcgagagcaacttcagccccaagttcaatgagaaggatggccacgtggagaggaagagcaagaatggcctgtatgaaattgaaaatggccggcccaggaacccagctggccgcacaggcctggtgggccggggcctgctgggccgctggggccccaaccacgccgctgaccccatcatcacccgctggaagagggacagcagcggcaacaagatcatgcaccctgtgtctgggaagcacatcctgcagtttgtggccatcaagaggaaggactgtggggagtgggccatccctgggggcatggtggaccctggagagaagatcagcgccaccctgaagcgggagtttggagaggaggccctgaacagcctgcagaagaccagcgctgagaagcgggagattgaggagaagctgcacaagctgtag

SEQ ID NO: 36112 - DNA, 789 bp, Artificial Sequence
  Description of Artificial Sequence: Synthetic coding sequence
atggccccagccctgctgctgatcccagctgccctggccagcttcatcctggcctttggaactggagtggagtttgtgcgcttcaccagcctgcggcccctgctgggcggcatccctgagagcggcggcccagatgcccggcagggctggctggccgccctgcaggacaggagcatcctggcccccctggcctgggacctgggcctgctgctgctgtttgtgggccagcacagcctgatggctgctgagcgggtgaaggcctggaccagccgctactttggagtgctgcagaggagcctgtatgtggcctgcacagccctggccctgcagctggtgatgagatactgggagcccatccccaagggccctgtgctgtgggaggcccgggcagagccctgggccacctgggtgcccctgctgtgctttgtgctgcacgtgatctcctggctgctgatcttcagcatcctgctggtgtttgattatgcagagctgatgggcctgaagcaggtgtactaccacgtgctgggcctgggggagcccctggccctgaagagcccccgggccctgcggctcttcagccacctgcggcaccctgtgtgtgtggagctgctgactgtgctgtgggtggtgcccaccctgggcacagaccggctgctgctggccttcctgctgaccctgtacctgggcctggcccacggcctggaccagcaggacctgcgctacctgcgggcccagctgcagaggaagctgcacctgctgagccggccccaggatggagaggccgagtag

SEQ ID NO: 36113 - DNA, 612 bp, Artificial Sequence
  Description of Artificial Sequence: Synthetic coding sequence
atggccccagccctgctgctgatcccagctgccctggccagcttcatcctggcctttggaactggagtggagtttgtgcgcttcaccagcctgcggcccctgctgggcggcatccctgagagcggcggcccagatgcccggcagggctggctggccgccctgcaggacaggagcatcctggcccccctggcctgggacctgggcctgctgctgctgtttgtgggccagcacagcctgatggctgctgagcgggtgaaggcctggaccagccgctactttggagtgctgcagaggagcctgtatgtggcctgcacagccctggccctgcaggtgtactaccacgtgctgggcctgggggagcccctggccctgaagagcccccgggccctgcggctcttcagccacctgcggcaccctgtgtgtgtggagctgctgactgtgctgtgggtggtgcccaccctgggcacagaccggctgctgctggccttcctgctgaccctgtacctgggcctggcccacggcctggaccagcaggacctgcgctacctgcgggcccagctgcagaggaagctgcacctgctgagccggccccaggatggagaggccgagtag

SEQ ID NO: 36114 - DNA, 789 bp, Artificial Sequence; identical to SEQ ID NO: 36112
  Description of Artificial Sequence: Synthetic coding sequence

SEQ ID NO: 36115 - DNA, 612 bp, Artificial Sequence; identical to SEQ ID NO: 36113
  Description of Artificial Sequence: Synthetic coding sequence

SEQ ID NO: 36116 - DNA, 789 bp, Artificial Sequence; identical to SEQ ID NO: 36112
  Description of Artificial Sequence: Synthetic coding sequence

SEQ ID NO: 36117 - DNA, 789 bp, Artificial Sequence
  Description of Artificial Sequence: Synthetic coding sequence
tgagaaagtggccgggaggccaccggggagggggacctgagcagcaagctgggcacccagggcctggagttctggaggggcggccgggtgaggacagagggcgctgagaagggcggggacaggagcatcctgaatgcccggcagggctggctggccgccctgcaggacaggagcatcctggcccccctggcctgggacctgggcctgctgctgctgtttgtgggccagcacagcctgatggctgctgagcgggtgaaggcctggaccagccgctactttggagtgctgcagaggagcctgtatgtggcctgcacagccctggccctgcagctggtgatgagatactgggagcccatccccaagggccctgtgctgtgggaggcccgggcagagccctgggccacctgggtgcccctgctgtgctttgtgctgcacgtgatctcctggctgctgatcttcagcatcctgctggtgtttgattatgcagagctgatgggcctgaagcaggtgtactaccacgtgctgggcctgggggagcccctggccctgaagagcccccgggccctgcggctcttcagccacctgcggcaccctgtgtgtgtggagctgctgactgtgctgtgggtggtgcccaccctgggcacagaccggctgctgctggccttcctgctgaccctgtacctgggcctggcccacggcctggaccagcaggacctgcgctacctgcgggcccagctgcagaggaagctgcacctgctgagccggccccaggatggagaggccgagtag

SEQ ID NO: 36118 - DNA, 789 bp, Artificial Sequence; identical to SEQ ID NO: 36112
  Description of Artificial Sequence: Synthetic coding sequence

SEQ ID NO: 36119 - DNA, 612 bp, Artificial Sequence; identical to SEQ ID NO: 36113
  Description of Artificial Sequence: Synthetic coding sequence

SEQ ID NO: 36120 - DNA, 789 bp, Artificial Sequence; identical to SEQ ID NO: 36112
  Description of Artificial Sequence: Synthetic coding sequence

SEQ ID NO: 36121 - DNA, 789 bp, Artificial Sequence; identical to SEQ ID NO: 36112
  Description of Artificial Sequence: Synthetic coding sequence

SEQ ID NO: 36122 - DNA, 789 bp, Artificial Sequence; identical to SEQ ID NO: 36117
  Description of Artificial Sequence: Synthetic coding sequence

SEQ ID NO: 36123 - DNA, 789 bp, Artificial Sequence; identical to SEQ ID NO: 36112
  Description of Artificial Sequence: Synthetic coding sequence

SEQ ID NO: 36124 - DNA, 789 bp, Artificial Sequence; identical to SEQ ID NO: 36117
  Description of Artificial Sequence: Synthetic coding sequence

SEQ ID NO: 36125 - DNA, 789 bp, Artificial Sequence; identical to SEQ ID NO: 36117
  Description of Artificial Sequence: Synthetic coding sequence

SEQ ID NO: 36126 - DNA, 789 bp, Artificial Sequence; identical to SEQ ID NO: 36112
  Description of Artificial Sequence: Synthetic coding sequence

SEQ ID NO: 36127 - DNA, 789 bp, Artificial Sequence; identical to SEQ ID NO: 36117
  Description of Artificial Sequence: Synthetic coding sequence

SEQ ID NO: 36128 - DNA, 789 bp, Artificial Sequence; identical to SEQ ID NO: 36117
  Description of Artificial Sequence: Synthetic coding sequence

SEQ ID NO: 36129 - DNA, 612 bp, Artificial Sequence; identical to SEQ ID NO: 36113
  Description of Artificial Sequence: Synthetic coding sequence

SEQ ID NO: 36130 - DNA, 789 bp, Artificial Sequence; identical to SEQ ID NO: 36117
  Description of Artificial Sequence: Synthetic coding sequence

SEQ ID NO: 36131 - DNA, 612 bp, Artificial Sequence; identical to SEQ ID NO: 36113
  Description of Artificial Sequence: Synthetic coding sequence

SEQ ID NO: 36132 - DNA, 612 bp, Artificial Sequence; identical to SEQ ID NO: 36113
  Description of Artificial Sequence: Synthetic coding sequence

SEQ ID NO: 36133 - DNA, 612 bp, Artificial Sequence; identical to SEQ ID NO: 36113
  Description of Artificial Sequence: Synthetic coding sequence

SEQ ID NO: 36134 - DNA, 750 bp, Artificial Sequence
  Description of Artificial Sequence: Synthetic coding sequence
atggccatgctgcgggtgcagcctgaggcccaggccaaggtggatgtgttccgggaggacctgtgcaccaagacagagaacctgctgggcagctacttccccaagaagatcagcgagctggatgccttcctgaaggagcccgccctgaatgaggccaacctgagcaacctgaaggcccccctggacatccctgtgcctgaccctgtgaaggagaaggagaaggaggagaggaagaagcagcaggagaaggaggacaaggatgagaagaagaagggagaagatgaagataaaggaccaccctgtggccctgtgaactgcaatgagaagatcgtggtgctgctgcagaggctgaagccagagatcaaggatgtgattgagcagctgaacctggtgaccacctggctgcagctgcagatccccagaattgaagatggcaacaactttggagtggccgtgcaggagaaggtgtttgagctgatgaccagcctgcacaccaagctggagggcttccacacccagatcagcaagtacttcagcgagagaggagatgctgtgaccaaggccgccaagcagccccacgtgggggactaccggcagctggtgcatgagctggatgaagctgagtacagagacatccggctgatggtgatggagatcagaaatgcctatgctgtgctgtatgacatcatcctgaagaactttgagaagctgaagaagcccagaggagagaccaagggcatgatctactag

SEQ ID NO: 36135 - DNA, 5697 bp, Artificial Sequence
  Description of Artificial Sequence: Synthetic coding sequence
atgctgctgagcggcggggaccccccagcccaggagtggttcatggtgcagaccaagagcaagccccgggtgcagaggcagaggctgcaggtgcagaggatcttccgggtgaagctgaatgccttccagagcaggccagacaccccctacttctggctgcagctggagggcccccgggagaacatgggcaaggccaaggagtacctgaagggcctgtgcagccctgagctgtggaaggaggtgcgctacccacccatcctgcactgtgccttcctgggcgcccagggcctcttcctggactgcctgtgctggagcaccctggcctacctggtgcccggccccccaggcagcctgatggtgggcggcctgacagagagcttcatcatgacccagaactggctggaggagctggtgggccgcctgcgctggggccctgcccccctgctgaccccccggggcatctgggaggccgaggtgacccgggcctttggagccctggtgtggatccggggggaccagcacgccggggacctgctgcagctgcccccagctgtgcaggagctgctgctgagcctggtgagagatgctgctgggaaggaggacatcatcgagtggctgagcagatttggcatcagtgacagccacagcgaccctgaggtgctgatctgccccccccagcagcagaaggaggccccagccatggtgtctgtgggggagagccctggcccctttgtggacatgggcaccctgcagaacagaggccctgagaacagcaagaggctgagcagcctgggcgccaccggcagcctcatcacagcccagagcaccccccaggaggccgccaaccagctggtgcgggtgggcagcaacaaccaggacggcatggattctgcccaggaggagggcaccgtgcaggccaccagcagccaggacagcaccaaccacacccaggccctgctgaagcagaggcaggtgcagaagattgaggacaagctgctcttccagccccctgtgtctgccctgggcgtgtgccccccctggaaggcctggaccccaggccctgccttcggccccctgtggccaggggccatcgccgccaccttctggaggatcaatgagctgcacagcctgcacctggcctggctgctgagccaggcctgcttcaacttccccttctggcagaggcccctgggccccatccagctgaagctgcccggccagaaccccctgcccctgaacctggagtggaagcagaaggagctggcccccctgcccagcgctgagagccctgctggccgcccagatggcggcctgggcggggaggccgccctgcagaactgccccaggcctgagatcagccccaaggtgaccagcctgctggtggtgcccggcagcagtgatgtgaaggacaaggtgtccagtgacctgccccagatcggcccccccctgaccagcaccccccagctgcaggccggcggggagcccggggaccagggctccatgcagctggacttcaagggcctggaggagggccctgcccctgtgctgcccaccggccagggcaagcctgtggcccagggcggcctgacagaccagagcgtgcctggggcccagacagtgcctgagaccctgaaggtgcccatggctgctgctgtgcccaaggccgagaaccccagcaggacccaggtgcccagcgctgcccccaagctgcccaccagcaggatgatgctggccgtgcacacagagcctgctgcccctgaggtgcccctggcccccaccaagcccacagcccagctgatggccacagcccagaagacagtggtgaaccagcctgtgctggtggcccaggtggagcccaccacccccaagaccccccaggcccagaagatgcctgtggccaagaccagccctgctggccccaagacccccaaggcccaggccggccctgctgccaccgtgtccaaggccccagctgccagcaaggccccagctgcccccaaggtgcctgtgaccccccgggtgtcccgggcccccaagaccccagctgcccagaaggtgcccacagatgctggccccaccctggatgtggcccggctgctgtctgaggtgcagcccaccagccgggcctctgtgtccctgctgaagggccagggccaggccggccggcagggcccccagagcagcggcaccctggccctgagcagcaagcaccagttccagatggagggcctgctgggcgcctgggagggcgccccccggcagcccccaagacacctgcaggccaacagcacagtgaccagcttccagcgctaccacgaggccctgaacaccccatttgagctgaacctgagcggggagcccggcaaccagggcctgcggcgggtggtgattgatggcagctctgtggccatggtgcacggcctgcagcacttcttcagctgccggggcatcgccatggctgtgcagttcttctggaacagaggccaccgggaggtgacagtgtttgtgcccacctggcagctgaagaagaacagaagagtgcgggagagccacttcctgaccaagctgcacagcctgaagatgctgagcatcacccccagccagctggagaatggcaagaagatcaccacctatgactaccgcttcatggtgaagctggccgaggagacagatggcatcatcgtgaccaatgagcagatccacatcctgatgaacagcagcaagaagctgatggtgaaggaccggctgctgcccttcacctttgctggcaacctcttcatggtgcctgatgaccccctgggcagagatggccccaccctggatgagttcctgaagaagcccaaccggctggacacagacatcggcaacttcctgaaggtgtggaagaccctgccccccagcagcgcctctgtgacagagctgagtgatgatgctgacagcggccccctggagagcctgcccaacatggaggaggtgcgggaggagaaggaggagcggcaggatgaggagcagaggcagggccagggcacccagaaggctgctgaggaggatgacctggacagcagcctggcctctgtgttccgggtggagtgccccagcctgtctgaggagatcctgcgctgcctgagcctgcatgaccccccagatggagccctggacatcgacctgctgcccggggccgccagcccctacctgggcatcccctgggatggcaaggccccctgccagcaggtgctggcccacctggcccagctgaccatccccagcaacttcaccgccctgtccttcttcatgggcttcatggacagccacagagatgccatcccagactatgaggccctggtgggccccctgcacagcctgctgaagcagaagccagactggcagtgggaccaggagcacgaggaggccttcctggccctgaagagggccctggtgtctgccctgtgcctgatggcccccaacagccagctgcccttccggctggaggtgacagtgagccacgtggccctgacagccatcctgcaccaggagcacagcggcaggaagcaccccatcgcctacaccagcaagcccctgctgcctgatgaggagagccagggcccccagagcggcggggacagcccctatgctgtggcctgggccctgaagcacttcagccgctgcattggagacacccctgtggtgctggacctgtcctatgccagcaggaccacagctgaccctgaggtgcgggagggccggcgggtgtccaaggcctggctgatccgctggagcctgctggtgcaggacaagggcaagagggccctggagctggccctgctgcagggcctgctgggagaaaatcggctgctgaccccagctgcctccatgccccgcttcttccaggtgctgccccccttcagtgacctgagcacctttgtgtgcatccacatgagcggctactgcttctaccgggaggatgagtggtgtgccggcttcggcctgtatgtgctgagccccaccagcccccctgtgtccctgtccttcagctgcagcccctacacccccacctacgcccacctggccgctgtggcctgtggcctggagagatttggccagagccccctgcctgtggtgttcctgacccactgcaactggatcttcagcctgctgtgggagctgctgcccctgtggagggcccggggcttcctgagcagtgatggagcccccctgccccaccccagcctgctgagctacatcatcagcctgaccagcggcctgagcagcctgcccttcatctaccgcaccagctaccggggcagcctgtttgctgtgacagtggacaccctggccaagcagggcgcccagggcggcggccagtggtggagcctgcccaaggatgtgcctgcccccaccgtgagcccccacgccatgggcaagaggcccaacctgctggccctgcagctgagtgacagcaccctggccgacatcatcgcccggctgcaggccggccagaagctgagcggcagcagccccttcagcagcgccttcaacagcctgagcctggacaaggagagcggcctgctgatgttcaagggggacaagaagccccgggtgtgggtggtgcccacccagctgcggcgggacctgatcttctctgtgcatgacatccccctgggcgcccaccagaggcctgaggagacctacaagaagctgcggctgctgggctggtggccaggcatgcaggagcacgtgaaggactactgccgcagctgcctcttctgcatccccaggaacctgattggcagcgagctgaaggtgattgagagcccctggcccctgcggagcacagccccctggagcaacctgcagatcgaggtggtgggccctgtgaccatcagcgaggagggccacaagcacgtgctgattgtggccgaccccaacacccgctgggtggaggccttccccctgaagccctacacccacacagctgtggcccaggtgctgctgcagcacgtgtttgcccgctggggcgtgcctgtgcggctggaggccgcccagggcccccagtttgcccggcacgtgctggtgtcctgtggcctggccctgggcgcccaggtggccagcctgagccgggacctgcagttcccctgcctgaccagcagcggggcctactgggagttcaagagggccctgaaggagttcatcttcctgcacggcaagaagtgggccgccagcctgcccctgctgcacctggccttccgggccagcagcacagatgccacccccttcaaggtgctgaccggcggggagagccggctgacagagcccctgtggtgggagatgagcagcgccaacatcgagggcctgaagatggatgtgttcctgctgcagctggtgggggagctgctggagctgcactggagggtggccgacaaggccagcgagaaggcagaaaatcgccgcttcaagcgggagagccaggagaaggagtggaatgtgggggaccaggtgctgctgctgagcctgcccagaaatggcagcagcgccaagtgggtgggccccttctacatcggggaccggctgagcctgagcctgtaccgcatctggggcttccccaccccagagaagctgggctgcatctaccccagcagcctgatgaaggcctttgccaagagcggcacccccctgtccttcaaggtgctggagcagtag

SEQ ID NO: 36136 - DNA, 7797 bp, Artificial Sequence
  Description of Artificial Sequence: Synthetic coding sequence
ggccggcccatcccccccaccagcagccccagcctgctgcccagcgcccagctgcccagcagccacaaccccccacctgtgtcctgccagatgcccctgctggacagcaacaccagccaccagatcatggacaccaacccagatgaggagttcagccccaacagctacctgctgcgggcctgcagcggcccccagcaggccagcagcagcggcccccccaaccaccacagccagagcaccctgcggccccccctgcccccaccccacaaccacaccctgagccaccaccacagcagcgccaacagcctgaacagaaacagcctgaccaacagaagaagccagatccacgccccagccccagccccaaatgacctggccaccaccccagagagcgtgcagctgcaggacagctgggtgctgaacagcaatgtgcccctggagaccaggcacttcctgttcaagaccagcagcggcagcacccccctcttcagcagcagcagccctggctaccccctgaccagcggcaccgtgtacaccccaccaccccggctgctgcccaggaacaccttcagcaggaaggccttcaagctgaagaagcccagcaagtactgctcctggaagtgtgccgccctgagcgccatcgccgccgccctgctgctggccatcctgctggcctacttcatcgccatgcacctgctgggcctgaactggcagctgcagcctgcagatggccacaccttcaacaacggcatcagaacaggcctgcctggaaatgatgatgtggccaccatgcccagcggcggcaaggtgccctggagcctgaagaacagcagcattgattctggagaggccgaggtgggccggcgggtgacccaggaggtgcccccaggagtcttctggaggagccagatccacatcagccagccccagttcctgaagttcaacatcagcctgggcaaggatgccctgtttggagtgtacatcagaagaggcctgccccccagccacgcccagtatgacttcatggagcggctggatggcaaggagaagtggagcgtggtggagagcccccgggagcggcgcagcatccagaccctggtgcagaatgaagctgtgtttgtgcagtacctggatgtgggcctgtggcacctggccttctacaatgatggcaaggacaaggagatggtgtccttcaacacagtggtgctggacagcgtgcaggactgccccaggaactgccacggcaatggagaatgtgtgtctggagtgtgccactgcttccctggcttcctgggcgctgactgtgccaaggccgcctgccctgtgctgtgcagcggaaatggccagtacagcaagggcacctgccagtgctacagcggctggaagggagcagaatgtgatgtgcccatgaaccagtgcatcgaccccagctgtggcggccacggcagctgcattgatggcaactgtgtgtgcagcgctggctacaagggggagcactgtgaggaggtggactgcctggaccccacctgcagcagccatggagtgtgtgtgaatggagagtgcctgtgcagccctggctggggcggcctgaactgtgagctggcccgggtgcagtgcccagaccagtgcagcggccacggcacctacctgcctgacaccggcctgtgcagctgtgaccccaactggatgggccctgactgcagcgtggaggtgtgcagcgtggactgtggcacccatggagtgtgcattggaggagcctgccgctgtgaggagggctggacaggagctgcctgtgaccagagggtgtgccacccccgctgcatcgagcacggcacctgcaaggatggaaaatgtgaatgtcgggagggctggaatggagagcactgcaccattgatggctgcccagacctgtgcaatggaaatggccgctgcaccctgggccagaacagctggcagtgtgtgtgccagacaggctggaggggccctggctgcaatgtggccatggagaccagctgtgccgacaacaaggacaatgaaggagatggcctggtggactgcctggaccctgactgctgcctgcagagcgcctgccagaacagcctgctgtgccggggcagccgggaccccctggacatcatccagcagggccagacagactggccagctgtgaagagcttctatgaccgcatcaagctgctggccggcaaggacagcacccacatcatccctggagagaaccccttcaacagcagcctggtgtccctcatccggggccaggtggtgaccacagatggcacccccctggtgggcgtgaatgtgtcctttgtgaagtaccccaagtatggctacaccatcacccggcaggacggcacctttgacctgattgccaatggaggagccagcctgaccctgcactttgagcgggcccccttcatgagccaggagaggacagtgtggctgccctggaacagcttctacgccatggacaccctggtgatgaagacagaagaaaattccatccccagctgtgacctgagcggctttgtgcggccagaccccatcatcatcagcagccccctgagcaccttcttctctgctgcccctggccagaaccccatcgtgcctgagacccaggtgctgcacgaggagattgagctgcccggcagcaatgtgaagctgcgctacctgagcagcaggacagctggctacaagagcctgctgaagatcaccatgacccagagcacagtgcccctgaacctgatccgggtgcacctgatggtggccgtggagggccacctgttccagaagagcttccaggccagccccaacctggcctacaccttcatctgggacaagacagatgcctacggccagagggtgtatggcctgagtgatgctgtggtgtctgtgggctttgaatatgagacctgccccagcctcatcctgtgggagaagaggacagccctgctgcagggctttgagctggaccccagcaacctgggcggctggagcctggacaagcaccacatcctgaatgtgaagagcggcatcctgcacaagggcaccggggagaaccagttcctgacccagcagcctgccatcatcaccagcatcatgggaaatggaagaagaagaagcatcagctgccccagctgcaatggcctggccgagggcaacaagctgctggcccctgtggccctggccgtgggcattgatggcagcctgtatgtgggggacttcaactacatccgccgcatcttccccagcagaaatgtgaccagcatcctggagctgaggaacaaggagttcaagcacagcaacaacccagcccacaagtactacctggccgtggaccctgtgtctggcagcctgtatgtgtctgacaccaacagccgccgcatctacagagtgaagagcctgagcggcaccaaggacctggccggcaacagcgaggtggtggccggcaccggggagcagtgcctgccctttgatgaggcccgctgtggagatggcggcaaggccattgatgccaccctgatgagcccccggggcattgctgtggacaagaatggcctgatgtactttgtggatgccaccatgatcaggaaggtggaccagaatggcatcatcagcaccctgctgggcagcaatgacctgacagctgtgcggcccctgagctgtgacagctccatggatgtggcccaggtgcggctggagtggcccacagacctggccgtgaaccccatggacaacagcctgtatgtgctggagaacaacgtcatcctgcgcatcacagagaaccaccaggtgtccatcatcgccggccggcccatgcactgccaggtgcccggcatcgactacagcctgagcaagctggccatccacagcgccctggagagcgccagcgccatcgccatcagccacactggagtgctgtacatcacagaaacagatgagaagaagatcaaccggctgcggcaggtgaccaccaatggagagatctgcctgctggccggggccgccagtgactgtgactgcaagaatgatgtgaactgcaactgctacagcggagatgatgcctatgccacagatgccatcctgaacagccccagcagcctggccgtggccccagatggcaccatctacatcgctgacctgggcaacatccgcatccgggctgtgtccaagaacaagcctgtgctgaatgccttcaaccagtatgaagctgccagccctggagagcaggagctgtatgtgttcaatgctgatggcatccaccagtacacagtgtccctggtgactggagagtacctgtacaacttcacctacagcacagacaatgatgtgacagagctgattgacaacaacggcaacagcctgaagatcagaagagacagcagcggcatgcccaggcacctgctgatgccagacaaccagatcatcaccctgactgtgggcaccaacggcggcctgaaggtggtgtccacccagaacctggagctgggcctgatgacctatgatggcaacacaggcctgctggccaccaagagtgatgagaccggctggaccaccttctatgactatgaccacgagggccgcctgaccaacgtgacccggcccactggagtggtgaccagcctgcaccgggagatggagaagagcatcaccattgatattgagaacagcaacagagatgatgatgtgaccgtcatcaccaacctgagctctgtggaggccagctacacagtggtgcaggaccaggtgagaaattcctaccagctgtgcaacaacggcaccctgcgggtgatgtatgccaacggcatgggcatctccttccacagcgagccccacgtgctggccggcaccatcacccccaccatcggccgctgcaacatcagcctgcccatggagaatggcctgaacagcattgagtggaggctgaggaaggagcagatcaagggcaaggtgaccatctttggaaggaagctgcgggtgcacggcaggaacctgctgagcattgattatgacaggaacatcagaacagagaagatctatgatgaccacaggaagttcaccctgcgcatcatctatgaccaggtgggccggcccttcctgtggctgcccagcagcggcctggccgctgtgaatgtgtcctacttcttcaacggccgcctggccggcctgcagagaggagccatgtctgagaggacagacatcgacaagcagggcagaattgtgtccaggatgtttgctgatggcaaggtgtggagctacagctacctggacaagtccatggtgctgctgctgcagagccagaggcagtacatctttgaatatgacagcagtgaccggctgctggccgtgaccatgcccagcgtggcccggcacagcatgagcacccacaccagcatcggctacatccggaacatctacaaccccccagagagcaatgccagcgtcatctttgactacagtgatgatggccgcatcctgaagaccagcttcctgggcaccggccggcaggtgttctacaagtatggcaagctgagcaagctgtctgaaattgtgtatgacagcacagctgtgaccttcggctatgatgagaccaccggggtgctgaagatggtgaacctgcagagcggcggcttcagctgcaccatccgctacaggaagattggccccctggtggacaagcagatctaccgcttcagcgaggagggcatggtgaatgccaggtttgactacacctaccatgacaacagcttccgcatcgccagcatcaagcctgtgatcagcgagacccccctgcctgtggacctgtaccgctatgatgagatcagcggcaaggtggagcactttgggaagtttggagtcatctactatgacatcaaccagatcatcaccacagctgtgatgaccctgagcaagcactttgacacccacggccgcatcaaggaggtgcagtatgagatgttccgcagcctgatgtactggatgacagtgcagtatgacagcatgggccgggtcatcaagcgggagctgaagctgggcccctatgccaacaccaccaagtacacctatgactatgatggagatggccagctgcagagcgtggccgtgaatgaccggcccacctggagatacagctatgacctgaatggaaacctgcacctgctgaaccctggcaacagcgtgcggctgatgcccctgcgctatgacctgcgggaccgcatcacccggctgggagatgtgcagtacaagattgatgatgatggctacctgtgccagaggggcagtgacatctttgagtacaacagcaagggcctgctgacccgggcctacaacaaggccagcggctggagcgtgcagtaccgctatgatggagtgggcagaagagccagctacaagaccaacctgggccaccacctgcagtacttctacagcgacctgcacaaccccacccgcatcacccacgtgtacaaccacagcaacagcgagatcaccagcctgtactatgacctgcagggccacctgtttgccatggagagcagcagtggagaggagtactacgtggccagtgacaacacaggcacccccctggccgtgttcagcatcaatggcctgatgatcaagcagctgcagtacacagcctacggggagatctactatgacagcaacccagacttccagatggtgattggcttccacggcggcctgtatgaccccctgaccaagctggtgcacttcacccagagggactatgatgtgctggccggccgctggaccagcccagactacaccatgtggaagaatgtgggcaaggagcccgcccccttcaacctgtacatgttcaagagcaacaaccccctgagcagcgagctggacctgaagaactacgtgacagatgtgaagtcctggctggtgatgtttggcttccagctgagcaacatcatccctggcttcccccgggccaagatgtactttgtgcccccaccctatgagctgtctgagagccaggcctctgaaaatggccagctgatcaccggggtgcagcagaccacagagcggcacaaccaggccttcatggccctggagggccaggtgatcaccaagaagctgcacgccagcatccgggagaaggccggccactggtttgccaccaccacccccatcatcggcaagggcatcatgtttgccatcaaggagggccgggtgaccactggagtgagcagcatcgccagcgaggacagcaggaaggtggcctctgtgctgaacaatgcctactacctggacaagatgcactacagcattgagggcaaggacacccactactttgtgaagattggcagcgcagatggagacctggtgaccctgggcaccaccatcggcaggaaggtgctggagagcggcgtgaatgtgacagtgtcccagcccaccctgctggtgaatggaagaacaagacgcttcaccaacatcgagttccagtacagcaccctgctgctgagcatccgctatggcctgaccccagacaccctggatgaggagaaggcccgggtgctggaccaggcccggcagagggccctgggcacagcctgggccaaggagcagcagaaggccagagatggccgggagggcagccggctgtggacagaaggagagaagcagcagctgctgagcacaggccgggtgcagggctatgagggctactacgtgctgcctgtggagcagtacccagagctggccgacagcagcagcaacatccagttcctgcggcagaatgagatgggcaagaggtag

SEQ ID NO: 36137 - DNA, 8325 bp, Artificial Sequence
  Description of Artificial Sequence: Synthetic coding sequence
atggatgtgaaggaccggcggcacaggagcctgacccggggccgctgtgggaaggaatgtcgctacaccagcagcagcctggacagcgaggactgccgggtgcccacccagaagagctacagcagcagcgagaccctgaaggcctatgaccatgacagcaggatgcactacggcaacagagtgacagacctgatccaccgggagagtgatgagttcccccggcagggcaccaacttcaccctggccgagctgggcatctgtgagcccagcccccacaggagcggctactgcagcgacatgggcatcctgcaccagggctacagcctgagcactggaagtgatgctgacagcgacacagaaggaggcatgagccctgagcacgccatccggctgtggggccggggcatcaagagcagaagaagcagcggcctgagcagccgggagaacagcgccctgaccctgacagacagcgacaatgaaaacaagagtgatgatgaaaatggccggcccatcccccccaccagcagccccagcctgctgcccagcgcccagctgcccagcagccacaaccccccacctgtgtcctgccagatgcccctgctggacagcaacaccagccaccagatcatggacaccaacccagatgaggagttcagccccaacagctacctgctgcgggcctgcagcggcccccagcaggccagcagcagcggcccccccaaccaccacagccagagcaccctgcggccccccctgcccccaccccacaaccacaccctgagccaccaccacagcagcgccaacagcctgaacagaaacagcctgaccaacagaagaagccagatccacgccccagccccagccccaaatgacctggccaccaccccagagagcgtgcagctgcaggacagctgggtgctgaacagcaatgtgcccctggagaccaggcacttcctgttcaagaccagcagcggcagcacccccctcttcagcagcagcagccctggctaccccctgaccagcggcaccgtgtacaccccaccaccccggctgctgcccaggaacaccttcagcaggaaggccttcaagctgaagaagcccagcaagtactgctcctggaagtgtgccgccctgagcgccatcgctgctgccctgctgctggccatcctgctggcctacttcatcgccatgcacctgctgggcctgaactggcagctgcagcctgcagatggccacaccttcaacaacggcatcagaacaggcctgcctggaaatgatgatgtggccaccatgcccagcggcggcaaggtgccctggagcctgaagaacagcagcattgacagcggggaggccgaggtgggcagaagagtgacccaggaggtgcccccaggagtcttctggaggagccagatccacatcagccagccccagttcctgaagttcaacatcagcctgggcaaggatgccctgtttggagtgtacatccggcggggcctgccccccagccacgcccagtatgacttcatggagcggctggatggcaaggagaagtggagcgtggtggagagcccccgggagaggaggagcatccagaccctggtgcagaatgaggccgtgtttgtgcagtacctggatgtgggcctgtggcacctggccttctacaatgatggcaaggacaaggagatggtgtccttcaacacagtggtgctggacagcgtgcaggactgccccaggaactgccacggcaatggagaatgtgtgtctggagtgtgccactgcttccctggcttcctgggcgctgactgtgccaaggccgcctgccctgtgctgtgcagcggaaatggccagtacagcaagggcacctgccagtgctacagcggctggaagggagcagaatgtgatgtgcccatgaaccagtgcatcgaccccagctgtggcggccacggcagctgcattgatggcaactgtgtgtgcagcgctggctacaagggggagcactgtgaggaggtggactgcctggaccccacctgcagcagccacggcgtgtgtgtgaatggagaatgtctgtgcagccctggctggggcggcctgaactgtgagctggcccgggtgcagtgcccagaccagtgcagcggccacggcacctacctgcctgacaccggcctgtgcagctgtgaccccaactggatgggccctgactgcagcgtggaggtgtgcagcgtggactgtggcacccacggcgtgtgcatcggcggggcctgccgctgtgaggagggctggacaggagctgcctgtgaccagagggtgtgccacccccgctgcattgaacatggcacctgcaaggatggaaaatgtgagtgccgggagggctggaatggagagcactgcaccatcggccggcagacagctggaacagaaacagatggctgcccagacctgtgcaatggaaatggccgctgcaccctgggccagaacagctggcagtgtgtgtgccagacaggctggaggggccctggctgcaatgtggccatggagaccagctgtgccgacaacaaggacaatgaaggagatggcctggtggactgcctggaccctgactgctgcctgcagagcgcctgccagaacagcctgctgtgccggggcagccgggaccccctggacatcatccagcagggccagacagactggccagctgtgaagagcttctatgaccgcatcaagctgctggccggcaaggacagcacccacatcatccctggagagaaccccttcaacagcagcctggtgtccctcatccggggccaggtggtgaccacagatggcacccccctggtgggcgtgaatgtgtcctttgtgaagtaccccaagtatggctacaccatcacccggcaggacggcacctttgacctgattgccaatggaggagccagcctgaccctgcactttgagcgggcccccttcatgagccaggagaggacagtgtggctgccctggaacagcttctacgccatggacaccctggtgatgaagacagaagaaaattccatccccagctgtgacctgagcggctttgtgcggccagaccccatcatcatcagcagccccctgagcaccttcttctctgctgcccctggccagaaccccatcgtgcctgagacccaggtgctgcacgaggagattgagctgcccggcagcaatgtgaagctgcgctacctgagcagcaggacagctggctacaagagcctgctgaagatcaccatgacccagagcacagtgcccctgaacctgatccgggtgcacctgatggtggccgtggagggccacctgttccagaagagcttccaggccagccccaacctggcctacaccttcatctgggacaagacagatgcctacggccagagggtgtatggcctgagtgatgctgtggtgtctgtgggctttgaatatgagacctgccccagcctcatcctgtgggagaagaggacagccctgctgcagggctttgagctggaccccagcaacctgggcggctggagcctggacaagcaccacatcctgaatgtgaagagcggcatcctgcacaagggcaccggggagaaccagttcctgacccagcagcctgccatcatcaccagcatcatgggaaatggaagaagaagaagcatcagctgccccagctgcaatggcctggccgagggcaacaagctgctggcccctgtggccctggccgtgggcattgatggcagcctgtatgtgggggacttcaactacatccgccgcatcttccccagcagaaatgtgaccagcatcctggagctgaggaacaaggagttcaagcacagcaacaacccagcccacaagtactacctggccgtggaccctgtgtctggcagcctgtatgtgtctgacaccaacagccgccgcatctacagagtgaagagcctgagcggcaccaaggacctggccggcaacagcgaggtggtggccggcaccggggagcagtgcctgccctttgatgaggcccgctgtggagatggcggcaaggccattgatgccaccctgatgagcccccggggcattgctgtggacaagaatggcctgatgtactttgtggatgccaccatgatcaggaaggtggaccagaatggcatcatcagcaccctgctgggcagcaatgacctgacagctgtgcggcccctgagctgtgacagctccatggatgtggcccaggtgcggctggagtggcccacagacctggccgtgaaccccatggacaacagcctgtatgtgctggagaacaacgtcatcctgcgcatcacagagaaccaccaggtgtccatcatcgccggccggcccatgcactgccaggtgcccggcatcgactacagcctgagcaagctggccatccacagcgccctggagagcgccagcgccatcgccatcagccacactggagtgctgtacatcacagaaacagatgagaagaagatcaaccggctgcggcaggtgaccaccaatggagagatctgcctgctggccggggccgccagtgactgtgactgcaagaatgatgtgaactgcaactgctacagcggagatgatgcctatgccacagatgccatcctgaacagccccagcagcctggccgtggccccagatggcaccatctacatcgctgacctgggcaacatccgcatccgggctgtgtccaagaacaagcctgtgctgaatgccttcaaccagtatgaagctgccagccctggagagcaggagctgtatgtgttcaatgctgatggcatccaccagtacacagtgtccctggtgactggagagtacctgtacaacttcacctacagcacagacaatgatgtgacagagctgattgacaacaacggcaacagcctgaagatcagaagagacagcagcggcatgcccaggcacctgctgatgccagacaaccagatcatcaccctgactgtgggcaccaacggcggcctgaaggtggtgtccacccagaacctggagctgggcctgatgacctatgatggcaacacaggcctgctggccaccaagagtgatgagaccggctggaccaccttctatgactatgaccacgagggccgcctgaccaacgtgacccggcccactggagtggtgaccagcctgcaccgggagatggagaagagcatcaccattgatattgagaacagcaacagagatgatgatgtgaccgtcatcaccaacctgagctctgtggaggccagctacacagtggtgcaggaccaggtgagaaattcctaccagctgtgcaacaacggcaccctgcgggtgatgtatgccaacggcatgggcatctccttccacagcgagccccacgtgctggccggcaccatcacccccaccatcggccgctgcaacatcagcctgcccatggagaatggcctgaacagcattgagtggaggctgaggaaggagcagatcaagggcaaggtgaccatctttggaaggaagctgcgggtgcacggcaggaacctgctgagcattgattatgacaggaacatcagaacagagaagatctatgatgaccacaggaagttcaccctgcgcatcatctatgaccaggtgggccggcccttcctgtggctgcccagcagcggcctggccgctgtgaatgtgtcctacttcttcaacggccgcctggccggcctgcagagaggagccatgtctgagaggacagacatcgacaagcagggcagaattgtgtccaggatgtttgctgatggcaaggtgtggagctacagctacctggacaagtccatggtgctgctgctgcagagccagaggcagtacatctttgaatatgacagcagtgaccggctgctggccgtgaccatgcccagcgtggcccggcacagcatgagcacccacaccagcatcggctacatccggaacatctacaaccccccagagagcaatgccagcgtcatctttgactacagtgatgatggccgcatcctgaagaccagcttcctgggcaccggccggcaggtgttctacaagtatggcaagctgagcaagctgtctgaaattgtgtatgacagcacagctgtgaccttcggctatgatgagaccaccggggtgctgaagatggtgaacctgcagagcggcggcttcagctgcaccatccgctacaggaagattggccccctggtggacaagcagatctaccgcttcagcgaggagggcatggtgaatgccaggtttgactacacctaccatgacaacagcttccgcatcgccagcatcaagcctgtgatcagcgagacccccctgcctgtggacctgtaccgctatgatgagatcagcggcaaggtggagcactttgggaagtttggagtcatctactatgacatcaaccagatcatcaccacagctgtgatgaccctgagcaagcactttgacacccacggccgcatcaaggaggtgcagtatgagatgttccgcagcctgatgtactggatgacagtgcagtatgacagcatgggccgggtcatcaagcgggagctgaagctgggcccctatgccaacaccaccaagtacacctatgactatgatggagatggccagctgcagagcgtggccgtgaatgaccggcccacctggagatacagctatgacctgaatggaaacctgcacctgctgaaccctggcaacagcgtgcggctgatgcccctgcgctatgacctgcgggaccgcatcacccggctgggagatgtgcagtacaagattgatgatgatggctacctgtgccagaggggcagtgacatctttgagtacaacagcaagggcctgctgacccgggcctacaacaaggccagcggctggagcgtgcagtaccgctatgatggagtgggcagaagagccagctacaagaccaacctgggccaccacctgcagtacttctacagcgacctgcacaaccccacccgcatcacccacgtgtacaaccacagcaacagcgagatcaccagcctgtactatgacctgcagggccacctgtttgccatggagagcagcagtggagaggagtactacgtggccagtgacaacacaggcacccccctggccgtgttcagcatcaatggcctgatgatcaagcagctgcagtacacagcctacggggagatctactatgacagcaacccagacttccagatggtgattggcttccacggcggcctgtatgaccccctgaccaagctggtgcacttcacccagagggactatgatgtgctggccggccgctggaccagcccagactacaccatgtggaagaatgtgggcaaggagcccgcccccttcaacctgtacatgttcaagagcaacaaccccctgagcagcgagctggacctgaagaactacgtgacagatgtgaagtcctggctggtgatgtttggcttccagctgagcaacatcatccctggcttcccccgggccaagatgtactttgtgcccccaccctatgagctgtctgagagccaggcctctgaaaatggccagctgatcaccggggtgcagcagaccacagagcggcacaaccaggccttcatggccctggagggccaggtgatcaccaagaagctgcacgccagcatccgggagaaggccggccactggtttgccaccaccacccccatcatcggcaagggcatcatgtttgccatcaaggagggccgggtgaccactggagtgagcagcatcgccagcgaggacagcaggaaggtggcctctgtgctgaacaatgcctactacctggacaagatgcactacagcattgagggcaaggacacccactactttgtgaagattggcagcgcagatggagacctggtgaccctgggcaccaccatcggcaggaaggtgctggagagcggcgtgaatgtgacagtgtcccagcccaccctgctggtgaatggaagaacaagacgcttcaccaacatcgagttccagtacagcaccctgctgctgagcatccgctatggcctgaccccagacaccctggatgaggagaaggcccgggtgctggaccaggcccggcagagggccctgggcacagcctgggccaaggagcagcagaaggccagagatggccgggagggcagccggctgtggacagaaggagagaagcagcagctgctgagcacaggccgggtgcagggctatgagggctactacgtgctgcctgtggagcagtacccagagctggccgacagcagcagcaacatccagttcctgcggcagaatgagatgggcaagaggtag

SEQ ID NO: 36138 - DNA, 8322 bp, Artificial Sequence
  Description of Artificial Sequence: Synthetic coding sequence
atggatgtgaaggaccggcggcacaggagcctgacccggggccgctgtgggaaggaatgtcgctacaccagcagcagcctggacagcgaggactgccgggtgcccacccagaagagctacagcagcagcgagaccctgaaggcctatgaccatgacagcaggatgcactacggcaacagagtgacagacctgatccaccgggagagtgatgagttcccccggcagggcaccaacttcaccctggccgagctgggcatctgtgagcccagcccccacaggagcggctactgcagcgacatgggcatcctgcaccagggctacagcctgagcactggaagtgatgctgacagcgacacagaaggaggcatgagccctgagcacgccatccggctgtggggccggggcatcaagagcagaagaagcagcggcctgagcagccgggagaacagcgccctgaccctgacagacagcgacaatgaaaacaagagtgatgatgaaaatggccggcccatcccccccaccagcagccccagcctgctgcccagcgcccagctgcccagcagccacaaccccccacctgtgtcctgccagatgcccctgctggacagcaacaccagccaccagatcatggacaccaacccagatgaggagttcagccccaacagctacctgctgcgggcctgcagcggcccccagcaggccagcagcagcggcccccccaaccaccacagccagagcaccctgcggccccccctgcccccaccccacaaccacaccctgagccaccaccacagcagcgccaacagcctgaacagaaacagcctgaccaacagaagaagccagatccacgccccagccccagccccaaatgacctggccaccaccccagagagcgtgcagctgcaggacagctgggtgctgaacagcaatgtgcccctggagaccaggcacttcctgttcaagaccagcagcggcagcacccccctcttcagcagcagcagccctggctaccccctgaccagcggcaccgtgtacaccccaccaccccggctgctgcccaggaacaccttcagcaggaaggccttcaagctgaagaagcccagcaagtactgctcctggaagtgtgccgccctgagcgccatcgctgctgccctgctgctggccatcctgctggcctacttcatcgccatgcacctgctgggcctgaactggcagctgcagcctgcagatggccacaccttcaacaacggcatcagaacaggcctgcctggaaatgatgatgtggccaccatgcccagcggcggcaaggtgccctggagcctgaagaacagcagcattgacagcggggaggccgaggtgggcagaagagtgacccaggaggtgcccccaggagtcttctggaggagccagatccacatcagccagccccagttcctgaagttcaacatcagcctgggcaaggatgccctgtttggagtgtacatccggcggggcctgccccccagccacgcccagtatgacttcatggagcggctggatggcaaggagaagtggagcgtggtggagagcccccgggagaggaggagcatccagaccctggtgcagaatgaggccgtgtttgtgcagtacctggatgtgggcctgtggcacctggccttctacaatgatggcaaggacaaggagatggtgtccttcaacacagtggtgctggacagcgtgcaggactgccccaggaactgccacggcaatggagaatgtgtgtctggagtgtgccactgcttccctggcttcctgggcgctgactgtgccaaggccgcctgccctgtgctgtgcagcggaaatggccagtacagcaagggcacctgccagtgctacagcggctggaagggagcagaatgtgatgtgcccatgaaccagtgcatcgaccccagctgtggcggccacggcagctgcattgatggcaactgtgtgtgcagcgctggctacaagggggagcactgtgaggaggtggactgcctggaccccacctgcagcagccacggcgtgtgtgtgaatggagaatgtctgtgcagccctggctggggcggcctgaactgtgagctggcccgggtgcagtgcccagaccagtgcagcggccacggcacctacctgcctgacaccggcctgtgcagctgtgaccccaactggatgggccctgactgcagcgtggaggtgtgcagcgtggactgtggcacccacggcgtgtgcatcggcggggcctgccgctgtgaggagggctggacaggagctgcctgtgaccagagggtgtgccacccccgctgcattgaacatggcacctgcaaggatggaaaatgtgagtgccgggagggctggaatggagagcactgcaccatcgtgcgggagaccatcggcggggagtgctacggctgcccagacctgtgcaatggaaatggccgctgcaccctgggccagaacagctggcagtgtgtgtgccagacaggctggaggggccctggctgcaatgtggccatggagaccagctgtgccgacaacaaggacaatgaaggagatggcctggtggactgcctggaccctgactgctgcctgcagagcgcctgccagaacagcctgctgtgccggggcagccgggaccccctggacatcatccagcagggccagacagactggccagctgtgaagagcttctatgaccgcatcaagctgctggccggcaaggacagcacccacatcatccctggagagaaccccttcaacagcagcctggtgtccctcatccggggccaggtggtgaccacagatggcacccccctggtgggcgtgaatgtgtcctttgtgaagtaccccaagtatggctacaccatcacccggcaggacggcacctttgacctgattgccaatggaggagccagcctgaccctgcactttgagcgggcccccttcatgagccaggagaggacagtgtggctgccctggaacagcttctacgccatggacaccctggtgatgaagacagaagaaaattccatccccagctgtgacctgagcggctttgtgcggccagaccccatcatcatcagcagccccctgagcaccttcttctctgctgcccctggccagaaccccatcgtgcctgagacccaggtgctgcacgaggagattgagctgcccggcagcaatgtgaagctgcgctacctgagcagcaggacagctggctacaagagcctgctgaagatcaccatgacccagagcacagtgcccctgaacctgatccgggtgcacctgatggtggccgtggagggccacctgttccagaagagcttccaggccagccccaacctggcctacaccttcatctgggacaagacagatgcctacggccagagggtgtatggcctgagtgatgctgtggtgtctgtgggctttgaatatgagacctgccccagcctcatcctgtgggagaagaggacagccctgctgcagggctttgagctggaccccagcaacctgggcggctggagcctggacaagcaccacatcctgaatgtgaagagcggcatcctgcacaagggcaccggggagaaccagttcctgacccagcagcctgccatcatcaccagcatcatgggaaatggaagaagaagaagcatcagctgccccagctgcaatggcctggccgagggcaacaagctgctggcccctgtggccctggccgtgggcattgatggcagcctgtatgtgggggacttcaactacatccgccgcatcttccccagcagaaatgtgaccagcatcctggagctgaggaacaaggagttccacaacaacaacccagcccacaagtactacctggccgtggaccctgtgtctggcagcctgtatgtgtctgacaccaacagccgccgcatctacagagtgaagagcctgagcggcaccaaggacctggccggcaacagcgaggtggtggccggcactggagagcagtgcctgccctttgatgaggcccgctgtggagatggcggcaaggccattgatgccaccctgatgagcccccggggcattgctgtggacaagaatggcctgatgtactttgtggatgccaccatgatcaggaaggtggaccagaatggcatcatcagcaccctgctgggcagcaatgacctgacagctgtgcggcccctgagctgtgacagctccatggatgtggcccaggtgcggctggagtggcccacagacctggccgtgaaccccatggacaacagcctgtatgtgctggagaacaacgtcatcctgcgcatcacagagaaccaccaggtgtccatcatcgccggccggcccatgcactgccaggtgcccggcatcgactacagcctgagcaagctggccatccacagcgccctggagagcgccagcgccatcgccatcagccacactggagtgctgtacatcacagaaacagatgagaagaagatcaaccggctgcggcaggtgaccaccaacggggagatctgcctgctggccggggccgccagtgactgtgactgcaagaatgatgtgaactgcaactgctacagcggagatgatgcctatgccacagatgccatcctgaacagccccagcagcctggccgtggccccagatggcaccatctacatcgctgacctgggcaacatccgcatccgggctgtgtccaagaacaagcctgtgctgaatgccttcaaccagtatgaggccgccagccctggagagcaggagctgtatgtgttcaatgctgatggcatccaccagtacacagtgtccctggtgactggagagtacctgtacaacttcacctacagcacagacaatgatgtgacagagctgattgacaacaatggaaacagcctgaagatccggcgggacagcagcggcatgcccaggcacctgctgatgccagacaaccagatcatcaccctgactgtgggcaccaatggaggcctgaaggtggtgtccacccagaacctggagctgggcctgatgacctatgatggcaacacaggcctgctggccaccaagagtgatgaaacaggctggaccaccttctatgactatgaccacgagggccgcctgaccaacgtgacccggcccaccggggtggtgaccagcctgcaccgggagatggagaagagcatcaccatcgacatcgagaacagcaacagagatgatgatgtgaccgtcatcaccaacctgagctctgtggaggccagctacacagtggtgcaggaccaggtgaggaacagctaccagctgtgcaacaacggcaccctgcgggtgatgtatgccaacggcatgggcatctccttccacagcgagccccacgtgctggccggcaccatcacccccaccatcggccgctgcaacatcagcctgcccatggagaatggcctgaacagcattgagtggaggctgaggaaggagcagatcaagggcaaggtgaccatcttcggcaggaagctgcgggtgcatggaagaaacctgctgagcattgattatgacaggaacatcagaacagagaagatctatgatgaccacaggaagttcaccctgcgcatcatctatgaccaggtgggccggcccttcctgtggctgcccagcagcggcctggccgctgtgaatgtgtcctacttcttcaacggccgcctggccggcctgcagagaggagccatgtctgagaggacagacatcgacaagcagggccgcatcgtgtccaggatgtttgctgatggcaaggtgtggagctacagctacctggacaagtccatggtgctgctgctgcagagccagaggcagtacatctttgaatatgacagcagtgaccggctgctggccgtgaccatgcccagcgtggcccggcacagcatgagcacccacaccagcatcggctacatccggaacatctacaaccccccagagagcaatgccagcgtcatctttgactacagtgatgatggccgcatcctgaagaccagcttcctgggcaccggccggcaggtgttctacaagtatggcaagctgagcaagctgtctgagatcgtgtatgacagcacagctgtgaccttcggctatgatgagaccactggagtgctgaagatggtgaacctgcagagcggcggcttcagctgcaccatccgctacaggaagattggccccctggtggacaagcagatctaccgcttcagcgaggagggcatggtgaatgccaggtttgactacacctaccatgacaacagcttcagaattgccagcatcaagcctgtgatcagcgagacccccctgcctgtggacctgtaccgctatgatgagatcagcggcaaggtggagcactttgggaagtttggagtcatctactatgacatcaaccagatcatcaccacagctgtgatgaccctgagcaagcactttgacacccacggccgcatcaaggaggtgcagtatgagatgttccgcagcctgatgtactggatgacagtgcagtatgacagcatgggccgggtcatcaagcgggagctgaagctgggcccctatgccaacaccaccaagtacacctatgactatgatggagatggccagctgcagagcgtggccgtgaatgaccggcccacctggagatacagctatgacctgaatggaaacctgcacctgctgaaccctggcaacagcgtgcggctgatgcccctgcgctatgacctgcgggaccgcatcacccggctgggagatgtgcagtacaagattgatgatgatggctacctgtgccagaggggcagtgacatctttgagtacaacagcaagggcctgctgacccgggcctacaacaaggccagcggctggagcgtgcagtaccgctatgatggagtgggccggcgggccagctacaagaccaacctgggccaccacctgcagtacttctacagcgacctgcacaaccccacccgcatcacccacgtgtacaaccacagcaacagcgagatcaccagcctgtactatgacctgcagggccacctgtttgccatggagagcagcagcggggaggagtactacgtggccagtgacaacacaggcacccccctggccgtgttcagcatcaatggcctgatgatcaagcagctgcagtacacagcctatggagagatctactatgacagcaacccagacttccagatggtgattggcttccatggaggcctgtatgaccccctgaccaagctggtgcacttcacccagagggactatgatgtgctggccggccgctggaccagcccagactacaccatgtggaagaatgtgggcaaggagcccgcccccttcaacctgtacatgttcaagagcaacaaccccctgagcagcgagctggacctgaagaactacgtgacagatgtgaagtcctggctggtgatgtttggcttccagctgagcaacatcatccctggcttcccccgggccaagatgtactttgtgcccccaccctatgagctgtctgagagccaggcctctgaaaatggccagctgatcactggagtgcagcagaccacagagcggcacaaccaggccttcatggccctggagggccaggtgatcaccaagaagctgcacgccagcatccgggagaaggccggccactggtttgccaccaccacccccatcatcggcaagggcatcatgtttgccatcaaggagggccgggtgaccaccggggtgagcagcatcgccagcgaggacagcaggaaggtggcctctgtgctgaacaatgcctactacctggacaagatgcactacagcattgagggcaaggacacccactactttgtgaagattggcagcgcagatggagacctggtgaccctgggcaccaccatcggcaggaaggtgctggagagcggcgtgaatgtgacagtgtcccagcccaccctgctggtgaatggccgcacccggcgcttcaccaacatcgagttccagtacagcaccctgctgctgagcatccgctatggcctgaccccagacaccctggatgaggagaaggcccgggtgctggaccaggcccggcagagggccctgggcacagcctgggccaaggagcagcagaaggccagagatggccgggagggcagccggctgtggacagaaggagagaagcagcagctgctgagcacaggccgggtgcagggctatgagggctactacgtgctgcctgtggagcagtacccagagctggccgacagcagcagcaacatccagttcctgcggcagaatgagatgggcaagaggtag

SEQ ID NO: 36139 - DNA, 8100 bp, Artificial Sequence
  Description of Artificial Sequence: Synthetic coding sequence
atggatgtgaaggagcggcggccctactgcagcctgaccaagagccggcgggagaaggagcggcgctacaccaacagcagcgctgacaatgaggagtgccgggtgcccacccagaagagctacagcagcagcgagaccctgaaggcctttgaccatgacagcagccggctgctgtatggcaacagagtgaaggacctggtgcaccgggaggctgatgagttcacccggcagggccagaacttcaccctgcggcagctgggcgtgtgtgagcccgccacccggcggggcctggccttctgtgccgagatgggcctgccccaccggggctacagcatctctgctggcagtgatgctgacacagaaaatgaggccgtgatgagccctgagcacgccatgaggctgtggggccggggcgtgaagagcggccgcagcagctgcctgagcagccgcagcaacagcgccctgaccctgacagacacagaacatgagaacaagagtgacagtgaaaatgagcagcctgccagcaaccagggccagagcaccctgcagcccctgccccccagccacaagcagcacagcgcccagcaccaccccagcatcaccagcctgaacagaaacagcctgaccaacagaagaaaccagagccctgcccccccagctgccctgcctgctgagctgcagaccaccccagagagcgtgcagctgcaggacagctgggtgctgggcagcaatgtgcccctggagagccgccacttcctgttcaagacaggcaccggcaccacccccctcttcagcacagccaccccaggctacaccatggccagcggctctgtgtacagcccccccacccggcccctgcccaggaacaccctgagccgcagcgccttcaagttcaagaagagcagcaagtactgctcctggaagtgcacagccctgtgtgctgtgggcgtgtctgtgctgctggccatcctgctgagctacttcatcgccatgcacctgtttggcctgaactggcagctgcagcagacagaaaatgacacctttgaaaatggcaaggtgaacagcgacaccatgcccaccaacacagtgtccctgcccagcggggacaacgggaagctgggcggcttcacccaggagaacaacaccattgattctggagagctggacatcggccggcgggccatccaggagatccccccaggcatcttctggaggagccagctgttcatcgaccagccccagttcctgaagttcaacatcagcctgcagaaggatgccctgattggagtgtatggcaggaagggcctgccccccagccacacccagtatgactttgtggagctgctggatggcagccggctgattgcccgggagcagaggagcctgctggagacagagcgggccggccggcaggcccggtctgtgtccctgcacgaggccggcttcatccagtacctggacagcggcatctggcacctggccttctacaatgatggcaagaatgctgagcaggtgtccttcaacaccatcgtcatcgagagcgtggtggagtgccccaggaactgccacggcaatggagaatgtgtgtctggcacctgccactgcttccctggcttcctgggccctgactgcagcagagctgcctgccctgtgctgtgcagcggaaatggccagtacagcaagggccgctgcctgtgcttcagcggctggaagggcacagaatgtgatgtgcccaccacccagtgcatcgacccccagtgtggcggccggggcatctgcatcatgggcagctgtgcctgcaacagcggctacaagggggagagctgtgaggaggccgactgcattgatcctggctgcagcaaccacggcgtgtgcatccatggagagtgccactgcagccctggctggggcggcagcaactgtgagatcctgaagaccatgtgcccagaccagtgcagcggccacggcacctacctgcaggagagcggcagctgcacctgtgaccccaactggacaggccctgactgcagcaatgagatctgcagcgtggactgtggcagccacggcgtgtgcatgggcggcacctgccgctgtgaggagggctggacaggccctgcctgcaaccagagggcctgccacccccgctgtgccgagcacggcacctgcaaggatggaaaatgtgagtgcagccagggctggaatggagagcactgcaccatcgagggctgccccggcctgtgcaacagcaatggccgctgcaccctggaccagaatggctggcactgtgtgtgccagcccggctggagaggagctggctgtgatgtggccatggagaccctgtgcacagacagcaaggacaatgaaggagatggcctgattgactgcatggaccctgactgctgcctgcagagcagctgccagaaccagccctactgccggggcctgcctgacccccaggacatcatcagccagagcctgcagagccccagccagcaggccgccaagagcttctatgaccgcatctccttcctgattggaagtgacagcacccacgtgattcctggagagagccccttcaacaagagcctggccagcgtcatccggggccaggtgctgacagcagatggcacccccctcatcggcgtgaatgtgtccttcttccactacccagaatatggctacaccatcacccggcaggacggcatgtttgacctggtggccaacggcggggccagcctgaccctggtgtttgagaggagccccttcctgacccagtaccacacagtgtggatcccctggaatgtgttctacgtgatggacaccctggtgatgaagaaggaggagaatgacatccccagctgtgacctgagcggctttgtgcggcccaaccccatcatcgtgagcagccccctgagcaccttcttccgcagcagccctgaggacagccccatcatccctgagacccaggtgctgcacgaggagaccaccatccctggaacagacctgaagctgagctacctgagcagcagagctgctggctacaagtctgtgctgaagatcaccatgacccagagcatcatccccttcaacctgatgaaggtgcacctgatggtggccgtggtgggccgcctcttccagaagtggttccctgccagccccaacctggcctacaccttcatctgggacaagacagatgcctacaaccagaaggtgtatggcctgtctgaggccgtggtgtctgtgggctatgaatatgagagctgcctggacctgaccctgtgggagaagaggacagccatcctgcagggctatgagctggatgccagcaacatgggcggctggaccctggacaagcaccacgtgctggatgtgcagaatggcatcctgtacaagggaaatggagagaaccagttcatcagccagcagccccctgtggtgagcagcatcatgggaaatggaagaagaagaagcatcagctgccccagctgcaatggccaggctgatggcaacaagctgctggcccctgtggccctggcctgtggcattgatggcagcctgtatgtgggggacttcaactacgtgcggcgcatcttccccagcggaaatgtgacctctgtgctggagctgagcagcaacccagcccaccgctactacctggccacagatcctgtgactggagacctgtatgtgtctgacaccaacacccggcgcatctaccggcccaagagcctgactggagccaaggacctgaccaagaatgctgaggtggtggccggcaccggggagcagtgcctgccctttgatgaggcccgctgtggagatggcggcaaggctgtggaggccaccctgatgagccccaagggcatggctgtggacaagaatggcctcatctactttgtggatggcaccatgatcaggaaggtggaccagaatggcatcatcagcaccctgctgggcagcaatgacctgaccagcgcccggcccctgacctgtgacacctccatgcacatcagccaggtgcggctggagtggcccacagacctggccatcaaccccatggacaacagcatctacgtgctggacaacaacgtggtgctgcagatcacagagaaccggcaggtgagaattgctgctggccggcccatgcactgccaggtgcctggggtggagtaccctgtgggcaagcatgctgtgcagaccaccctggagagcgccacagccatcgctgtgtcctacagcggcgtgctgtacatcacagaaacagatgagaagaagatcaaccgcatccggcaggtgaccacagatggagagatcagcctggtggccggcatccccagtgaatgtgactgcaagaatgatgccaactgtgactgctaccagagcggagatggctacgccaaggatgccaagctgagcgcccccagcagcctggccgccagcccagatggcaccctgtacatcgctgacctgggcaacatccgcatccgggctgtgtccaagaacaagcccctgctgaacagcatgaacttctatgaggtggccagccccacagaccaggagctgtacatctttgacatcaatggcacccaccagtacacagtgtccctggtgactggagactacctgtacaacttctcctacagcaatgacaatgacatcacagctgtgacagacagcaatggaaacaccctgcgcatcagaagagaccccaacaggatgcctgtgcgggtggtgtccccagacaaccaggtgatctggctgaccatcggcaccaacggctgcctgaagtccatgacagcccagggcctggagctggtgctcttcacctaccacggcaacagcggcctgctggccaccaagagtgatgagaccggctggaccaccttctttgattatgacagcgagggccgcctgaccaacgtgaccttccccactggagtggtgaccaacctgcacggggacatggacaaggccatcaccgtggacatcgagagcagcagccgggaggaggatgtgtccatcaccagcaacctgagcagcattgacagcttctacaccatggtgcaggaccagctgagaaattcctaccagatcggctatgatggcagcctgcgcatcatctatgccagcggcctggacagccactaccagacagagccccacgtgctggccggcacagccaaccccaccgtggccaagaggaacatgaccctgcctggagaaaatggccagaacctggtggagtggaggttcaggaaggagcaggcccagggcaaggtgaatgtgtttggaaggaagctgcgggtgaatggaagaaacctgctgtctgtggactttgacaggaccaccaagacagagaagatctatgatgaccacaggaagttcctgctgagaattgcctatgacaccagcggccaccccaccctgtggctgcccagcagcaagctgatggctgtgaatgtgacctacagcagcacaggccagatcgccagcatccagaggggcaccaccagcgagaaggtggactatgatggccagggcagaattgtgtcccgggtgtttgctgatggcaagacctggagctacacctacctggagaagtccatggtgctgctgctgcacagccagaggcagtacatctttgaatatgacatgtgggaccggctgagcgccatcaccatgcccagcgtggcccggcacaccatgcagaccatccgcagcatcggctactacagaaacatctacaaccccccagagagcaatgccagcatcatcacagactacaatgaggagggcctgctgctgcagacagccttcctgggcaccagccggcgggtgctcttcaagtaccgccggcagacccggctgtctgagatcctgtatgacagcaccagggtgtccttcacctatgatgaaacagctggggtgctgaagacagtgaacctgcagagtgatggcttcatctgcaccatccgctaccggcagatcggccccctgattgaccggcagatcttccgcttctctgaagatggcatggtgaatgccaggtttgactacagctatgacaacagcttccgggtgacctccatgcagggcgtcatcaatgagacccccctgcccatcgacctgtaccagtttgatgacatcagcggcaaggtggagcagtttgggaagtttggagtcatctactatgacatcaaccagatcatcagcacagctgtgatgacctacaccaagcactttgatgcccacggccgcatcaaggagatccagtatgagatcttccgcagcctgatgtactggatcaccatccagtatgacaacatgggccgggtgaccaagcgggagatcaagattggcccctttgccaacaccaccaagtatgcctatgaatatgatgtggatggccagctgcagacagtgtacctgaatgagaagatcatgtggagatacaactatgacctgaatggaaacctgcacctgctgaaccccagcaacagcgcccggctgacccccctgcgctatgacctgcgggaccgcatcacccggctgggagatgtgcagtaccgcctggatgaagatggcttcctgcggcagaggggcacagagatctttgagtacagcagcaagggcctgctgaccagggtgtacagcaaaggaagtggctggacagtcatctaccgctatgatggcctgggccggcgggtgagcagcaagaccagcctgggccagcacctgcagttcttctatgctgacctgacctaccccacccgcatcacccacgtgtacaaccacagcagcagcgagatcaccagcctgtactatgacctgcagggccacctgtttgccatggagatcagcagtggagatgagttctacatcgccagtgacaacacaggcacccccctggccgtgttcagcagcaatggcctgatgctgaagcagatccagtacacagcctatggagagatctactttgacagcaacatcgacttccagctggtgattggcttccatggaggcctgtatgaccccctgaccaagctgatccactttggagagcgggactatgacatcctggccggccgctggaccaccccagacatcgagatctggaagagaattggcaaggaccctgcccccttcaacctgtacatgttcaggaacaacaacccagccagcaagatccatgatgtgaaggactacatcacagatgtgaacagctggctggtgaccttcggcttccacctgcacaatgccatccctggcttccctgtgcccaagtttgacctgacagagcccagctatgagctggtgaagagccagcagtgggatgacatcccccccatctttggagtgcagcagcaggtggcccggcaggccaaggccttcctgagcctgggcaagatggccgaggtgcaggtgtccagaagaagagctgggggcgcccagagctggctgtggtttgccaccgtgaagagcctcatcggcaagggcgtgatgctggccgtgtcccagggccgggtgcagaccaacgtgctgaacatcgccaatgaagactgcatcaaggtggccgctgtgctgaacaatgccttctacctggagaacctgcacttcaccatcgagggcaaggacacccactacttcatcaagaccaccaccccagagagtgacctgggcaccctgcggctgaccagcggcaggaaggccctggagaatggcatcaacgtgacagtgtcccagagcaccaccgtggtgaatggaagaacaagaagatttgctgatgtggagatgcagtttggagccctggccctgcacgtgcgctatggcatgaccctggatgaggagaaggcccgcatcctggagcaggcccggcagagggccctggcccgggcctgggcccgggagcagcagagggtgagagatggagaggagggcgcccggctgtggacagaaggagagaagaggcagctgctgtctgctgggaaggtgcagggctatgatggctactacgtgctgtctgtggagcagtacccagagctggccgacagcgccaacaacatccagttcctgcggcagagcgagatcggcagaagatag

SEQ ID NO: 36140 - DNA, 8100 bp, Artificial Sequence; identical to SEQ ID NO: 36139
  Description of Artificial Sequence: Synthetic coding sequence

SEQ ID NO: 36141 - DNA, 513 bp, Artificial Sequence
  Description of Artificial Sequence: Synthetic coding sequence
atggatgtgaaggagcggcggccctactgcagcctgaccaagagccggcgggagaaggagcggcgctacaccaacagcagcgctgacaatgaggagtgccgggtgcccacccagaagagctacagcagcagcgagaccctgaaggcctttgaccatgacagcagccggctgctgtatggcaacagagtgaaggacctggtgcaccgggaggctgatgagttcacccggcagggccagaacttcaccctgcggcagctgggcgtgtgtgagcccgccacccggcggggcctggccttctgtgccgagatgggcctgccccaccggggctacagcatctctgctggcagtgatgctgacacagaaaatgaggccgtgatgagccctgagcacgccatgaggctgtggggccggggcgtgaagagcggccgcagcagctgcctgagcagccgcagcaacagcgccctgaccctgacagacacagaacatgagaacaagagtgacagtgaaaattag

SEQ ID NO: 36142 - DNA, 981 bp, Artificial Sequence
  Description of Artificial Sequence: Synthetic coding sequence
atgtgccccctgaccctgcaggtgacaggcctgatgaatgtgtctgagcccaacagcagctttgcctttgtgaatgagttcatcctgcagggcttcacctgtgagtggaccatccagatcttcctgttcagcctcttcaccaccacctacgccctgaccatcactggaaatggagccatcgcctttgtgctgtggtgtgactggaggctgcacacccccatgtacatgttcctgggcaacttctccttcctggagatctggtacgtgagcagcacagtgcccaagatgctggtgaacttcctgtctgagaagaagaacatcagctttgctggctgcttcctgcagttctacttcttcttcagcctgggcaccagcgagtgcctgctgctgactgtgatggcctttgaccagtacctggccatctgccggcccctgctgtaccccaacatcatgacaggccacctgtgtgccaagctggtgatcctgtgctgggtgtgtggcttcctgtggttcctgatccccatcgtgctgatcagccagatgcccttctgtggccccaacatcatcgaccacgtggtgtgtgaccccggccccaggtttgccctggactgtgtgtctgccccccgcatccagctgttctgctacaccctgagcagcctggtgatctttggaaacttcctgttcatcatcggcagctacaccctggtgctgaaggctgtgctgggcatgcccagcagcacaggccgccacaaggccttcagcacctgtggcagccacctggccgtggtgtccctgtgctacagcagcctgatggtgatgtatgtgtccccaggcctgggccacagcacaggcatgcagaagattgagaccctcttctacgccatggtgacccccctcttcaaccccctcatctacagcctgcagaacaaggagatcaaggccgccctgaggaaggtgctgggcagcagcaacatcatctag

SEQ ID NO: 36143 - DNA, 960 bp, Artificial Sequence
  Description of Artificial Sequence: Synthetic coding sequence
atggagcctggaaatgacacccagatcagcgagttcctgctgctgggcttcagccaggagcccggcctgcagcccttcctgtttggcctcttcctgtccatgtacctggtgacagtgctgggcaacctgctgatcatcctggccaccatcagtgacagccacctgcacacccccatgtacttcttcctgagcaacctgagctttgctgacatctgtgtgaccagcaccaccatccccaagatgctgatgaacatccagacccagaacaaggtgatcacctacatcgcctgcctgatgcagatgtacttcttcatcctgtttgctggctttgagaacttcctgctgtctgtgatggcctatgacagatttgtggccatctgccaccccctgcactacatggtgatcatgaacccccacctgtgtggcctgctggtgctggcctcctggaccatgtctgccctgtacagcctgctgcagatcctgatggtggtgcggctgtccttctgcacagccctggagatcccccacttcttctgtgagctgaaccaggtgatccagctggcctgcagcgacagcttcctgaaccacatggtgatctacttcaccgtggccctgctgggcggcggccccctgaccggcatcctgtacagctacagcaagatcatcagcagcatccacgccatcagcagcgcccagggcaagtacaaggccttcagcacctgtgccagccacctgtctgtggtgtccctcttctacggggccatcctgggcgtgtacctgagcagcgctgccaccaggaacagccacagcagcgccacagcctctgtgatgtacacagtggtgacccccatgctgaaccccttcatctacagcctgaggaacaaggacatcaagagggccctgggcatccacctgctgtggggcaccatgaagggccagttcttcaagaagtgcccctag

SEQ ID NO: 36144 - DNA, 930 bp, Artificial Sequence
  Description of Artificial Sequence: Synthetic coding sequence
atgagggagaacaaccagagcagcaccctggagttcatcctgctgggcgtgacaggccagcaggagcaggaggacttcttctacatcctcttcctgttcatctaccccatcaccctcatcggcaacctgctgattgtgctggccatctgcagtgatgtgcggctgcacaaccccatgtacttcctgctggccaacctgagcctggtggacatcttcttcagctctgtgaccatccccaagatgctggccaaccacctgctgggcagcaagagcatcagctttggaggctgcctgacccagatgtacttcatgattgccctgggcaacacagacagctacatcctggccgccatggcctatgacagagctgtggccatcagccggcccctgcactacaccaccatcatgagccccaggagctgcatctggctgattgctggctcctgggtgattggaaatgccaatgccctgccccacaccctgctgacagccagcctgtccttctgtggcaaccaggaggtggccaacttctactgtgacatcacccccctgctgaagctgagctgcagcgacatccacttccacgtgaagatgatgtacctgggcgtgggcatcttctctgtgcccctgctgtgcatcatcgtgtcctacatccgggtcttcagcacagtgttccaggtgcccagcaccaagggcgtgctgaaggccttcagcacctgtggcagccacctgactgtggtgtccctgtactatggaacagtgatgggcacctacttccggcccctgaccaactacagcctgaaggatgctgtgatcaccgtgatgtacacagctgtgacccccatgctgaaccccttcatctacagcctgaggaacagagacatgaaggccgccctgaggaagctgttcaacaagaggatcagcagctag

SEQ ID NO: 36145 - DNA, 930 bp, Artificial Sequence
  Description of Artificial Sequence: Synthetic coding sequence
atgaagaaggagaaccagagcttcaacctggacttcatcctgctgggcgtgaccagccagcaggagcagaacaacgtgttcttcgtcatcttcctgtgcatctaccccatcaccctgaccggcaacctgctgatcatcctggccatctgtgccgacatccggctgcacaaccccatgtacttcctgctggccaacctgagcctggtggacatcatcttcagctctgtgaccatccccaaggtgctggccaaccacctgctgggcagcaagttcatcagctttggaggctgcctgatgcagatgtacttcatgattgccctggccaaggctgacagctacaccctggccgccatggcctatgacagagctgtggccatcagctgccccctgcactacaccaccatcatgagccccaggagctgcatcctgctgattgctggctcctgggtgattggcaacaccagcgccctgccccacaccctgctgacagccagcctgtccttctgtggcaaccaggaggtggccaacttctactgtgacatcatgcccctgctgaagctgagctgcagtgatgtgcacttcaacgtgaagatgatgtacctgggcgtgggcgtcttcagcctgcccctgctgtgcatcatcgtgtcctatgtgcaggtgttcagcacagtgttccaggtgcccagcaccaagagcctcttcaaggccttctgcacctgtggcagccacctgactgtggtgttcctgtactacggcaccaccatgggcatgtacttccggcccctgaccagctacagccccaaggatgctgtgatcaccgtgatgtatgtggccgtgaccccagccctgaaccccttcatctacagcctgaggaactgggacatgaaggccgccctgcagaagctgttcagcaagaggatcagcagctag

SEQ ID NO: 36146 - DNA, 957 bp, Artificial Sequence
  Description of Artificial Sequence: Synthetic coding sequence
atgatgagctttgccccaaatgccagccacagccctgtgttcctgctgctgggcttcagccgggccaacatctcctacaccctgctcttcttcctgttcctggccatctacctgaccaccatcctgggcaatgtgaccctggtgctgctgatctcctgggacagccggctgcacagccccatgtactacctgctgcggggcctgtctgtgattgacatgggcctgagcacagtgaccctgccccagctgctggcccacctggtgagccactaccccaccatcccagctgcccgctgcctggcccagttcttcttcttctacgcctttggagtgacagacaccctggtgattgctgtgatggccctggacagatatgtggccatctgtgaccccctgcactacgccctggtgatgaaccaccagagatgtgcctgcctgctggccctgtcctgggtggtgtccatcctgcacaccatgctgcgggtgggcctggtgctgcccctgtgctggacaggagatgctggaggaaatgtgaacctgccccacttcttctgtgaccaccggcccctgctgcgggccagctgcagcgacatccacagcaatgagctggccatcttctttgaaggaggcttcctgatgctgggcccctgtgccctgattgtgctgtcctatgtgagaattggagctgccatcctgcggctgcccagcgctgctggaagaagaagagctgtgtccacctgtggcagccacctgaccatggtgggcttcctgtatggcaccatcatctgtgtgtacttccagccccccttccagaacagccagtaccaggacatggtggcctctgtgatgtacacagccatcacccccctggccaacccctttgtgtacagcctgcacaacaaggatgtgaagggggccctgtgccgcctgctggagtgggtgaaggtggacccctag

SEQ ID NO: 36147 - DNA, 945 bp, Artificial Sequence
  Description of Artificial Sequence: Synthetic coding sequence
atggagaagaggaacctgactgtggtgcgggagtttgtgctgctgggcctgcccagcagcgctgagcagcagcacctgctgtctgtgctcttcctgtgcatgtacctggccaccaccctgggcaacatgctgatcatcgccaccatcggctttgacagccacctgcacagccccatgtacttcttcctgagcaacctggcctttgtggacatctgcttcaccagcaccaccgtgccccagatggtggtgaacatcctgaccggcaccaagaccatcagctttgctggctgcctgacccagctgttcttctttgtgtcctttgtgaacatggacagcctgctgctgtgtgtgatggcctatgacagatatgtggccatctgccaccccctgcactacacagccaggatgaacctgtgcctgtgtgtgcagctggtggccggcctgtggctggtgacctacctgcacgccctgctgcacacagtgctgattgcccagctgtccttctgtgccagcaacatcatccaccacttcttctgtgacctgaaccccctgctgcagctgagctgcagtgatgtgtccttcaacgtgatgatcatctttgctgtgggcggcctgctggccctgacccccctggtgtgcatcctggtgtcctatggcctcatcttcagcacagtgctgaagatcaccagcacccagggcaagcagagagctgtgtccacctgcagctgccacctgtctgtggtggtgctcttctacggcacagccatcgctgtgtacttcagccccagcagcccccacatgcctgagagtgacaccctgagcaccatcatgtacagcatggtggcccccatgctgaaccccttcatctacaccctgaggaacagagacatgaagaggggcctgcagaagatgctgctgaagtgcaccgtcttccagcagcagtag

SEQ ID NO: 36148 - DNA, 945 bp, Artificial Sequence
  Description of Artificial Sequence: Synthetic coding sequence
atgatgggccagaaccagaccagcatcagtgacttcctgctgctgggcctgcccatccagcctgagcagcagaacctgtgctacgccctcttcctggccatgtacctgaccaccctgctgggcaacctgctgatcatcgtgctgatccggctggacagccacctgcacacccccatgtacctgttcctgagcaacctgtccttcagtgacctgtgcttcagctctgtgaccatccccaagctgctgcagaacatgcagaaccaggaccccagcatcccctatgctgactgcctgacccagatgtacttcttcctgctgtttggagacctggagagcttcctgctggtggccatggcctatgacagatatgtggccatctgcttccccctgcactacacagccatcatgagccccatgctgtgcctggccctggtggccctgtcctgggtgctgaccaccttccacgccatgctgcacaccctgctgatggcccggctgtgcttctgtgccgacaacgtcatcccccacttcttctgtgacatgtctgccctgctgaagctggccttcagtgacaccagggtgaatgagtgggtgatcttcatcatgggcggcctcatcctggtgatccccttcctgctgatcctgggcagctatgccagaattgtgagcagcatcctgaaggtgcccagcagcaagggcatctgcaaggccttcagcacctgtggcagccacctgtctgtggtgtccctcttctacggcaccgtcatcggcctgtacctgtgcagcagcgccaacagcagcaccctgaaggacacagtgatggccatgatgtacacagtggtgacccccatgctgaaccccttcatctacagcctgaggaacagagacatgaagggggccctgagcagggtcatccaccagaagaagaccttcttcagcctgtag

SEQ ID NO: 36149 - DNA, 972 bp, Artificial Sequence
  Description of Artificial Sequence: Synthetic coding sequence
atgatgggccagaaccagaccagcatcagtgacttcctgctgctgggcctgcccatccagcctgagcagcagaacctgtgctacgccctcttcctggccatgtacctgaccaccctgctgggcaacctgctgatcatcgtgctgatccggctggacagccacctgcacacccctgtgtacctgttcctgagcaacctgtccttcagtgacctgtgcttcagctctgtgaccatgcccaagctgctgcagaacatgcagaaccaggaccccagcatcccctatgctgactgcctgacccagatgtacttcttcctgtacttcagtgacctggagagcttcctgctggtggccatggcctatgacagatatgtggccatctgcttccccatgcactacacagccatctgcttcctgctgcactacacagccatcatgagccccatgctgtgcctgtctgtggtggccctgtcctgggtgctgaccaccttccacgccatgctgcacaccctgctgatggcccggctgtgcttctgtgccgacaacgtcatcccccacttcttctgtgacatgtctgccctgctgaagctggcctgcagcgacaccagggtgaatgagtgggtgatcttcatcatgggcggcctcatcctggtgatccccttcctgctgatcctgggcagctatgcccgcatcgtgagcagcatcctgaaggtgcccagcagcaagggcatctgcaaggccttcagcacctgtggcagccacctgtctgtggtgtccctcttctatggaacagtgattggcctgtacctgtgccccagcgccaacagcagcaccctgaaggacacagtgatggccatgatgtacacagtggtgacccccatgctgacccccttcatctacagcctgaggaacagagacatgaagggggccctggagagggtcatctgcaagaggaagaaccccttcctgctgtag

SEQ ID NO: 36150 - DNA, 942 bp, Artificial Sequence
  Description of Artificial Sequence: Synthetic coding sequence
atggagggcaagaacctgaccagcatcagcgagtgcttcctgctgggcttcagcgagcagctggaggagcagaagcccctgtttggcagcttcctgttcatgtacctggtgacagtggccggcaacctgctgatcatcctggtgatcatcacagacacccagctgcacacccccatgtacttcttcctggccaacctgagcctggctgatgcctgctttgtgtccaccaccgtgcccaagatgctggccaacatccagatccagagccaggccatctcctacagcggctgcctgctgcagctgtacttcttcatgctgtttgtgatgctggaggccttcctgctggccgtgatggcctatgactgctacgtggccatctgccaccccctgcactacatcctgatcatgagccctggcctgtgcatcttcctggtgtctgcctcctggatcatgaatgccctgcacagcctgctgcacaccctgctgatgaacagcctgtccttctgtgccaaccacgagatcccccacttcttctgtgacatcaaccccctgctgagcctgagctgcacagaccccttcaccaatgagctggtgatcttcatcaccggcggcctgaccggcctcatctgtgtgctgtgcctgatcatctcctacaccaacgtgttcagcaccatcctgaagatccccagcgcccagggcaagaggaaggccttcagcacctgcagcagccacctgtctgtggtgtccctcttcttcggcaccagcttctgtgtggacttcagcagccccagcacccacagcgcccagaaggacacagtggcctctgtgatgtacacagtggtgacccccatgctgaaccccttcatctacagcctgaggaaccaggagatcaagagcagcctgaggaagctgatctgggtgaggaagatccacagcccctag

SEQ ID NO: 36151 - DNA, 1611 bp, Artificial Sequence
  Description of Artificial Sequence: Synthetic coding sequence
atggccgagcacgccccccggcgctgctgcctgggctgggacttcagcacccagcaggtgaaggtggtggccgtggatgctgagctgaatgtgttctatgaggagagcgtgcactttgaccgggacctgcctgagtttggcacccagggcggcgtgcacgtgcacaaggatggcctgactgtgaccagccctgtgctgatgtgggtgcaggccctggacatcatcctggagaagatgaaggccagcggctttgacttcagccaggtgctggccctgtctggagctggccagcagcacggcagcatctactggaaggccggggcccagcaggccctgaccagcctgagcccagacctgcggctgcaccagcagctgcaggactgcttcagcatcagtgactgccctgtgtggatggacagcagcaccacagcccagtgccggcagctggaggccgctgtgggcggggcccaggccctgagctgcctgaccggcagccgggcctatgagcgcttcaccggcaaccagatcgccaagatctaccagcagaaccctgaggcctacagccacacagagcgcatcagcctggtgagcagctttgctgccagcctcttcctgggcagctacagccccatcgactacagtgatggcagcggcatgaacctgctgcagatccaggacaaggtgtggagccaggcctgcctgggcgcctgtgccccccacctggaggagaagctgagcccccctgtgcccagctgcagcgtggtgggcgccatcagcagctactacgtgcagagatatggcttccccccaggctgcaaggtggtggccttcaccggggacaacccagccagcctggccggcatgaggctggaggagggggacattgctgtgtccctgggcaccagtgacaccctcttcctgtggctgcaggagcccatgcctgccctggagggccacatcttctgcaaccctgtggacagccagcactacatggccctgctgtgcttcaagaatggcagcctgatgagggagaagatcagaaatgaatctgtgagccgctcctggagcgacttcagcaaggccctgcagagcacagagatgggaaatggaggcaacctgggcttctactttgatgtgatggagatcaccccagagatcatcggccgccaccgcttcaacacagagaaccacaaggtggccgccttccctggagatgtggaggtgcgggccctgattgagggccagttcatggccaagagaattcatgctgagggcctgggctacagagtgatgagcaagaccaagatcctggccactggaggagccagccacaaccgggagatcctgcaggtgctggctgatgtgtttgatgcccctgtgtatgtgattgacacagccaacagcgcctgtgtgggcagcgcctaccgggccttccacggcctggccggcggcacagatgtgcccttcagcgaggtggtgaagctggcccccaacccccggctggccgccacccccagccctggggccagccaggtgtatgaggccctgctgccccagtatgccaagctggagcagaggatcctgagccagacccggggccccccagagtag

SEQ ID NO: 36152 - DNA, 969 bp, Artificial Sequence
  Description of Artificial Sequence: Synthetic coding sequence
atgagccctgagaaccagagctctgtgtctgagttcctgctgctgggcctgcccatccggcctgagcagcaggccgtgttctttgccctcttcctgggcatgtacctgaccaccgtgctgggcaacctgctgatcatgctgctgatccagctggacagccacctgcacacccccatgtacttcttcctgagccacctggccctgacagacatctccttcagctctgtgacagtgcccaagatgctgatgaacatgcagacccagcacctggccgtgttctacaagggctgcatcagccagacctacttcttcatcttctttgctgacctggacagcttcctgatcacctccatggcctatgacagatatgtggccatctgccaccccctgcactacgccaccatcatgacccagagccagtgtgtgatgctggtggccggctcctgggtgattgcctgtgcctgtgccctgctgcacaccctgctgctggcccagctgtccttctgtgccgaccacatcatcccccactacttctgtgacctgggcgccctgctgaagctgagctgcagcgacaccagcctgaaccagctggccatcttcaccgctgccctgacagccatcatgctgcccttcctgtgcatcctggtgtcctatggccacatcggcgtgaccatcctgcagatccccagcaccaagggcatctgcaaggccctgagcacctgtggcagccacctgtctgtggtgaccatctactaccgcaccatcatcggcctgtacttcctgccccccagcagcaacaccaatgacaagaacatcatcgccagcgtcatctacacagctgtgacccccatgctgaaccccttcatctacagcctgaggaacaaggacatcaagggggccctgaggaagctgctgagccgcagcggggctgtggcccacgcctgcaacctgaacaccctgggcggctag

SEQ ID NO: 36153 - DNA, 942 bp, Artificial Sequence
  Description of Artificial Sequence: Synthetic coding sequence
atgagccctgagaaccagagctctgtgtctgagttcctgctgctgggcctgcccatccggcctgagcagcaggccgtgttcttcaccctcttcctgggcatgtacctgaccaccgtgctgggcaacctgctgatcatgctgctgatccagctggacagccacctgcacacccccatgtacttcttcctgagccacctggccctgacagacatctccttcagctctgtgacagtgcccaagatgctgatggacatgaggaccaagtacaagagcatcctgtatgaggagtgcatcagccagatgtacttcttcatcttcttcacagacctggacagcttcctgatcacctccatggcctatgacagatatgtggccatctgccaccccctgcactacaccgtcatcatgagggaggagctgtgtgtgttcctggtggccgtgtcctggatcctgagctgtgccagcagcctgagccacaccctgctgctgacccggctgtccttctgtgccgccaacaccatcccccacgtgttctgtgacctggccgccctgctgaagctgagctgcagcgacatcttcctgaatgagctggtgatgttcaccgtgggcgtggtggtgatcaccctgcccttcatgtgcatcctggtgtcctatggctacatcggggccaccatcctgcgggtgcccagcaccaagggcatccacaaggccctgagcacctgtggcagccacctgtctgtggtgtccctgtactacggcagcatcttcggccagtacctgttccccaccgtgagcagcagcattgacaaggatgtgattgtggccctgatgtacacagtggtgacccccatgctgaaccccttcatctacagcctgaggaacagagacatgaaggaggccctgggcaagctgttcagccgggccaccttcttctcctggtag

SEQ ID NO: 36154 - DNA, 942 bp, Artificial Sequence
  Description of Artificial Sequence: Synthetic coding sequence
atgagccctgagaaccagagctctgtgtctgagttcctgctgctgggcctgcccatccggcctgagcagcaggccgtgttcttcaccctcttcctgggcatgtacctgaccaccgtgctgggcaacctgctgatcatgctgctgatccagctggacagccacctgcacacccccatgtacttcttcctgagccacctggccctgacagacatctccttcagctctgtgacagtgcccaagatgctgatggacatgaggaccaagtacaagagcatcctgtatgaggagtgcatcagccagatgtacttcttcatcttcttcacagacctggacagcttcctgatcacctccatggcctatgacagatatgtggccatctgccaccccctgcactacaccgtcatcatgagggaggagctgtgtgtgttcctggtggccgtgtcctggatcctgagctgtgccagcagcctgagccacaccctgctgctgacccggctgatgaagcgggagaaccagagctctgtgtctgagttcctgctgctggacctgcccatctggccagagcagcaggccgtgttcttcaccctcttcctgggcatgtacctgatcaccgtgctgggcaacctgctgatcatcctgctgatccggctggacagccacctgcacacccccatgttcttcttcctgagccacctggccctgacagacatcagcctgagctctgtgacagtgcccaagatgctgctgtccatgcagacccaggaccagagcatcctgtatgccggctgtgtgacccagatgtacttcttcatcttcttcacagacctggacaacttcctgctgacctccatggcctatgacagatatgtggccatctgccaccccctgcgctacaccaccatcatgaaggagggcctgtgcaacctgctggtgacagtgtag

SEQ ID NO: 36155 - DNA, 942 bp, Artificial Sequence
  Description of Artificial Sequence: Synthetic coding sequence
atgaagcgggagaaccagagctctgtgtctgagttcctgctgctggacctgcccatctggccagagcagcaggccgtgttcttcaccctcttcctgggcatgtacctgatcaccgtgctgggcaacctgctgatcatcctgctgatccggctggacagccacctgcacacccccatgttcttcttcctgagccacctggccctgacagacatcagcctgagctctgtgacagtgcccaagatgctgctgtccatgcagacccaggaccagagcatcctgtatgccggctgtgtgacccagatgtacttcttcatcttcttcacagacctggacaacttcctgctgacctccatggcctatgacagatatgtggccatctgccaccccctgcgctacaccaccatcatgaaggagggcctgtgcaacctgctggtgacagtgtcctggatcctgagctgcaccaatgccctgagccacaccctgctgctggcccagctgtccttctgtgccgacaacaccatcccccacttcttctgtgacctggtggccctgctgaagctgagctgcagcgacatcagcctgaatgagctggtgatcttcaccgtgggccaggccgtcatcaccctgcccctcatctgcatcctgatctcctatggccacatcggcgtgaccatcctgaaggcccccagcaccaagggcatcttcaaggccctgagcacctgtggcagccacctgtctgtggtgtccctgtactacggcaccatcatcggcctgtacttcctgcccagcagcagcgccagcagtgacaaggatgtgattgcctctgtgatgtacaccgtcatcacccccctgctgaaccccttcatctacagcctgaggaacagagacatcaagggggccctggagcggctcttcaacagagccaccgtgctgagccagtag

SEQ ID NO: 36156 - DNA, 951 bp, Artificial Sequence
  Description of Artificial Sequence: Synthetic coding sequence
atggaggccgccaatgaaagcagcgagggcatcagctttgtgctgctgggcctgaccaccagccctggccagcagaggcccctgtttgtgctcttcctgctgctgtatgtggccagcctgctgggcaatggcctcatcgtggccgccatccaggccagccctgccctgcacgcccccatgtacttcctgctggcccacctgagctttgctgacctgtgctttgcctctgtgacagtgcccaagatgctggccaacctgctggcccatgaccacagcatcagcctggccggctgcctgacccagatgtacttcttctttgccctgggcgtgacagacagctgcctgctggccgccatggcctatgactgctacgtggccatccgccaccccctgccctatgccaccaggatgagccgggccatgtgtgccgccctggtgggcatggcctggctggtgagccacgtgcacagcctgctgtacatcctgctgatggcccggctgtccttctgtgccagccaccaggtgccccacttcttctgtgaccaccagcccctgctgcggctgagctgcagcgacacccaccacatccagctgctgatcttcacagagggcgctgctgtggtggtgacccccttcctgctgatcctggccagctatggagccatcgctgctgctgtgctgcagctgcccagcgccagcggccgcctgcgggctgtgtccacctgtggcagccacctggccgtggtgtccctcttctatggaacagtgattgctgtgtacttccaggccaccagccggcgggaggccgagtggggccgggtggccaccgtgatgtacacagtggtgacccccatgctgaaccccatcatctacagcctgtggaacagagatgtgcagggcgccctgcgggccctgctgattggaagacgcatcagcgccagtgacagctag

SEQ ID NO: 36157 - DNA, 933 bp, Artificial Sequence
  Description of Artificial Sequence: Synthetic coding sequence
atgggcaggaacaacctgacccggcccagcgagttcatcctgctgggcctgagcagcaggcctgaggaccagaagcccctgtttgctgtgttcctgcccatctacctgatcaccgtcatcggcaacctgctgatcatcctggccatccgcagtgacacccggctgcagacccccatgtacttcttcctgagcatcctgagctttgtggacatctgctacgtgaccgtcatcatccccaagatgctggtgaacttcctgtctgagaccaagaccatctcctacagcgagtgcctgacccagatgtacttcttcctggcctttggaaacacagacagctacctgctggccgccatggccatcgacagatatgtggccatctgcaaccccttccactacatcaccatcatgagccaccgctgctgcgtgctgctgctggtgctgtccttctgcatcccccacttccacagcctgctgcacatcctgctgaccaaccagctgatcttctgtgccagcaatgtcatccaccacttcttctgtgatgaccagcctgtgctgaagctgagctgcagcagccactttgtgaaggagatcaccgtgatgacagagggcctggccgtcatcatgacccccttcagctgcatcatcatctcctacctgcgcatcctgatcaccgtgctgaagatccccagcgctgctgggaagaggaaggccttcagcacctgtggcagccacctgactgtggtgaccctcttctacggcagcatctcctacctgtacttccagcccctgagcaactacacagtgaaggaccagatcgccaccatcatctacacagtgctgacccccatgctgaaccccttcatctacagcctgaggaacaaggacatgaagcagggcctggccaagctgatgcacaggatgaagtgccagtag

SEQ ID NO: 36158 - DNA, 1083 bp, Artificial Sequence
  Description of Artificial Sequence: Synthetic coding sequence
atggagaggaaccacaacccagacaactgcaatgtgctgaacttcttctttgctgacaagaagaacaagagaagaaactttggccagatcgtgtctgatgtgggccgcatctgctacagcgtgtccctgagcctgggggagcccaccaccatgggcaggaacaacctgacccggcccagcgagttcatcctgctgggcctgagcagcaggcctgaggaccagaagcccctgtttgctgtgttcctgcccatctacctgatcaccgtcatcggcaacctgctgatcatcctggccatccgcagtgacacccggctgcagacccccatgtacttcttcctgagcatcctgagctttgtggacatctgctacgtgaccgtcatcatccccaagatgctggtgaacttcctgtctgagaccaagaccatctcctacagcgagtgcctgacccagatgtacttcttcctggcctttggaaacacagacagctacctgctggccgccatggccatcgacagatatgtggccatctgcaaccccttccactacatcaccatcatgagccaccgctgctgcgtgctgctgctggtgctgtccttctgcatcccccacttccacagcctgctgcacatcctgctgaccaaccagctgatcttctgtgccagcaatgtcatccaccacttcttctgtgatgaccagcctgtgctgaagctgagctgcagcagccactttgtgaaggagatcaccgtgatgacagagggcctggccgtcatcatgacccccttcagctgcatcatcatctcctacctgcgcatcctgatcaccgtgctgaagatccccagcgctgctgggaagaggaaggccttcagcacctgtggcagccacctgactgtggtgaccctcttctacggcagcatctcctacctgtacttccagcccctgagcaactacacagtgaaggaccagatcgccaccatcatctacacagtgctgacccccatgctgaaccccttcatctacagcctgaggaacaaggacatgaagcagggcctggccaagctgatgcacaggatgaagtgccagtag

SEQ ID NO: 36159 - DNA, 975 bp, Artificial Sequence
  Description of Artificial Sequence: Synthetic coding sequence
atgggcatgagcaacctgacccggctgtctgagttcatcctgctgggcctgagcagccgctctgaggaccagaggcccctgtttgccctcttcctgatcatctacctggtgaccctgatgggcaacctgctgatcatcctggccatccacagcgacccccggctgcagaaccccatgtacttcttcctgagcatcctgagctttgctgacatctgctacaccaccgtgattgtgcccaagatgctggtgaacttcctgtctgagaagaagaccatctcctatgcagagtgcctggcccagatgtacttcttcctggtgtttggaaacatcgacagctacctgctggccgccatggccatcaacagatgtgtggccatctgcaaccccttccactacgtgacagtgatgaacagacgctgctgcgtgctgctgctggccttccccatcaccttctcctacttccacagcctgctgcacgtgctgctggtgaaccggctgaccttctgcaccagcaatgtcatccaccacttcttctgtgatgtgaaccctgtgctgaagctgagctgcagcagcacctttgtgaatgaaattgtggccatgacagagggcctggcctctgtgatggccccctttgtgtgcatcatcatctcctacctgcgcatcctgattgctgtgctgaagatccccagcgctgctgggaagcacaaggccttcagcacctgcagcagccacctgactgtggtgatcctcttctacggcagcatctcctatgtgtacctgcagcccctgagcagctacacagtgaaggaccgcatcgccaccatcaactacacagtgctgacctctgtgctgaaccccttcatctacagcctgaggaacaaggacatgaagaggggcctgcagaagctgatcaacaagatcaagagccagatgagccgcttcagcaccaagaccaacaagatctgtggcccctag

SEQ ID NO: 36160 - DNA, 936 bp, Artificial Sequence
  Description of Artificial Sequence: Synthetic coding sequence
atggagaccaagaactacagcagcagcaccagcggcttcatcctgctgggcctgagcagcaaccccaagctgcagaagcccctgtttgccatcttcctgatcatgtacctgctgacagctgtgggcaatgtgctgatcatcctggccatctacagcgacccccggctgcacacccccatgtacttcttcctgagcaacctgtccttcatggacatctgcttcaccaccgtcatcgtgcccaagatgctggtgaacttcctgtctgagaccaagatcatctcctatgtgggctgcctgatccagatgtacttcttcatggccttcggcaacacagacagctacctgctggcctccatggccatcgaccggctggtggccatctgcaaccccctgcactatgatgtggtgatgaagccctggcactgcctgctgatgctgctgggcagctgcagcatcagccacctgcacagcctcttccgggtgctgctgatgagccggctgtccttctgtgccagccacatcatcaagcacttcttctgtgacacccagcctgtgctgaagctgagctgcagcgacaccagcagcagccagatggtggtgatgacagagaccctggccgtcatcgtgacccccttcctgtgcaccatcttctcctacctgcagatcatcgtgacagtgctgcgcatccccagcgctgctgggaagtggaaggccttcagcacctgtggcagccacctgactgtggtggtgctcttctacggcagcgtcatctacgtgtacttccggcccctgtccatgtacagcgtgatgaagggccgggtggccaccgtgatgtacacagtggtgacccccatgctgaaccccttcatctacagcctgaggaacaaggacatgaagaggggcctgaagaagctgcggcaccgcatctacagctag

SEQ ID NO: 36161 - DNA, 936 bp, Artificial Sequence
  Description of Artificial Sequence: Synthetic coding sequence
atggagatcaagaactacagcagcagcaccagcggcttcatcctgctgggcctgagcagcaacccccagctgcagaagcccctgtttgccatcttcctgatcatgtacctgctggccgctgtgggcaatgtgctgatcatcccagccatctacagcgacccccggctgcacacccccatgtacttcttcctgagcaacctgtccttcatggacatctgcttcaccaccgtcatcgtgcccaagatgctggtgaacttcctgtctgagaccaaggtgatctcctatgtgggctgcctggcccagatgtacttcttcatggccttcggcaacacagacagctacctgctggcctccatggccatcgaccggctggtggccatctgcaaccccctgcactatgatgtggtgatgaagcccaggcactgcctgctgatgctgctgggcagctgcagcatcagccacctgcacagcctcttccgggtgctgctgatgagccggctgtccttctgtgccagccacatcatcaagcacttcttctgtgacacccagcctgtgctgaagctgagctgcagcgacaccagcagcagccagatggtggtgatgacagagaccctggccgtcatcgtgacccccttcctgtgcatcatcttctcctacctgcgcatcatggtgacagtgctgcgcatccccagcgctgctgggaagtggaaggccttcagcacctgtggcagccacctgacagctgtggccctcttctacggcagcatcatctacgtgtacttccggcccctgtccatgtacagcgtggtgcgggacagagtggccaccgtgatgtacacagtggtgacccccatgctgaaccccttcatctacagcctgaggaacaaggacatgaagaggggcctgaagaagctgcaggaccgcatctacagatag

SEQ ID NO: 36162 - DNA, 1044 bp, Artificial Sequence
  Description of Artificial Sequence: Synthetic coding sequence
atgagctacttctaccgcctgaagctgatgaaggaggccgtgctggtgaagctgcccttcaccagcctgcccctgctgctgcagaccctgagcaggaagagccgggacatggagatcaagaactacagcagcagcaccagcggcttcatcctgctgggcctgagcagcaacccccagctgcagaagcccctgtttgccatcttcctgatcatgtacctgctggccgctgtgggcaatgtgctgatcatcccagccatctacagcgacccccggctgcacacccccatgtacttcttcctgagcaacctgtccttcatggacatctgcttcaccaccgtcatcgtgcccaagatgctggtgaacttcctgtctgagaccaaggtgatctcctatgtgggctgcctggcccagatgtacttcttcatggccttcggcaacacagacagctacctgctggcctccatggccatcgaccggctggtggccatctgcaaccccctgcactatgatgtggtgatgaagcccaggcactgcctgctgatgctgctgggcagctgcagcatcagccacctgcacagcctcttccgggtgctgctgatgagccggctgtccttctgtgccagccacatcatcaagcacttcttctgtgacacccagcctgtgctgaagctgagctgcagcgacaccagcagcagccagatggtggtgatgacagagaccctggccgtcatcgtgacccccttcctgtgcatcatcttctcctacctgcgcatcatggtgacagtgctgcgcatccccagcgctgctgggaagtggaaggccttcagcacctgtggcagccacctgacagctgtggccctcttctacggcagcatcatctacgtgtacttccggcccctgtccatgtacagcgtggtgcgggacagagtggccaccgtgatgtacacagtggtgacccccatgctgaaccccttcatctacagcctgaggaacaaggacatgaagaggggcctgaagaagctgcaggaccgcatctacagatag

SEQ ID NO: 36163 - DNA, 930 bp, Artificial Sequence
  Description of Artificial Sequence: Synthetic coding sequence
atggagcgcatcaaccacaccagctctgtgtctgagttcatcctgctgggcctgagcagcaggcctgaggaccagaagaccctgtttgtgctcttcctgattgtgtacctggtgaccatcactggaaacctgctgatcatcctggccatccgcttcaacccccacctgcagacccccatgtacttcttcctgtccttcctgagcctgacagacatctgcttcaccacctctgtggtgcccaagatgctgatgaacttcctgtctgagaagaagaccatctcctatgccggctgcctgacccagatgtacttcctgtatgccctgggcaacagcgacagctgcctgctggccgtgatggcctttgaccgctacgtggccgtgtgtgaccccttccactacgtgaccaccatgagccaccaccactgtgtgctgctggtggccttcagctgcagcttcccccacctgcacagcctgctgcacaccctgctgctgaaccggctgaccttctgtgacagcaatgtcatccaccacttcctgtgtgacctgagccctgtgctgaagctgagctgcagcagcatctttgtgaatgagatcgtgcagatgacagaggcccccatcgtgctggtgacccgcttcctgtgcatcgccttctcctacatccgcatcctgaccaccgtgctgaagatccccagcaccagcggcaagaggaaggccttcagcacctgtggcttctacctgactgtggtgaccctcttctacggcagcatcttctgtgtgtacctgcagccccccagcacctatgctgtgaaggaccacgtggccaccatcgtgtacacagtgctgagctccatgctgaaccccttcatctacagcctgaggaacaaggacctgaagcagggcctgaggaagctgatgagcaagaggagctag

SEQ ID NO: 36164 - DNA, 951 bp, Artificial Sequence
  Description of Artificial Sequence: Synthetic coding sequence
atcacccccatggagcccaggaaccagaccagcgccagccagttcatcctgctgggcctgtctgagaagccagagcaggagaccctgctcttcagcctcttcttctgcatgtacctggtgatggtggtgggcaacctgctgatcatcctggccatcagcattgacagccacctgcacacccccatgtacttcttcctggccaacctgagcctggtggacttctgcctggccaccaacaccatccccaagatgctggtgtccctgcagacaggcagcaaggccatctcctacccctgctgcctgatccagatgtacttcttccacttcttcggcatcgtggacagcgtcatcatcgccatgatggcctatgacagatttgtggccatctgccaccccctgcactacgccaagatcatgagcctgcggctgtgccgcctgctggtgggcgccctgtgggccttcagctgcttcatcagcctgacccacatcctgctgatggcccggctggtgttctgtggcagccatgaggtgccccactacttctgtgacctgacccccatcctgcggctgagctgcacagacacctctgtgaaccgcatcttcatcctgattgtggccggcatggtgattgccaccccatttgtgtgcatcctggccagctatgcccgcatcctggtggccatcatgaaggtgcccagcgctgggggcaggaagaaggccttcagcacctgcagcagccacctgtctgtggtggccctcttctacggcaccaccatcggcgtgtacctgtgccccagctctgtgctgaccaccgtgaaggagaaggccagcgctgtgatgtacacagctgtgacccccatgctgaaccccttcatctacagcctgaggaacagagacctgaagggggccctgaggaagctggtgaacaggaagatcaccagcagcagctag

SEQ ID NO: 36165 - DNA, 942 bp, Artificial Sequence
  Description of Artificial Sequence: Synthetic coding sequence
atggagcccaggaaccagaccagcgccagccagttcatcctgctgggcctgtctgagaagccagagcaggagaccctgctcttcagcctcttcttctgcatgtacctggtgatggtggtgggcaacctgctgatcatcctggccatcagcattgacagccacctgcacacccccatgtacttcttcctggccaacctgagcctggtggacttctgcctggccaccaacaccatccccaagatgctggtgtccctgcagacaggcagcaaggccatctcctacccctgctgcctgatccagatgtacttcttccacttctttggaattgtggacagcgtcatcatcgccatgatggcctatgacagatttgtggccatctgccaccccctgcactacgccaagatcatgagcctgcggctgtgccgcctgctggtgggcgccctgtgggccttcagctgcttcatcagcctgacccacatcctgctgatggcccggctggtgttctgtggcagccatgaggtgccccactacttctgtgacctgacccccatcctgcggctgagctgcacagacacctctgtgaaccgcatcttcatcctgattgtggccggcatggtgattgccaccccatttgtgtgcatcctggccagctatgcccgcatcctggtggccatcatgaaggtgcccagcgctgggggcaggaagaaggccttcagcacctgcagcagccacctgtctgtggtggccctcttctacggcaccaccatcggcgtgtacctgtgccccagctctgtgctgaccaccgtgaaggagaaggccagcgctgtgatgtacacagctgtgacccccatgctgaaccccttcatctacagcctgaggaacagagacctgaagggggccctgaggaagctggtgaacaggaagatcaccagcagcagctag

SEQ ID NO: 36166 - DNA, 936 bp, Artificial Sequence
  Description of Artificial Sequence: Synthetic coding sequence
atggagaaccagagcagcatcagcgagttcttcctgcggggcatcagcgcccctcctgagcagcagcagagcctgtttggcatcttcctgtgcatgtacctggtgaccctgaccggcaacctgctgatcatcctggccatcggcagtgacctgcacctgcacacccccatgtacttcttcctggccaacctgagctttgtggacatgggcctgaccagcagcacagtgaccaagatgctggtgaacatccagaccaggcaccacaccatctcctacacaggctgcctgacccagatgtacttcttcctgatgtttggagacctggacagcttcttcctggccgccatggcctatgacagatatgtggccatctgccaccccctgtgctacagcacagtgatgaggccccaggtgtgtgccctgatgctggccctgtgctgggtgctgaccaacatcgtggccctgacccacaccttcctgatggcccggctgtccttctgtgtgactggagagatcgcccacttcttctgtgacatcacccctgtgctgaagctgagctgcagcgacacccacatcaatgagatgatggtgtttgtgctgggcggcaccgtgctgattgtgcccttcctgtgcatcgtgaccagctacatccacatcgtgcctgccatcctgcgggtgaggacccggggcggcgtgggcaaggccttcagcacctgcagcagccacctgtgtgtggtgtgtgtgttctacggcaccctcttcagcgcctacctgtgcccccccagcatcgccagcgaggagaaggacattgctgctgctgccatgtacaccatcgtgacccccatgctgaaccccttcatctacagcctgaggaacaaggacatgaagggggccctgaagaggctcttcagccacaggagcatcgtgagcagctag

SEQ ID NO: 36167 - DNA, 993 bp, Artificial Sequence
  Description of Artificial Sequence: Synthetic coding sequence
atggagggcttctacctgcggcgcagccatgagctgcagggcatgggcaagccaggccgggtgaaccagaccaccgtgtctgacttcctgctgctgggcctgtctgagtggccagaggagcagcccctgctgtttggcatcttcctgggcatgtacctggtgaccatggtgggcaacctgctgatcatcctggccatcagcagtgacccccacctgcacacccccatgtacttcttcctggccaacctgagcctgacagatgcctgcttcaccagcgccagcatccccaagatgctggccaacatccacacccagagccagatcatctcctacagcggctgcctggcccagctgtacttcctgctgatgtttggaggcctggacaactgcctgctggccgtgatggcctatgaccgctacgtggccatctgccagcccctgcactacagcacctccatgagcccccagctgtgtgccctgatgctgggcgtgtgctgggtgctgaccaactgcccagccctgatgcacaccctgctgctgaccagggtggccttctgtgcccagaaggccatcccccacttctactgtgaccccagcgccctgctgaagctggcctgcagcgacacccacgtgaatgagctgatgatcatcaccatgggcctgctcttcctgactgtgcccctgctgctgattgtgttctcctatgtgcgcatcttctgggccgtgtttgtgatcagcagccctgggggccgctggaaggccttcagcacctgtggcagccacctgactgtggtgctgctcttctacggcagcctgatgggcgtgtacctgctgccccccagcacctacagcacagagcgggagagcagagctgctgtgctgtacatggtgatcatccccaccctgaaccccttcatctacagcctgaggaacagagacatgaaggaggccctgggcaagctgtttgtgtctgggaagaccttcttcctgtag

SEQ ID NO: 36168 - DNA, 945 bp, Artificial Sequence
  Description of Artificial Sequence: Synthetic coding sequence
atggacaacagcaactggacctctgtgagccactttgtgctgctgggcatcagcacccaccctgaggagcagatccccctcttcctggtgttcagcctgatgtatgccatcaacatcagcggcaacctggccatcatcaccctcatcctgagcgccccccggctgcacatccccatgtacatcttcctgagcaacctggccctgacagacatctgcttcaccagcaccaccgtgcccaagatgctgcagatcatcttcagccccaccaaggtgatctcctacacaggctgcctggcccagacctacttcttcatctgctttgctgtgatggagaacttcatcctggccgtgatggcctatgaccgctacatcgccatctgccaccccttccactacaccatgatcctgaccaggatgctgtgtgtgaagatggtggtgatgtgccacgccctgagccacctgcacgccatgctgcacaccttcctgattggccagctgatcttctgtgccgacaaccgcatcccccacttcttctgtgacctgtatgccctgatgaagatcagctgcaccagcacctacctgaacaccctgatgatccacacagaaggagctgtggtgatcagcggggccctggccttcatcacagccagctatgcctgcatcatcctggtggtgctgcgcatccccagcgccaagggccgctggaagaccttcagcacctgtggcagccacctgactgtggtggccatcttctacggcaccctgtcctgggtgtacttccggcccctgagcagctacagcgtgaccaagggccgcatcatcaccgtggtgtacacagtggtgacccccatgctgaaccccttcatctacagcctgagaaatggagatgtgaagggcggcttcatgaagtggatgagcaggatgcagaccttcttcttcagatag

SEQ ID NO: 36169 - DNA, 978 bp, Artificial Sequence
  Description of Artificial Sequence: Synthetic coding sequence
atgaagaccttcagcagcttcctgcagatcggcaggaacatgcaccagggcaaccagaccaccatcacagagttcatcctgctgggcttcttcaagcaggatgagcaccagaacctgctgtttgtgctcttcctgggcatgtacctggtgacagtgattggaaatggcctcatcatcgtggccatcagcctggacacctacctgcacacccccatgtacctgttcctggccaacctgagctttgctgacatcagcagcatcagcaacagcgtgcccaagatgctggtgaacatccagaccaagagccagagcatctcctatgagagctgcatcacccagatgtacttcagcatcgtgtttgtggtgattgacaacctgctgctgggcaccatggcctatgaccactttgtggccatctgccaccccctgaactacaccatcctgatgaggcccaggtttggcatcctgctgaccgtcatctcctggttcctgagcaacatcatcgccctgacccacaccctgctgctgatccagctgctcttctgcaaccacaacaccctgccccacttcttctgtgacctggcccccctgctgaagctgagctgcagcgacaccctcatcaatgagctggtgctcttcatcgtgggcctgagcgtcatcatcttccccttcaccctgtccttcttctcctatgtgtgcatcatccgggctgtgctgcgggtgagcagcacccagggcaagtggaaggccttcagcacctgtggcagccacctgactgtggtgctgctcttctacggcaccatcgtgggcgtgtacttcttccccagcagcacccaccctgaggacacagacaagatcggggctgtgctcttcaccgtggtgacccccatgatcaaccccttcatctacagcctgaggaacaaggacatgaagggggccctgaggaagctgatcaacaggaagatcagcagcctgtag

SEQ ID NO: 36170 - DNA, 978 bp, Artificial Sequence
  Description of Artificial Sequence: Synthetic coding sequence
atgaagaccctgtgcagcttcctgcagatcagcaggaacatgcaccaggagaaccagaccaccatcacagagttcatcctgctgggcctgagcaaccaggccgagcaccagaacctgctgtttgtgctcttcctgtccatgtatgtggtgacagtggtgggcaatggcctcatcatcgtggccatcagcctggacatctacctgcacacccccatgtacctgttcctggcctacctgagctttgctgacatcagcagcatcagcaacagcgtgcccaagatgctggtgaacatccagaccaacagccagagcatctcctatgagagctgcatcacccagatgtacttcagcatcgtgtttgtggtgacagacaacctgctgctgggcaccatggcctttgaccactttgtggccatctgccaccccctgaactacaccaccttcatgagggccaggtttggcaccctgctgaccgtcatctcctggttcctgagcaacatcatcgccctgacccacaccctgctgctgatccagctgctcttctgtgaccacaacaccctgccccacttcttctgtgacctggcccccctgctgaagctgagctgcagcgacaccatgatcaatgagctggtgctcttcatcgtgggcctgagcgtcatcatcttcccctttgtgctgatcttcttctcctatgtgtgcatcatccgggctgtgctgggcgtgagcagcacccagggcaagtggaaggccttcagcacctgtggcagccacctgaccatcgccctgctcttctacggcaccaccgtgggcgtgtacttcttccccagcagcacccaccctgaggacacagacaagatcggggctgtgctcttcaccgtggtgacccccatgatgaaccccttcatctacagcctgaggaacaaggacatgaagggggccctgaggaagctgatcaacaggaagatcagcagcctgtag

SEQ ID NO: 36171 - DNA, 912 bp, Artificial Sequence
  Description of Artificial Sequence: Synthetic coding sequence
atgtccttcagcagcctgcccacagagatccagagcctgctcttcctgaccttcctgaccatctacctggtgaccctgatgggcaactgcctgatcatcctggtgaccctggccgaccccatgctgcacagccccatgtacttcttcctgaggaacctgtccttcctggagatcggcttcaacctggtgattgtgcccaagatgctgggcaccctgctggcccaggacaccaccatctccttcctgggctgtgccacccagatgtacttcttcttcttcttcggcgtggccgagtgcttcctgctggccaccatggcctatgaccgctacgtggccatctgcagccccctgcactaccctgtgatcatgaaccagaggacccgggccaagctggccgccgcctcctggttccctggcttccctgtggccaccgtgcagaccacctggctgttctccttccccttctgtggcaccaacaaggtgaaccacttcttctgtgacagcccccctgtgctgcggctggtgtgtgccgacacagccctgtttgagatctatgccatcgtgggcaccatcctggtggtgatgatcccctgcctgctgatcctgtgcagctacacccacatcgccgccgccatcctgaagatccccagcgccaagggcaagaacaaggccttcagcacctgcagcagccacctgctggtggtgtccctcttctacatcagcctgagcctgacctacttccggcccaagagcaacaacagccctgagggcaagaagctgctgagcctgagctacacagtgatgacccccatgctgaaccccatcatctacagcctgaggaacaatgaggtgaagaatgccctgagcaggacagtgtccaaggccctggccctgaggaactgcatcccctag

SEQ ID NO: 36172 - DNA, 945 bp, Artificial Sequence
  Description of Artificial Sequence: Synthetic coding sequence
atgaagaggcagaaccagagctgtgtggtggagttcatcctgctgggcttcagcaacttccctgagctgcaggtgcagctgtttggagtcttcctggtgatctacgtggtgaccctgatgggaaatgccatcatcaccgtcatcatcagcctgaaccagagcctgcacgtgcccatgtacctgttcctgctgaacctgtctgtggtggaggtgtccttctctgctgtgatcaccccagagatgctggtggtgctgagcacagagaagaccatgatcagctttgtgggctgctttgcccagatgtacttcatcctgctgtttggaggaacagagtgcttcctgctgggcgccatggcctatgacagatttgctgccatctgccaccccctgaactaccctgtgatcatgaacagaggagtcttcatgaagctggtgatcttctcctggatcagcggcatcatggtggccaccgtgcagaccacctgggtgttctccttccccttctgtggccccaatgagatcaaccacctgttctgtgagaccccacctgtgctggagctggtgtgtgccgacaccttcctgtttgagatctatgccttcaccggcaccatcctgattgtgatggtgcccttcctgctgatcctgctgagctacatccgggtgctgtttgccatcctgaagatgcccagcaccaccggccggcagaaggccttcagcacctgtgccagccacctgacctctgtgaccctcttctacggcacagccaacatgacctacctgcagcccaagagcggctacagccctgagaccaagaagctgatcagcctggcctacaccctgctgacccccctgctgaaccccctcatctacagcctgagaaattctgagatgaagaggaccctcatcaagctgtggaggaggaaggtgatcctgcacaccttctag

SEQ ID NO: 36173 - DNA, 948 bp, Artificial Sequence
  Description of Artificial Sequence: Synthetic coding sequence
atgatgtgggagaactggaccatcgtgtctgaatttgtgctggtgtccttcagcgccctgagcacagagctgcaggccctgctcttcctgctcttcctgaccatctacctggtgaccctgatgggaaatgtgctgatcatcctggtgaccatcgctgacagcgccctgcagagccccatgtacttcttcctgaggaacctgtccttcctggagatcggcttcaacctggtgattgtgcccaagatgctgggcaccctcatcatccaggacaccaccatctccttcctgggctgtgccacccagatgtacttcttcttcttcttcggggctgctgagtgctgcctgctggccaccatggcctatgaccgctacgtggccatctgtgaccccctgcactaccctgtgatcatgggccacatcagctgtgcccagctggccgccgcctcctggttcagcggcttctctgtggccaccgtgcagaccacctggatcttctccttccccttctgtggccccaacagagtgaaccacttcttctgtgacagcccccctgtgattgccctggtgtgtgccgacacctctgtgtttgagctggaggccctgacagccaccgtgctcttcatcctcttccccttcctgctgatcctgggcagctatgtgcgcatcctgagcaccatcttcaggatgcccagcgctgagggcaagcaccaggccttcagcacctgcagcgcccacctgctggtggtgtccctcttctacagcacagccatcctgacctacttccggccccagagcagcgccagcagcgagagcaagaagctgctgagcctgagcagcacagtggtgacccccatgctgaaccccatcatctacagcagcaggaacaaggaggtgaaggccgccctgaagaggctcatccacaggaccctgggcagccagaagctgtag

SEQ ID NO: 36174 - DNA, 954 bp, Artificial Sequence
  Description of Artificial Sequence: Synthetic coding sequence
atggccatcggcaactggacagagatcagcgagttcatcctgatgtccttcagcagcctgcccacagagatccagagcctgctcttcctgaccttcctgaccatctacctggtgaccctgaagggcaacagcctcatcatcctggtgaccctggccgaccccatgctgcacagccccatgtacttcttcctgaggaacctgtccttcctggagatcggcttcaacctggtgattgtgcccaagatgctgggcaccctgctggcccaggacaccaccatctccttcctgggctgtgccacccagatgtacttcttcttcttcttcggcgtggccgagtgcttcctgctggccaccatggcctatgaccgctacgtggccatctgcagccccctgcactaccctgtgatcatgaaccagaggacccgggccaagctggccgccgcctcctggttccctggcttccctgtggccaccgtgcagaccacctggctgttctccttccccttctgtggcaccaacaaggtgaaccacttcttctgtgacagcccccctgtgctgaagctggtgtgtgccgacacagccctgtttgagatctatgccatcgtgggcaccatcctggtggtgatgatcccctgcctgctgatcctgtgcagctacaccagaattgctgctgccatcctgaagatccccagcgccaagggcaagcacaaggccttcagcacctgcagcagccacctgctggtggtgtccctcttctacatcagcagcagcctgacctacttctggcccaagagcaacaacagccctgagagcaagaagctgctgagcctgagctacacagtggtgacccccatgctgaaccccatcatctacagcctgaggaacagcgaggtgaagaatgccctgagcaggaccttccacaaggtgctggccctgaggaactgcatcccctag

SEQ ID NO: 36175 - DNA, 966 bp, Artificial Sequence
  Description of Artificial Sequence: Synthetic coding sequence
atgcccatcctgatggccatcggcaactggacagagatcagcgagttcatcctgatgtccttcagcagcctgcccacagagatccagagcctgctcttcctgaccttcctgaccatctacctggtgaccctgaagggcaacagcctcatcatcctggtgaccctggccgaccccatgctgcacagccccatgtacttcttcctgaggaacctgtccttcctggagatcggcttcaacctggtgattgtgcccaagatgctgggcaccctgctggcccaggacaccaccatctccttcctgggctgtgccacccagatgtacttcttcttcttcttcggcgtggccgagtgcttcctgctggccaccatggcctatgaccgctacgtggccatctgcagccccctgcactaccctgtgatcatgaaccagaggacccgggccaagctggccgccgcctcctggttccctggcttccctgtggccaccgtgcagaccacctggctgttctccttccccttctgtggcaccaacaaggtgaaccacttcttctgtgacagcccccctgtgctgaagctggtgtgtgccgacacagccctgtttgagatctatgccatcgtgggcaccatcctggtggtgatgatcccctgcctgctgatcctgtgcagctacaccagaattgctgctgccatcctgaagatccccagcgccaagggcaagcacaaggccttcagcacctgcagcagccacctgctggtggtgtccctcttctacatcagcagcagcctgacctacttctggcccaagagcaacaacagccctgagagcaagaagctgctgagcctgagctacacagtggtgacccccatgctgaaccccatcatctacagcctgaggaacagcgaggtgaagaatgccctgagcaggaccttccacaaggtgctggccctgaggaactgcatcccctag

SEQ ID NO: 36176 - DNA, 945 bp, Artificial Sequence
  Description of Artificial Sequence: Synthetic coding sequence
atggagcggcagaaccagagctgtgtggtggagttcatcctgctgggcttcagcaactacccagagctgcagggccagctgtttgtggccttcctggtgatctacctggtgaccctgattggaaatgccatcatcatcgtcatcgtgtccctggaccagagcctgcacgtgcccatgtacctgttcctgctgaacctgtctgtggtggacctgtccttctctgctgtgatcatgcctgagatgctggtggtgctgagcacagagaagaccaccatcagctttggaggctgctttgcccagatgtacttcatcctgctgtttggaggagctgagtgcttcctgctgggcgccatggcctatgacagatttgctgccatctgccaccccctgaactaccagatgatcatgaacaagggcgtcttcatgaagctgatcatcttctcctgggccctgggcttcatgctgggcaccgtgcagacctcctgggtgtcctccttccccttctgtggcctgaatgagatcaaccacatcagctgtgagaccccagctgtgctggagctggcctgtgccgacaccttcctgtttgagatctatgccttcaccggcaccttcctgatcatcctggtgcccttcctgctgatcctgctgagctacatccgggtgctgtttgccatcctgaagatgcccagcaccaccggccggcagaaggccttcagcacctgtgccgcccacctgacctctgtgaccctcttctacggcacagcctccatgacctacctgcagcccaagagcggctacagccctgagaccaagaaggtgatgagcctgagctacagcctgctgacccccctgctgaacctgctgatctacagcctgagaaattctgagatgaagagggccctgatgaagctgtggaggagaagagtggtgctgcacaccatctag

SEQ ID NO: 36177 - DNA, 951 bp, Artificial Sequence
  Description of Artificial Sequence: Synthetic coding sequence
atgatctgtgagaaccacaccagggtgacagagttcatcctgctgggcttcaccaacaaccctgagatgcaggtgtccctcttcatcttcttcctggccatctacacagtgaccctgctgggcaacttcctgattgtgacagtgacctctgtggacctggccctgcagacccccatgtacttcttcctgcagaacctgagcctgctggaggtgtgcttcaccctggtgatggtgcccaagatgctggtggacctggtgagccccaggaagatcatcagctttgtgggctgcggcacccagatgtacttcttcttcttcttcggcagcagcgagtgcttcctgctgtccatgatggcctatgacagatttgtggccatctgcaaccccctgcactacagcgtcatcatgaacagaagcctgtgcctgtggatggccatcggctcctggatgtctggagtgcctgtgtccatgctgcagacagcctggatgatggccctgcccttctgtggccccaatgctgtggaccacttcttctgtgatggcccccctgtgctgaagctggtgacagtggacaccaccatgtatgagatgcaggccctggccagcaccctgctcttcatcatgttccccttctgcctgatcctggtgtcctacacccgcatcatcatcaccatcctgaggatgagcagcgccaccggccggcagaaggccttcagcacctgcagcagccacctgattgtggtgtccctcttctacggcacagccagcctgacctacctgcggcccaagagcaaccagagccctgagagcaagaagctggtgtccctgagctacaccgtcatcacccccatgctgaaccccatcatctacggcctgagaaataatgaggtgaagggagctgtgaagaggaccatcacccagaaggtgctgcagaagctggatgtgttctag

SEQ ID NO: 36178 - DNA, 1020 bp, Artificial Sequence
  Description of Artificial Sequence: Synthetic coding sequence
atggagaagcgggagatcaacagcgccttcggcgtgaagagccgctaccgctacctgggccccctgtatgtgatctacacctactaccacatccgcatcatcctgctcttcacccaggccccagacctggacctcttccctgctgccaacgtgtccatcatgggcgccatcaagctgagccacaacctgcacacccccatgtacttcttcctgtgtggcctgtccttcagcgagacctgcaccaccgtggtggtgatccccaggatgctggtggacttcctgtctgagagcaagaccatcagcctgcctgaatgtgccacccagatgttcttcttcctgggctttgccagcaacaactgcttcatcatggccgccatgtcctatgaccgctacacagccatccacaaccccctgcagtaccacaccctgatgaccaggaagatctgcctgcagatgatgatggcctcctggatggtgggcttcctgttcagcctgtgcatcatcgtgaccgtcttcaacctgagcctgtgtgacctgaacaccatccagcactacttctgtgacatcagccctgtggtgtccctggcctgcaactacaccttctaccacgagatggccatctttgtgctgagcgcctttgtgctggtgggcagctgcatcctgatcatgatctcctatgtgttcatcgtgttcatcgtcatcaagatgcccagcgccaagggccgcagcaaggccttcagcacctgcagcagccacctgactgtggtgtccatccactacggctttgcctgctttgtgtacctgcggcccaagaacagcaacagctttgatgaggacatgctgacagccatgatctacaccatcctgatgcccctgctgaaccccatcgtgtacagcctgaggaacaaggagatgcagatcgccctgaggaagaccctgggctctgtgtttggagtcttcccccagaagaccaagaaggagcctgagcacctgaagaagctgcacagcattgacaagtag

SEQ ID NO: 36179 - DNA, 954 bp, Artificial Sequence
  Description of Artificial Sequence: Synthetic coding sequence
atgctgagaaatggcagcatcgtgacagagttcatcctggtgggcttccagcagagcagcaccagcacccgggccctgctgtttgccctcttcctggccctgtacagcctgaccatggccatgaatggcctcatcatcttcatcacctcctggacagaccccaagctgaacagccccatgtacttcttcctgggccacctgagcctgctggatgtgtgcttcatcaccaccaccatcccccagatgctgatccacctggtggtgcgggaccacatcgtgtcctttgtgtgctgcatgacccagatgtactttgtgttctgtgtgggcgtggccgagtgcatcctgctggccttcatggcctatgaccgctacgtggccatctgctaccccctgaactacgtgcccatcatcagccagaaggtgtgtgtgcggctggtgggcacagcctggttcttcggcctcatcaatggcatcttcctggagtacatctccttccgggagcccttccggcgggacaaccacatcgagagcttcttctgtgaggcccccatcgtcatcggcctgagctgtggggacccccagttcagcctgtgggccatctttgctgatgccatcgtggtgatcctgagccccatggtgctgactgtgaccagctatgtgcacatcctggccaccatcctgagcaaggccagcagcagcggccggggcaagaccttcagcacctgtgccagccacctgactgtggtgatcttcctgtacaccagcgccatgttctcctacatgaacccccacagcacccacggccctgacaaggacaagcccttcagcctgctgtacaccatcatcacccccatgtgcaaccccatcatctacagcttcaggaacaaggagatcaaggaggccatggtgcgggccctgggccgcacccggctggcccagccccagagcgtgtag

SEQ ID NO: 36180 - DNA, 906 bp, Artificial Sequence
  Description of Artificial Sequence: Synthetic coding sequence
atggagtttgtgctgctgggcttcagtgacatccccaacctgcactggatgctgttcagcatcttcctgctgatgtacctgatgatcctgatgtgcaatggcatcatcatcctgctgatcaagatccacccagccctgcagacccccatgtacttcttcctgagcaacttcagcctgctggagatctgctacgtgaccatcatcatccccaggatgctgatggacatctggacccagaagggcaacatcagcctgtttgcctgtgccacccagatgtgcttcttcctgatgctgggcggcacagagtgcctgctgctgactgtgatggcctatgaccgctacgtggccatctgcaagcccctgcagtaccccctggtgatgaaccacaaggtgtgcatccagctgatcatcgcctcctggaccatcaccatccctgtggtgattggagagacctgccagatcttcctgctgcccttctgtggcaccaacaccatcaaccacttcttctgtgacatcccccccatcctgaagctggcctgtggcaacatctttgtgaatgagatcaccgtgcacgtggtggccgtggtgttcatcaccgtgcccttcctgctgattgtggtgtcctatggcaagatcatcagcaacatcctgaagctgagcagcgcccggggcaaggccaaggccttcagcacctgcagcagccacctgattgtggtgatcctcttctttggagctggcaccatcacctacctgcagcccaagccccaccagttccagaggatgggcaagctgatcagcctcttctacaccatcctgatccccaccctgaaccccatcatctacaccctgaggaacaaggacatcatggtggccctgaggaagctgctggccaagctgctgacctag

SEQ ID NO: 36181 - DNA, 939 bp, Artificial Sequence
  Description of Artificial Sequence: Synthetic coding sequence
atgtctgccaacacctccatggtgacagagttcctgctgctgggcttcagccacctggccgacctgcagggcctgctcttcagcgtcttcctgaccatctacctgctgactgtggccggcaacttcctgattgtggtgctggtgtccacagatgctgccctgcagagccccatgtacttcttcctgcggaccctgagcgccctggagatcggctacacctctgtgacagtgcccctgctgctgcaccacctgctgaccggccgccgccacatcagccgcagcggctgtgccctgcagatgttcttcttcctgttcttcggggccacagagtgctgcctgctggccgccatggcctatgacagatatgctgccatctgtgagcccctgcgctaccccctgctgctgagccaccgggtgtgcctgcagctggccggcagcgcctgggcctgtggggtgctggtgggcctgggccacacccccttcatcttcagcctgcccttctgtggccccaacaccatcccccagttcttctgtgagatccagcctgtgctgcagctggtgtgtggggacaccagcctgaatgagctgcagatcatcctggccacagccctgctgatcctgtgccccttcggcctcatcctgggcagctatggccgcatcctggtgaccatcttccgcatccccagcgtggccggccgcaggaaggccttcagcacctgcagcagccacctgatcatggtgtccctcttctatggaacagccctcttcatctacatccggcccaaggccagctatgaccctgccacagaccccctggtgtccctcttctatgctgtggtgacccccatcctgaaccccatcatctacagcctgaggaacacagaggtgaaggccgccctgaagaggaccatccagaagacagtgcccatggagatctag

SEQ ID NO: 36182 - DNA, 939 bp, Artificial Sequence; identical to SEQ ID NO: 36181
  Description of Artificial Sequence: Synthetic coding sequence

SEQ ID NO: 36183 - DNA, 939 bp, Artificial Sequence
  Description of Artificial Sequence: Synthetic coding sequence
atgtctgccaacacctccatggtgacagagttcctgctgctgggcttcagccacctggccgacctgcagggcctgctcttcagcgtcttcctgaccatctacctgctgactgtggccggcaacttcctgattgtggtgctggtgtccacagatgctgccctgcagagccccatgtacctgttcctgcggaccctgagcgccctggagatcggctacacctctgtgacagtgcccctgctgctgcaccacctgctgaccggccgccgccacatcagccgcagcggctgtgccctgcagatgttcttcttcctgttcttcggggccacagagtgctgcctgctggccgccatggcctatgacagatatgctgccatctgtgagcccctgcgctaccccctgctgctgagccaccgggtgtgcctgcagctggccggcagcgcctgggcctgtggggtgctggtgggcctgggccacacccccttcatcttcagcctgcccttctgtggccccaacaccatccagcagttcttctgtgagatccagcctgtgctgcagctggtgtgtggggacaccagcctgaatgagctgcagatcatcctggccacagccctgctgatcctgtgccccttcggcctcatcctgggcagctatggccgcatcctggtgaccatcttccgcatccccagcgtggccggccgcaggaaggccttcagcacctgcagcagccacctgattgtggtgtccctcttctatggaacagccctcttcatctacatccggcccaaggccagctatgaccctgccacagaccccctggtgtccctcttctatgctgtggtgacccccatcctgaaccccatcatctacagcctgaggaacacagaggtgaaggccgccctgaagaggaccatccagaagacagtgcccatggagatctag

SEQ ID NO: 36184 - DNA, 939 bp, Artificial Sequence
  Description of Artificial Sequence: Synthetic coding sequence
atgtctgccaacacctccatggtgacagagttcctgctgctgggcttcagccacctggccgacctgcagggcctgctcttcagcgtcttcctgaccatctacctgctgactgtggccggcaacttcctgattgtggtgctggtgtccacagatgctgccctgcagagccccatgtacttcttcctgcggaccctgagcgccctggagatcggctacacctctgtgacagtgcccctgctgctgcaccacctgctgaccggccgccgccacatcagccgcagcggctgtgccctgcagatgttcttcttcctgttcttcggggccacagagtgctgcctgctggccgccatggcctatgacagatatgctgccatctgtgagcccctgcgctaccccctgctgctgagccaccgggtgtgcctgcagctggccggcagcgcctgggcctgtggggtgctggtgggcctgggccacacccccttcatcttcagcctgcccttctgtggccccaacaccatcccccagttcttctgtgagatccagcctgtgctgcagctggtgtgtggggacaccagcctgaatgagctgcagatcatcctggccacagccctgctgatcctgtgccccttcggcctcatcctgggcagctatggccgcatcctggtgaccatcttccgcatccccagcgtggccggccgcaggaaggccttcagcacctgcagcagccacctgattgtggtgtccctcttctatggaacagccctcttcatctacatccggcccaaggccagctatgaccctgccacagaccccctggtgtccctcttctatgctgtggtgacccccatcctgaaccccatcatctacagcctgaggaacacagaggtgaaggccgccctgaagaggaccatccagaagacagtgcccatggagatctag

SEQ ID NO: 36185 - DNA, 939 bp, Artificial Sequence; identical to SEQ ID NO: 36181
  Description of Artificial Sequence: Synthetic coding sequence

SEQ ID NO: 36186 - DNA, 939 bp, Artificial Sequence; identical to SEQ ID NO: 36184
  Description of Artificial Sequence: Synthetic coding sequence

SEQ ID NO: 36187 - DNA, 939 bp, Artificial Sequence; identical to SEQ ID NO: 36184
  Description of Artificial Sequence: Synthetic coding sequence

SEQ ID NO: 36188 - DNA, 939 bp, Artificial Sequence; identical to SEQ ID NO: 36184
  Description of Artificial Sequence: Synthetic coding sequence

SEQ ID NO: 36189 - DNA, 888 bp, Artificial Sequence
  Description of Artificial Sequence: Synthetic coding sequence
tctgtgacagagttcctgctgctgggcgtgacagacatccaggagctgcagcccttcctgtttgtggtgttcctgaccatctacttcatctctgtggccggaaatggagccatcctgatgatcgtcatcagtgacccccggctgcacagccccatgtacttcttcctgggcaacctgagctgcctggacatctgctacagctctgtgaccctgcccaagatgctgcagaacttcctgagcgcccacaagatcagccgcagcggctgtgccctgcagatgttcttcttcctgttctttggagccacagagtgctgcctgctggccgccatggcctatgacagatatgctgccatctgtgagcccctgcgctaccccctgctgctgagccaccgggtgtgcctgcagctggccggcagcgcctgggcctgtggggtgctggtgggcctgggccacacccccttcatcttcagcctgcccttctgtggccccaacaccatcccccagttcttctgtgagatccagcctgtgctgcagctggtgtgtggggacaccagcctgaatgagctgcagatcatcctggccacagccctgctgatcctgtgccccttcggcctcatcctgggcagctatggccgcatcctggtgaccatcttccgcatccccagcgtggccggccgcaggaaggccttcagcacctgcagcagccacctgatcatggtgtccctcttctacggcacagccctcttcatctacatccggcccaaggccagctatgaccctgccacagaccccctggtgtccctcttctatgctgtggtgacccccatcctgaaccccatcatctacagcctgaggaacacagaggtgaaggccgccctgaagaggtag

SEQ ID NO: 36190 - DNA, 888 bp, Artificial Sequence; identical to SEQ ID NO: 36189
  Description of Artificial Sequence: Synthetic coding sequence

SEQ ID NO: 36191 - DNA, 888 bp, Artificial Sequence
  Description of Artificial Sequence: Synthetic coding sequence
tctgtgacagagttcctgctgctgggcgtgacagacatccaggagctgcagcccttcctgtttgtggtgttcctgaccatctacttcatctctgtggccggaaatggagccatcctgatgatcgtcatcagtgacccccggctgcacagccccatgtacttcttcctgggcaacctgagctgcctggacatctgctacagctctgtgaccctgcccaagatgctgcagaacttcctgagcgcccacaagatcagccgcagcggctgtgccctgcagatgttcttcttcctgttctttggagccacagagtgctgcctgctggccgccatggcctatgacagatatgctgccatctgtgagcccctgcgctaccccctgctgctgagccaccgggtgtgcctgcagctggccggcagcgcctgggcctgtggggtgctggtgggcctgggccacacccccttcatcttcagcctgcccttctgtggccccaacaccatccagcagttcttctgtgagatccagcctgtgctgcagctggtgtgtggggacaccagcctgaatgagctgcagatcatcctggccacagccctgctgatcctgtgccccttcggcctcatcctgggcagctatggccgcatcctggtgaccatcttccgcatccccagcgtggccggccgcaggaaggccttcagcacctgcagcagccacctgattgtggtgtccctcttctacggcacagccctcttcatctacatccggcccaaggccagctatgaccctgccacagaccccctggtgtccctcttctatgctgtggtgacccccatcctgaaccccatcatctacagcctgaggaacacagaggtgaaggccgccctgaagaggtag

SEQ ID NO: 36192 - DNA, 888 bp, Artificial Sequence
  Description of Artificial Sequence: Synthetic coding sequence
tctgtgacagagttcctgctgctgggcgtgacagacatccaggagctgcagcccttcctgtttgtggtgttcctgaccatctacttcatctctgtggccggaaatggagccatcctgatgatcgtcatcagtgacccccggctgcacagccccatgtacttcttcctgggcaacctgagctgcctggacatctgctacagctctgtgaccctgcccaagatgctgcagaacttcctgagcgcccacaagatcagccgcagcggctgtgccctgcagatgttcttcttcctgttctttggagccacagagtgctgcctgctggccgccatggcctatgacagatatgctgccatctgtgagcccctgcgctaccccctgctgctgagccaccgggtgtgcctgcagctggccggcagcgcctgggcctgtggggtgctggtgggcctgggccacacccccttcatcttcagcctgcccttctgtggccccaacaccatcccccagttcttctgtgagatccagcctgtgctgcagctggtgtgtggggacaccagcctgaatgagctgcagatcatcctggccacagccctgctgatcctgtgccccttcggcctcatcctgggcagctatggccgcatcctggtgaccatcttccgcatccccagcgtggccggccgcaggaaggccttcagcacctgcagcagccacctgattgtggtgtccctcttctacggcacagccctcttcatctacatccggcccaaggccagctatgaccctgccacagaccccctggtgtccctcttctatgctgtggtgacccccatcctgaaccccatcatctacagcctgaggaacacagaggtgaaggccgccctgaagaggtag

SEQ ID NO: 36193 - DNA, 915 bp, Artificial Sequence
  Description of Artificial Sequence: Synthetic coding sequence
gagaggatgtctgccaacacctccatggtgacagagttcctgctgctgggcttcagccacctggccgacctgcagggcctgctcttcagcgtcttcctgaccatctacctgctgactgtggccggcaacttcctgattgtggtgctggtgtccacagatgctgccctgcagagccccatgtacttcttcctgcggaccctgagcgccctggagatcggctacacctctgtgacagtgcccctgctgctgcaccacctgctgaccggccgccgccacatcagccgcagcggctgtgccctgcagatgttcttcttcctgttcttcggggccacagagtgctgcctgctggccgccatggcctatgacagatatgctgccatctgtgagcccctgcgctaccccctgctgctgagccaccgggtgtgcctgcagctggccggcagcgcctgggcctgtggggtgctggtgggcctgggccacacccccttcatcttcagcctgcccttctgtggccccaacaccatcccccagttcttctgtgagatccagcctgtgctgcagctggtgtgtggggacaccagcctgaatgagctgcagatcatcctggccacagccctgctgatcctgtgccccttcggcctcatcctgggcagctatggccgcatcctggtgaccatcttccgcatccccagcgtggccggccgcaggaaggccttcagcacctgcagcagccacctgattgtggtgtccctcttctatggaacagccctcttcatctacatccggcccaaggccagctatgaccctgccacagaccccctggtgtccctcttctatgctgtggtgacccccatcctgaaccccatcatctacagcctgaggaacacagaggtgaaggccgccctgaagaggtag

SEQ ID NO: 36194 - DNA, 888 bp, Artificial Sequence; identical to SEQ ID NO: 36192
  Description of Artificial Sequence: Synthetic coding sequence

SEQ ID NO: 36195 - DNA, 888 bp, Artificial Sequence; identical to SEQ ID NO: 36192
  Description of Artificial Sequence: Synthetic coding sequence

SEQ ID NO: 36196 - DNA, 939 bp, Artificial Sequence
  Description of Artificial Sequence: Synthetic coding sequence
atggaggtgaagaactgctgcatggtgacagagttcatcctgctgggcatcccccacacagagggcctggagatgaccctgtttgtgctcttcctgcccttctacgcctgcaccctgctgggcaatgtgtccatcctggtggccgtgatgagcagcgcccggctgcacacccccatgtacttcttcctgggcaacctgtctgtgtttgacatgggcttcagctctgtgacctgccccaagatgctgctgtacctgatgggcctgagccgcctcatctcctacaaggactgtgtgtgccagctgttcttcttccacttcctgggcagcattgagtgcttcctgttcaccgtgatggcctatgaccgcttcaccgccatctgctaccccctgcgctacaccgtcatcatgaacccccgcatctgtgtggccctggccgtgggcacctggctgctgggctgcatccacagcagcatcctgaccagcctgaccttcaccctgccctactgcggccccaatgaggtggaccacttcttctgtgacatcccagccctgctgcccctggcctgtgccgacaccagcctggcccagagggtgtccttcaccaacgtgggcctcatcagcctggtgtgcttcctgctgatcctgctgagctacacccgcatcaccatcagcatcctgagcatccgcaccacagagggcagaagaagagccttcagcacctgcagcgcccacctgattgccatcctgtgtgcctacggccccatcatcaccgtgtacctgcagcccacccccaaccccatgctgggcaccgtggtgcagatcctgatgaacctggtgggccccatgctgaaccccctcatctacaccctgaggaacaaggaggtgaagacagccctgaagaccatcctgcacaggacaggccacgtgcctgagagctag

SEQ ID NO: 36197 - DNA, 933 bp, Artificial Sequence
  Description of Artificial Sequence: Synthetic coding sequence
atgggcaagaccaagaacaccagcctggatgctgtggtgacagacttcatcctgctgggcctgagccacccccccaacctgcggagcctgctcttcctggtgttcttcatcatctacatcctgacccagctgggcaacctgctgatcctgctgaccatgtgggccgaccccaagctgtgtgcccggcccatgtacatcctgctgggcgtgctgtccttcctggacatgtggctgagctctgtgacagtgcccaggctcatcctggacttcacccccagcatcaaggccatcccctttggaggctgtgtggcccagctgtacttcttccacttcctgggcagcacccagtgcttcctgtacaccctgatggcctatgaccgctacctggccatctgccagcccctgcactaccctgtgctgatgaatggccgcctgtgcaccgtgctggtggccggggcctgggtggccggctccatgcacggcagcatccaggccaccctgaccttccggctgccctactgcggccccaaccaggtggactacttcatctgtgacatccgggctgtgctgcggctggcctgtgccgacaccaccgtgaatgagctggtgacctttgtggatgtgcgggtggtggccgccagctgcttcatgctgatcctgctgtcctatgccaacatcgtgcacgccatcctgaagatcagaacagcagatggaagaagaagagccttcagcacctgtggcagccacctgattgtggtgacagtgtactacgtgccctgcatcttcatctacctgcgggccggcagcaaggaccccctggatggagctgctgctgtgttctacacagtggtgacccccctgctgaaccccctcatctacaccctgaggaaccaggaggtgaagagcgccctgaagaggatcacagctggatag

SEQ ID NO: 36198 - DNA, 942 bp, Artificial Sequence
  Description of Artificial Sequence: Synthetic coding sequence
atggagcgcatcaacagcaccctgctgacagccttcatcctgaccggcatcccctaccccctgcggctgcggaccctcttctttgtgttcttcttcctgatctacatcctgacccagctgggcaacctgctgatcctgatcaccgtgtgggccgacccccggctgcacgcccggcccatgtacatcttcctgggcgtgctgagcgtcatcgacatgagcatcagcagcatcatcgtgccccggctgatgatgaacttcaccctgggcgtgaagcccatcccctttggaggctgtgtggcccagctgtacttctaccacttcctgggcagcacccagtgcttcctgtacaccctgatggcctatgaccgctacctggccatctgccagcccctgcgctaccctgtgctgatgacagccaagctgagcgccctgctggtggccggggcctggatggccggcagcatccacggggccctgcaggccatcctgaccttccggctgccctactgcggccccaaccaggtggactacttcttctgtgacatcccagctgtgctgcggctggcctgtgccgacaccaccgtgaatgagctggtgacctttgtggacatcggcgtggtggtggccagctgcttcagcctcatcctgctgagctacatccagatcatccaggccatcctgcgcatccacacagcagatggaagaagaagagccttcagcacctgtggggcccacgtgacagtggtgacagtgtactacgtgccctgtgccttcatctacctgcggcctgagaccaacagccccctggatggagctgctgccctggtgcccacagccatcacccccttcctgaaccccctcatctacaccctgaggaaccaggaggtgaagctggccctgaagaggatgctgcggagccccaggaccccatctgaggtgtag

SEQ ID NO: 36199 - DNA, 936 bp, Artificial Sequence
  Description of Artificial Sequence: Synthetic coding sequence
atgagcaatgccagcctggtgacagccttcatcctgaccggcctgccccacgcccctggcctggatgccctgctgtttggcatcttcctggtggtgtatgtgctgactgtgctgggcaacctgctgatcctgctggtgatccgggtggacagccacctgcacacccccatgtactacttcctgaccaacctgtccttcatcgacatgtggttcagcacagtgacagtgcccaagatgctgatgaccctggtgagccccagcggccgggccatctccttccacagctgtgtggcccagctgtacttcttccacttcctgggcagcacagagtgcttcctgtacacagtgatgtcctatgaccgctacctggccatctcctaccccctgcgctacacctccatgatgagcggcagccgctgtgccctgctggccaccggcacctggctgagcggcagcctgcacagcgctgtgcagaccatcctgaccttccacctgccctactgcggccccaaccagatccagcactacttctgtgatgccccacccatcctgaagctggcctgtgccgacaccagcgccaacgtgatggtgatctttgtggacatcggcatcgtggccagcggctgctttgtgctgattgtgctgtcctatgtgtccatcgtgtgcagcatcctgcgcatccgcaccagtgatggaagaagaagagccttccagacctgtgccagccactgcatcgtggtgctgtgcttctttgtgccctgtgtggtgatctacctgcggcccggctccatggatgccatggatggagtggtggccatcttctacacagtgctgacccccctgctgaaccctgtggtgtacaccctgaggaacaaggaggtgaagaaggctgtgctgaagctgcgggacaaggtggcccacccccagaggaagtag

SEQ ID NO: 36200 - DNA, 936 bp, Artificial Sequence
  Description of Artificial Sequence: Synthetic coding sequence
atgagcaatgccaccctgctgacagccttcatcctgaccggcctgccccacgcccctggcctggatgcccccctgtttggcatcttcctggtggtgtatgtgctgactgtgctgggcaacctgctgatcctgctggtgatccgggtggacagccacctgcacacccccatgtactacttcctgaccaacctgtccttcatcgacatgtggttcagcacagtgacagtgcccaagatgctgatgaccctggtgagccccagcggccgcaccatctccttccacagctgtgtggcccagctgtacttcttccacttcctgggcagcacagagtgcttcctgtacacagtgatgtcctatgaccgctacctggccatctcctaccccctgcgctacaccaacatgatgacaggccgcagctgtgccctgctggccaccggcacctggctgagcggcagcctgcacagcgctgtgcagaccatcctgaccttccacctgccctactgcggccccaaccagatccagcactacttctgtgatgccccacccatcctgaagctggcctgtgccgacaccagcgccaatgagatggtgatctttgtgaacatcggcctggtggccagcggctgctttgtgctgattgtgctgtcctatgtgtccatcgtgtgcagcatcctgcgcatccgcaccagcgagggccgccaccgggccttccagacctgtgccagccactgcatcgtggtgctgtgcttctttggacctggcctcttcatctacctgcggcccggcagcagagatgccctgcacggcgtggtggccgtgttctacaccaccctgacccccctcttcaaccctgtggtgtacaccctgaggaacaaggaggtgaagaaggccctgctgaagctgaagaatggatctgtgtttgcccagggcgagtag

SEQ ID NO: 36201 - DNA, 936 bp, Artificial Sequence
  Description of Artificial Sequence: Synthetic coding sequence
atgagcaatgccagcctgctgacagccttcatcctgatgggcctgccccacgccccagccctggatgcccccctgtttggagtcttcctggtggtgtatgtgctgactgtgctgggcaacctgctgatcctgctggtgatccgggtggacagccacctgcacaccaccatgtactacttcctgaccaacctgtccttcatcgacatgtggttcagcacagtgacagtgcccaagctgctgatgaccctggtgttccccagcggccgggccatctccttccacagctgcatggcccagctgtacttcttccacttcctgggcggcacagagtgcttcctgtacagagtgatgagctgtgaccgctacctggccatctcctaccccctgcgctacacctccatgatgacaggccgcagctgcaccctgctggccaccagcacctggctgagcggcagcctgcacagcgctgtgcaggccatcctgaccttccacctgccctactgcggccccaactggatccagcactacctgtgtgatgccccacccatcctgaagctggcctgtgccgacaccagcgccatcgagaccgtcatctttgtgacagtgggcatcgtggccagcggctgctttgtgctgattgtgctgtcctatgtgtccatcgtgtgcagcatcctgcgcatccgcaccagcgagggcaagcaccgggccttccagacctgtgccagccactgcatcgtggtgctgtgcttctttggacctggcctcttcatctacctgcggcccggcagcaggaaggctgtggatggagtggtggccgtgttctacacagtgctgacccccctgctgaaccctgtggtgtacaccctgaggaacaaggaggtgaagaaggccctgctgaagctgaaggacaaggtggcccacagccagagcaagtag

SEQ ID NO: 36202 - DNA, 936 bp, Artificial Sequence
  Description of Artificial Sequence: Synthetic coding sequence
atgagcaagaccagcctggtgacagccttcatcctgaccggcctgccccacgcccctggcctggatgcccccctgtttggcatcttcctggtggtgtatgtgctgactgtgctgggcaacctgctgatcctgctggtgatccgggtggacagccacctgcacacccccatgtactacttcctgaccaacctgtccttcatcgacatgtggttcagcacagtgacagtgcccaagatgctgatgaccctggtgagccccagcggccgggccatctccttccacagctgtgtggcccagctgtacttcttccacttcctgggcagcacagagtgcttcctgtacacagtgatgtcctatgaccgctacctggccatctcctaccccctgcgctacacctccatgatgagcggcagccgctgtgccctgctggccaccagcacctggctgagcggcagcctgcacagcgctgtgcagaccatcctgaccttccacctgccctactgcggccccaaccagatccagcactacctgtgtgatgccccacccatcctgaagctggcctgtgccgacaccagcgccaatgagatggtgatctttgtggacatcggcctggtggccagcggctgcttcctgctgattgtgctgtcctatgtgtccatcgtgtgcagcatcctgcgcatccacaccagcgagggccgccaccgggccttccagacctgtgccagccactgcatcgtggtgctgtgcttctttgtgccctgtgtgttcatctacctgcggcccggcagcagagatgtggtggatggagtggtggccatcttctacacagtgctgacccccctgctgaaccctgtggtgtacaccctgaggaacaaggaggtgaagaaggctgtgctgaagctgcgggacaaggtggcccacagccagggcgagtag

SEQ ID NO: 36203 - DNA, 957 bp, Artificial Sequence
  Description of Artificial Sequence: Synthetic coding sequence
atgcagagggccaaccacagcacagtgacccagttcatcctggtgggcttcagcgtcttcccccacctgcagctgatgctgttcctgctcttcctgctgatgtacctgttcaccctgctgggcaacctgctgatcatggccaccgtgtggagcgagaggagcctgcacacccccatgtacctgttcctgtgtgccctgtctgtgtctgagatcctgtacacagtggccatcatccccaggatgctggccgacctgctgagcacccagaggagcatcgccttcctggcctgtgccagccagatgttcttctccttctcctttggcttcacccacagcttcctgctgactgtgatgggctatgacagatatgtggccatctgccaccccctgcgctacaacgtgctgatgagcccccggggctgtgcctgcctggtgggctgctcctgggccggcggcctggtgatgggcatggtggtgaccagcgccatcttccacctggccttctgtggccacaaggagatccaccactttgcctgccacgtgccccccctgctgaagctggcctgtggagatgatgtgctggtggtggccaagggcgtgggcctggtgtgcatcacagccctgctgggctgcttcctgctgatcctgctgtcctatgccttcatcgtggccgccatcctgaagatccccagcgctgagggcaggaacaaggccttcagcacctgtgccagccacctgactgtggtggtggtgcactacggctttgccagcgtcatctacctgaagcccaagagcccccagagcctggagggggacaccctgatgggcatcacctacacagtgctgacccccttcctgagccccatcatcttcagcctgaggaacaaggagctgaaggtggccatgaagaagaccttcttcagcaagctgtacccagagaagaatgtgatgatgtag

SEQ ID NO: 36204 - DNA, 948 bp, Artificial Sequence
  Description of Artificial Sequence: Synthetic coding sequence
atgctgggcctgaaccacacctccatgtctgagttcatcctggtgggcttcagcgccttcccccacctgcagctgatgctgttcctgctcttcctgctgatgtacctgttcaccctgctgggcaacctgctgatcatggccaccgtgtggagcgagaggagcctgcacacccccatgtacctgttcctgtgtgtgctgtctgtgtctgagatcctgtacacagtggccatcatccccaggatgctggccgacctgctgagcacccagaggagcatcgccttcctggcctgtgccagccagatgttcttctccttctcctttggcttcacccacagcttcctgctgactgtgatgggctatgacagatatgtggccatctgccaccccctgcgctacaacgtgctgatgagcccccggggctgtgcctgcctggtgggctgctcctgggccggcggctctgtgatgggcatggtggtgaccagcgccatcttccagctgaccttctgtggcagccatgagatccagcacttcctgtgccacgtgccccccctgctgaagctggcctgtggcaacaacgtgcctgctgtggccctgggcgtgggcctggtgtgcatcatggccctgctgggctgcttcctgctgatcctgctgtcctatgccttcatcgtggccgacatcctgaagatccccagcgctgagggcaggaacaaggccttcagcacctgtgccagccacctgattgtggtgattgtgcactacggctttgccagcgtcatctacctgaagcccaagggcccccacagccaggagggggacaccctgatggccaccacctatgctgtgctgacccccttcctgagccccatcatcttcagcctgaggaacaaggagctgaaggtggccatgaagaggaccttcctgagcaccctgtacagcagcggcacctag

SEQ ID NO: 36205 - DNA, 951 bp, Artificial Sequence
  Description of Artificial Sequence: Synthetic coding sequence
atgcctggccagaactaccgcaccatcagcgagttcatcctgagcggcttcagcgccttcccccagcagctgctgcctgtgctcttcctgctgtacctgctgatgttcctgttcaccctgctgggcaacctgctgatcatggccaccgtgtggattgaaagaaggctgcacacccccatgtacctgttcctgtgtgccctgagcatcagcgagatcctcttcaccgtggccatcacccccaggatgctggccgacctgctcttcacccacaggagcatcacctttgtggcctgtgccatccagatgttcttctccttcatgtttggcttcacccacagcttcctgctgatggtgatgggctatgaccactacgtgaccatctgccaccccctgcactacaacatgctgatgagcccccggggctgtgcccacctggtggcctggacctgggccggcggctctgtgatgggcatgatggtgaccatgatggtgttccacctgaccttctgtggcagcaatgtcatccaccacttcctgtgccacgtgctgagcctgctgaagctggcctgtggcagcaagaccagcagcgtcatcatgggcgtgatgctggtgtgtgtgacagccctgattggctgcctcttcctgatcatcctgagctttgtgttcatcgtggccgccatcctgcgcatccccagcgctgagggccgccacaagaccttcagcacctgtgtgagccacctgactgtggtggtgatgcactacagctttgccagcctcatctacctgaagcccaagggcctgcacagcatgtacagtgatgccctgatggccaccacctacacagtgttcacccccttcctgagccccatcatcttcagcctgaggaacaaggagctgaagaatgccatcaacaagaacttctgccgccgcttctgccccctgagcagctag

SEQ ID NO: 36206 - DNA, 951 bp, Artificial Sequence
  Description of Artificial Sequence: Synthetic coding sequence
atgcccagccagaactacagcatcatcagcgagttcaacctgtttggcttcagcgccttcccccagcacctgctgcccatcctcttcctgctgtacctgctgatgttcctgttcaccctgctgggcaacctgctgatcatggccaccatctggattgagcaccggctgcacacccccatgtacctgttcctgtgcaccctgtctgtgtctgagatcctcttcaccgtggccatcacccccaggatgctggccgacctgctgagcacccaccacagcatcacctttgtggcctgtgccaaccagatgttcttctccttcatgtttggcttcacccacagcttcctgctgctggtgatgggctatgaccgctacgtggccatctgccaccccctgcgctacaacgtgctgatgagcccccgggactgtgcccacctggtggcctgcacctgggccggcggctctgtgatgggcatgatggtgaccaccatcgtgttccacctgaccttctgtggcagcaatgtcatccaccacttcttctgccacgtgctgagcctgctgaagctggcctgtgagaacaagaccagcagcgtcatcatgggcgtgatgctggtgtgtgtgacagccctgattggctgcctcttcctgatcatcctgtcctatgtgttcatcgtggccgccatcctgcgcatccccagcgctgagggccgccacaagaccttcagcacctgtgtgagccacctgactgtggtggtgacccactacagctttgccagcttcatctacctgaagcccaagggcctgcacagcatgtacagtgatgccctgatggccaccacctacacagtgttcacccccttcctgagccccatcatcttcagcctgaggaacaaggagctgaagaatgccatcaacaagaacttctacaggaagttctgcccccccagcagctag

SEQ ID NO: 36207 - DNA, 948 bp, Artificial Sequence
  Description of Artificial Sequence: Synthetic coding sequence
atgcagggcctgaaccacacctctgtgtctgagttcatcctggtgggcttcagcgccttcccccacctgcagctgatgctgttcctgctcttcctgctgatgtacctgttcaccctgctgggcaacctgctgatcatggccaccgtgtggagcgagaggagcctgcacatgcccatgtacctgttcctgtgtgccctgagcatcacagagatcctgtacacagtggccatcatccccaggatgctggccgacctgctgagcacccagaggagcatcgccttcctggcctgtgccagccagatgttcttctccttctcctttggcttcacccacagcttcctgctgactgtgatgggctatgacagatatgtggccatctgccaccccctgcgctacaacgtgctgatgagcctgcggggctgcacctgccgggtgggctgctcctgggccggcggcctggtgatgggcatggtggtgaccagcgccatcttccacctggccttctgtggccacaaggagatccaccacttcttctgccacgtgccccccctgctgaagctggcctgtggagatgatgtgctggtggtggccaagggcgtgggcctggtgtgcatcacagccctgctgggctgcttcctgctgatcctgctgtcctatgccttcatcgtggccgccatcctgaagatccccagcgctgagggcaggaacaaggccttcagcacctgtgccagccacctgactgtggtggtggtgcactacggctttgccagcgtcatctacctgaagcccaagggcccccagagccctgagggggacaccctgatgggcatcacctacacagtgctgacccccttcctgagccccatcatcttcagcctgaggaacaaggagctgaaggtggccatgaagaagacctgcttcaccaagctgttcccccagaactgctag

SEQ ID NO: 36208 - DNA, 963 bp, Artificial Sequence
  Description of Artificial Sequence: Synthetic coding sequence
atgctgctgtgcttccgctttggaaaccagagcatgaagcgggagaacttcaccctcatcacagactttgtgttccagggcttcagcagcttccacgagcagcagatcaccctgtttggagtcttcctggccctgtacatcctgaccctggccggcaacatcatcatcgtgaccatcatccgcatggacctgcacctgcacacccccatgtacttcttcctgtccatgctgagcaccagcgagaccgtgtacaccctggtgatcctgcccaggatgctgagcagcctggtgggcatgagccagcccatcagcctggccggctgtgccacccagatgttcttctttgtgaccttcggcatcaccaactgcttcctgctgacagccatgggctatgaccgctacgtggccatctgcaaccccctgcgctacatggtgatcatgaacaagaggctgcgcatccagctggtgctgggcgcctgcagcatcggcctgattgtggccatcacccaggtgacctctgtgttccggctgcccttctgtgccaggaaggtgccccacttcttctgtgacatccggcctgtgatgaagctgagctgcatcgacaccaccgtgaatgagatcctgaccctcatcatctctgtgctggtgctggtggtgcccatgggcctggtgttcatctcctatgtgctgatcatcagcaccatcctgaagatcgcctctgtggagggcaggaagaaggcctttgccacctgtgccagccacctgactgtggtgattgtgcactacagctgtgccagcatcgcctacctgaagcccaagtctgagaacacccgggagcatgaccagctgatctctgtgacctacaccgtcatcacccccctgctgaaccctgtggtgtacaccctgaggaacaaggaggtgaaggatgccctgtgcagagctgtgggcggcaagttctcctag

SEQ ID NO: 36209 - DNA, 990 bp, Artificial Sequence
  Description of Artificial Sequence: Synthetic coding sequence
atgcccaagctgaacagcacctttgtgacagagttcctgtttgagggcttcagcagcttccggcggcagcacaagctggtgttctttgtggtgttcctgaccctgtacctgctgaccctgtctggaaatgtcatcatcatgaccatcatccggctggaccaccacctgcacacccccatgtacttcttcctgtgcatgctgagcatcagcgagacctgctacacagtggccatcatcccccacatgctgagcggcctgctgaacccccaccagcccatcgccacccagagctgtgccacccagctgttcttctacctgaccttcggcatcaacaactgcttcctgctgactgtgatgggctatgaccgctacgtggccatctgcaaccccctgcgctacagcgtcatcatgggcaagagggcctgcatccagctggccagcggcagcctgggcatcggcctgggcatggccatcgtgcaggtgacctctgtgtttggcctgcccttctgtgatgcctttgtgatcagccacttcttctgtgatgtgcgccacctgctgaagctggcctgcacagacaccaccgtgaatgagatcatcaactttgtggtgtctgtgtgtgtgctggtgctgcccatgggcctggtgttcatctcctatgtgctgatcatcagcaccatcctgaagatcgccagcgctgagggccagaagaaggcctttgccacctgtgccagccacctgactgtggtgatcatccactacggctgtgccagcatcatctacctgaagcccaagagccagagcagcctgggccaggacaggctcatctctgtgacctacacccaccacagccccacagagccctgctgcgtgcagcctgaggagcagggcggccagcgctgcagcgcccagagcagaggagccaagaacagcgtgtccctgatgaagaggggctgtgagggcttctcctttgccttcatcaacatgtactag

SEQ ID NO: 36210 - DNA, 930 bp, Artificial Sequence
  Description of Artificial Sequence: Synthetic coding sequence
atgaagaggaagaacttcacagaggtgtctgagttcatcttcctgggcttcagcagctttgggaagcaccagatcaccctgtttgtggtgttcctgactgtgtacatcctgaccctggtggccaacatcatcatcgtgaccatcatctgcatcgaccaccacctgcacacccccatgtacttcttcctgtccatgctggccagcagcgagaccgtgtacaccctggtgattgtgcccaggatgctgctgagcctcatcttccacaaccagcccatcagcctggccggctgtgccacccagatgttcttcttcgtcatcctggccaccaacaactgcttcctgctgacagccatgggctatgacagatatgtggccatctgccggcccctgcgctacaccgtcatcatgagcaagggcctgtgtgcccagctggtgtgtggcagctttggaattggcctgaccatggctgtgctgcacgtgacagccatgttcaacctgcccttctgtggcaccgtggtggaccacttcttctgtgacatctaccctgtgatgaagctgagctgcatcgacaccaccatcaatgagatcatcaactatggagtgtcctcctttgtgatctttgtgcccatcggcctcatcttcatctcctatgtgctggtgatcagcagcatcctgcagatcgccagcgctgagggcaggaagaagacctttgccacctgtgtgagccacctgactgtggtgattgtgcactgcggctgtgccagcatcgcctacctgaagcccaagtctgagagcagcattgagaaggacctggtgctgtctgtgacctacaccatcatcacccccctgctgaaccctgtggtgtacagcctgaggaacaaggaggtgaaggatgccctgtgccgggtggtgggcaggaacatctcctag

SEQ ID NO: 36211 - DNA, 942 bp, Artificial Sequence
  Description of Artificial Sequence: Synthetic coding sequence
atggagcaggtgaacaagacagtggtgcgggagtttgtggtgctgggcttcagcagcctggcccggctgcagcagctgctcttcgtcatcttcctgctgctgtacctgttcaccctgggcaccaatgccatcatcatcagcaccatcgtgctggaccgggccctgcacacccccatgtacttcttcctggccatcctgagctgcagcgagatctgctacacctttgtgattgtgcccaagatgctggtggacctgctgagccagaagaagaccatctccttcctgggctgtgccatccagatgttctccttcctgttcttcggcagcagccacagcttcctgctggccgccatgggctatgaccgctacatggccatctgcaaccccctgcgctacagcgtgctgatgggccacggcgtgtgcatgggcctgatggctgctgcctgtgcctgtggcttcaccgtgtccctggtgaccaccagcctggtgttccacctgcccttccacagcagcaaccagctgcaccacttcttctgtgacatcagccctgtgctgaagctggccagccagcacagcggcttcagccagctggtgatcttcatgctgggcgtgtttgccctggtgatccccctgctgctgatcctggtgtcctacatccgcatcatcagcgccatcctgaagatccccagctctgtgggccgctacaagaccttcagcacctgtgccagccacctgattgtggtgacagtgcactacagctgtgccagcttcatctacctgcggcccaagaccaactacaccagcagccaggacaccctcatctctgtgtcctacaccatcctgacccccctcttcaaccccatgatctacagcctgaggaacaaggagttcaagagcgccctgcggaggaccatcggccagaccttctaccccctgtcctag

SEQ ID NO: 36212 - DNA, 939 bp, Artificial Sequence
  Description of Artificial Sequence: Synthetic coding sequence
atggagcgggtgaatgaaacagtggtgcgggaggtgatcttcctgggcttcagcagcctggcccggctgcagcagctgctcttcgtcatcttcctgctgctgtacctgttcaccctgggcaccaatgccatcatcatcagcaccatcgtgctggaccgggccctgcacatccccatgtacttcttcctggccatcctgagctgcagcgagatctgctacaccttcatcatcgtgcccaagatgctggtggacctgctgagccagaagaagaccatctccttcctgggctgtgccatccagatgttctccttcctgttcctgggctgcagccacagcttcctgctggccgtgatgggctatgaccgctacatcgccatctgcaaccccctgcgctacagcgtgctgatgggccacggcgtgtgcatgggcctggtggccgccgcctgtgcctgtggcttcaccgtggcccagatcatcaccagcctggtgttccacctgcccttctacagcagcaaccagctgcaccacttcttctgtgacatcgcccctgtgctgaagctggccagccaccacaaccacttcagccagatcgtcatcttcatgctgtgcaccctggtgctggccatccccctgctgctgatcctggtgtcctatgtgcacatcctgagcgccatcctgcagttccccagcaccctgggccgctgcaaggccttcagcacctgtgtgagccacctgatcatcgtgacagtgcactacggctgtgccagcttcatctacctgcggccccagagcaactacagcagcagccaggatgccctgatctctgtgtcctacaccatcatcacccccctcttcaaccccatgatctacagcctgaggaacaaggagttcaagagcgccctgtgcaagatcgtgcggaggaccatcagcctgctgtag

SEQ ID NO: 36213 - DNA, 942 bp, Artificial Sequence
  Description of Artificial Sequence: Synthetic coding sequence
atggccggggagaaccacaccaccctgcctgagttcctgctgctgggcttcagtgacctgaaggccctgcagggccccctcttctgggtggtgctgctggtgtacctggtgaccctgctgggcaacagcctcatcatcctgctgacccaggtgtccccagccctgcacagccccatgtacttcttcctgcggcagctgtctgtggtggagctgttctacaccacagacatcgtgcccaggaccctggccaacctgggcagcccccacccccaggccatctccttccagggctgtgccgcccagatgtatgtgttcatcgtgctgggcatcagcgagtgctgcctgctgacagccatggcctatgaccgctacgtggccatctgccagcccctgcgctacagcaccctgctgagcccccgggcctgcatggccatggtgggcacctcctggctgaccggcatcatcacagccaccacccacgccagcctcatcttcagcctgcccttccgcagccaccccatcatcccccacttcctgtgtgacatcctgcctgtgctgcggctggccagcgctgggaagcacaggtctgagatctctgtgatgacagccaccatcgtgttcatcatgatccccttcagcctgattgtgaccagctacatccgcatcctgggcgccatcctggccatggccagcacccagagcaggaggaaggtgttcagcacctgcagcagccacctgctggtggtgtccctcttctttggaacagccagcatcacctacatccggccccaggccggcagctctgtgaccacagacagagtgctgagcctcttctacaccgtcatcacccccatgctgaaccccatcatctacaccctgaggaacaaggatgtgagaagagccctgcggcacctggtgaagaggcagaggcccagcccctag

SEQ ID NO: 36214 - DNA, 960 bp, Artificial Sequence
  Description of Artificial Sequence: Synthetic coding sequence
atgcctgtgggcaagctggtgttcaaccagagcgagcccacagaatttgtgttccgggccttcaccacagccacagagttccaggtgctgctcttcctgctcttcctgctgctgtacctgatgatcctgtgtggcaacacagccatcatctgggtggtgtgcacccacagcaccctgcggacccccatgtacttcttcctgagcaacctgtccttcctggagctgtgctacaccaccgtggtggtgcccctgatgctgagcaacatcctgggcgcccagaagcccatcagcctggccggctgtggggcccagatgttcttctttgtgaccctgggcagcacagactgcttcctgctggccatcatggcctatgacagatatgtggccatctgccaccccctgcactacaccctcatcatgacccgggagctgtgcacccagatgctgggcggggccctgggcctggccctcttccccagcctgcagctgacagccctgatcttcaccctgcccttctgtggccaccaccaggagatcaaccacttcctgtgtgatgtgccccctgtgctgcggctggcctgtgccgacatccgggtgcaccaggccgtgctgtatgtggtgtccatcctggtgctgaccatccccttcctgctgatctgtgtgtcctatgtgttcatcacctgtgccatcctgagcatccgctctgctgagggcagaagaagagccttcagcacctgcagcttccacctgactgtggtgctgctgcagtatggctgctgcagcctggtgtacctgcggcccaggagcagcaccagtgaagatgaggacagccagatcgccctggtgtacacctttgtgacccccctgctgaaccccctgctgtacagcctgaggaacaaggatgtgaagggggccctgcggagcgccatcatcaggaaggccgccagtgatgccaactag

SEQ ID NO: 36215 - DNA, 1008 bp, Artificial Sequence
  Description of Artificial Sequence: Synthetic coding sequence
atgccccagatcctgatcttcacctacctgaacatgttctacttcttcccccccctgcagatcctggccgagaacctgaccatggtgacagagttcctgctgctgggcttcagcagcctgggggagatccagctggccctgtttgtggtgttcctgttcctgtacctggtgatcctgtctggaaatgtgaccatcatcagcgtcatccacctggacaagagcctgcacacccccatgtacttcttcctgggcatcctgagcaccagcgagaccttctacacctttgtgatcctgcccaagatgctgatcaacctgctgtctgtggcccggaccatctccttcaactgctgtgccctgcagatgttcttcttcctgggctttgccatcaccaactgcctgctgctgggcgtgatgggctatgacagatatgctgccatctgccaccccctgcactaccccaccctgatgtcctggcaggtgtgtgggaagctggccgccgcctgtgccatcggcggcttcctggccagcctgactgtggtgaacctggtgttcagcctgcccttctgcagcgccaacaaggtgaaccactacttctgtgacatctctgctgtgatcctgctggcctgcaccaacacagatgtgaatgaatttgtgatcttcatctgtggggtgctggtgctggtggtgcccttcctgttcatctgtgtgtcctacctgtgcatcctgcggaccatcctgaagatccccagcgctgagggccgcaggaaggccttcagcacctgtgccagccacctgtctgtggtgattgtgcactacggctgtgccagcttcatctacctgcggcccacagccaactacgtgagcaacaaggaccggctggtgacagtgacctacaccatcgtgacccccctgctgaaccccatggtgtacagcctgaggaacaaggatgtgcagctggccatcaggaaggtgctgggcaagaagggcagcctgaagctgtacaactag

SEQ ID NO: 36216 - DNA, 996 bp, Artificial Sequence
  Description of Artificial Sequence: Synthetic coding sequence
atgaccagccgctctgtgtgtgagaagatgaccatgaccacagagaaccccaaccagacagtggtgagccacttcttcctggagggcctgcgctacacagccaagcacagcagcctcttcttcctgctcttcctgctgatctacagcatcaccgtggccggcaacctgctgatcctgctgactgtgggcagtgacagccacctgagcctgcccatgtaccacttcctgggccacctgtccttcctggatgcctgcctgagcacagtgacagtgcccaaggtgatggccggcctgctgaccctggatggcaaggtgatcagctttgagggctgtgctgtgcagctgtactgcttccacttcctggccagcacagagtgcttcctgtacacagtgatggcctatgaccgctacctggccatctgccagcccctgcactaccctgtggccatgaacagaaggatgtgtgccgagatggccggcatcacctgggccatcggggccacccacgccgccatccacaccagcctgaccttccggctgctgtactgcggcccctgccacatcgcctacttcttctgtgacatcccccctgtgctgaagctggcctgcacagacaccaccatcaatgagctggtgatgctggccagcattggaattgtggccgccggctgcctgatcctgattgtcatctcctacatcttcatcgtggccgctgtgctgcgcatcagaacagcccagggccggcagagggccttcagcccctgcacagcccagctgactggagtgctgctgtactacgtgccccctgtgtgcatctacctgcagcccaggagcagcgaggccggggccggggccccagctgtgttctacaccatcgtgacccccatgctgaaccccttcatctacaccctgaggaacaaggaggtgaagcacgccctgcagaggctgctgtgcagcagcttccgggagagcacagctggcagccccccaccctag

SEQ ID NO: 36217 - DNA, 945 bp, Artificial Sequence
  Description of Artificial Sequence: Synthetic coding sequence
atgaggggcttcaacaagaccaccgtggtgacccagttcatcctggtgggcttcagcagcctgggggagctgcagctgctgctgtttgtgatcttcctgctgctgtacctgaccatcctggtggccaacgtgaccatcatggccgtcatccgcttctcctggaccctgcacacccccatgtatggcttcctgttcatcctgtccttcagcgagagctgctacaccttcgtcatcatcccccagctgctggtgcacctgctgagtgacaccaagaccatctccttcatggcctgtgccacccagctgttcttcttcctgggctttgcctgcaccaactgcctgctgattgctgtgatgggctatgaccgctacgtggccatctgccaccccctgcgctacaccctcatcatcaacaagaggctgggcctggagctgatcagcctgagcggggccaccggcttcttcatcgccctggtggccaccaacctgatctgtgacatgaggttctgtggccccaacagagtgaaccactacttctgtgacatggcccctgtgatcaagctggcctgcacagacacccacgtgaaggagctggccctcttcagcctgagcatcctggtgatcatggtgcccttcctgctgatcctgatctcctatggcttcatcgtgaacaccatcctgaagatccccagcgctgagggcaagaaggcctttgtgacctgtgccagccacctgactgtggtgtttgtgcactacggctgtgccagcatcatctacctgcggcccaagagcaagagcgccagtgacaaggaccagctggtggccgtgacctacacagtggtgacccccctgctgaaccccctggtgtacagcctgaggaacaaggaggtgaagacagccctgaagagggtgctgggcatgcctgtggccaccaagatgtcctag

SEQ ID NO: 36218 - DNA, 930 bp, Artificial Sequence
  Description of Artificial Sequence: Synthetic coding sequence
atggagggcatcaacaagacagccaagatgcagttcttcttccggcccttctccccagaccctgaggtgcagatgctgatctttgtggtgttcctgatgatgtacctgaccagcctgggcggcaatgccaccatcgccgtcatcgtgcagatcaaccacagcctgcacacccccatgtacttcttcctggccaacctggccgtgctggagatcttctacaccagcagcatcacccccctggccctggccaacctgctgtccatgggcaagacccctgtgtccatcaccggctgcggcacccagatgttcttctttgtgttcctgggcggcgctgactgtgtgctgctggtggtgatggcctatgaccagttcatcgccatctgccaccccctgcgctaccgcctcatcatgtcctggagcctgtgtgtggagctgctggtgggcagcctggtgctgggcttcctgctgagcctgcccctgaccatcctgatcttccacctgcccttctgccacaatgatgagatctaccacttctactgtgacatgcctgctgtgatgaggctggcctgtgccgacaccagggtgcacaagacagccctgtacatcatctccttcatcgtgctgagcatccccctgagcctcatcagcatctcctatgtgttcatcgtggtggccatcctgcgcatccgctctgctgagggccggcagcaggcctacagcacctgcagcagccacatcctggtggtgctgctgcagtatggctgcaccagcttcatctacctgagccccagcagcagctacagccctgagatgggccgggtggtgtctgtggcctacaccttcatcacccccatcctgaaccccctcatctacagcctgaggaacaaggagctgaaggatgccctgaggaaggccctgaggaagttctag

SEQ ID NO: 36219 - DNA, 918 bp, Artificial Sequence
  Description of Artificial Sequence: Synthetic coding sequence
atggagtttgtgttcctggcctaccccagctgcccagagctgcacatcctgtccttcctgggcgtgtccctggtgtatggcctcatcatcactggaaacatcctgattgtggtgtccatccacacagagacctgcctgtgcacctccatgtactacttcctgggcagcctgagcggcatcgagatctgctacacagctgtggtggtgccccacatcctggccaacaccctgcagagcgagaagaccatcaccctgctgggctgtgccacccagatggccttcttcatcgccctgggcagcgctgactgcttcctgctggccgccatggcctatgaccgctacgtggccatctgccaccccctgcagtaccccctgctgatgaccctgaccctgtgtgtgcacctggtggtggccagcgtcatcagcggcctcttcctgagcctgcagctggtggccttcatcttcagcctgcccttctgccaggcccagggcatcgagcacttcttctgtgatgtgccccctgtgatgcacgtggtgtgtgcccagagccacatccacgagcagagcgtgctggtggccgccatcctggccatcgctgtgcccttcttcctgatcaccaccagctacaccttcatcgtggccgccctgctgaagatccacagcgctgctggccgccaccgggccttcagcacctgcagcagccacctgactgtggtgctgctgcagtatggctgctgtgccttcatgtacctgtgccccagcagcagctacaaccccaagcaggaccgcttcatcagcctggtgtacaccctgggcacccccctgctgaaccccctcatctatgccctgaggaacagcgagatgaagggagctgtgggccgggtgctgaccaggaactgcctgagccagaacagctag

SEQ ID NO: 36220 - DNA, 981 bp, Artificial Sequence
  Description of Artificial Sequence: Synthetic coding sequence
atggtgctgaatgtgtactgctgcttcttccagatcagtgacatccagaccatgaagatcaaccagaccatcctgaaggagttcatcctggtgggcttctctgtgtacccccacgtgcagaccttcctgtttgtggtgttcttctgcctgtacctgctgaccctggccggcaacctgatcatcatgggcctgacctgggtggacaggagcctgcacacccccatgtacctgttcctgagcgccctgtccttcagcgagacctgctacaccctgaccatcgtgcccaagatgctggaggacctgctggccaaggacaggagcatctctgtgacaggctgcagcctgcagatgtgcttcttcctgggcctgggcggcaccaactgcatcatcctgaccctgatgggctatgaccgcttcctggccatctgcaaccccctgcgctaccccctgctgatgaccaacatcgtgtgtggccagctggtggccagcgcctgcacagctggcttcttcatcagcctgacagaaacagccctgatcttccgggacagcttctgccggcccaacctggtgaagcacttcttctgccacatgctggccgtcatccggctgagctgcatcgacagcaaccacacagagttcatcatcaccctcatctctgtgtctggcctgctgggcaccctgctgctgatcatcctgacagatgtgttcatcatcagcacagtgctgcgcatccccagcgctgagggcaagcagaaggccttcaccacctgtgccagccacctgactgtggtgatcatccacttcggctttgccagcatcgtgtacctgaagccagaggccagcggagatgacaccctgattgctgtgccctacaccgtcatcacccccttcctgagccccatcatcttcagcctgaggaacaaggacatgaagaatgccttccggaggatgatgggcaacacagtggccctgaagaagtag

SEQ ID NO: 36221 - DNA, 942 bp, Artificial Sequence
  Description of Artificial Sequence: Synthetic coding sequence
atgggccagaccaacgtgacctcctggagggactttgtgttcctgggcttcagcagcagcggggagctgcagctgctgctgtttgccctcttcctgagcctgtacctggtgaccctgaccagcaatgtgttcatcatcatcgccatccggctggacagccacctgcacacccccatgtacctgttcctgtccttcctgtccttcagcgagacctgctacaccctgggcatcatccccaggatgctgagcggcctggccggcggggaccaggccatctcctatgtgggctgtgccgcccagatgttcttcagcgcctcctgggcctgcaccaactgcttcctgctggccgccatgggctttgacagatatgtggccatctgtgcccccctgcactacgccagccacatgaaccccaccctgtgtgcccagctggtgatcaccagcttcctgaccggctacctgtttggcctgggcatgaccctggtgatcttccacctgtccttctgcagcagccatgagatccagcacttcttctgtgacaccccacctgtgctgagcctggcctgtggggacaccggccccagcgagctgcgcatcttcatcctgagcctgctggtgctgctggtgtccttcttcttcatcaccatctcctatgcctacatcctggccgccatcctgcgcatccccagcgctgagggccagaagaaggccttcagcacctgtgccagccacctgactgtggtgatcatccactacggctgtgccagctttgtgtacctgcggcccaaggccagctacagcctggagcgggaccagctgattgccatgacctacacagtggtgacccccctgctgaaccccatcgtgtacagcctgaggaacagagccatccagacagccctgagaaatgccttccggggccgcctgctgggcaagggctag

SEQ ID NO: 36222 - DNA, 39 bp, Artificial Sequence
  Description of Artificial Sequence: Synthetic coding sequence
gtcaccccccagaagctgtccttctgcagcagccactag

SEQ ID NO: 36223 - DNA, 948 bp, Artificial Sequence
  Description of Artificial Sequence: Synthetic coding sequence
atggagatcgtgtccactggaaatgagaccatcacagaatttgtgctgctgggcttctatgacatccctgagctgcacttcctgttcttcatcgtgttcaccgctgtgtatgtgttcatcatcatcggcaacatgctgatcatcgtggccgtggtgagcagccagaggctgcacaagcccatgtacatcttcctggccaacctgtccttcctggacatcctgtacaccagcgctgtgatgcccaagatgctggagggcttcctgcaggaggccaccatctctgtggccggctgcctgctgcagttcttcatcttcggcagcctggccacagctgagtgcctgctgctggccgtgatggcctatgaccgctacctggccatctgctaccccctgcactaccccctgctgatgggcccccggcgctacatgggcctggtggtgaccacctggctgagcggctttgtggtggatggcctggtggtggccctggtggcccagctgcgcttctgtggccccaaccacatcgaccagttctactgtgacttcatgctgtttgtgggcctggcctgcagcgacccccgggtggcccaggtgaccaccctcatcctgagcgtcttctgcctgaccatccccttcggcctcatcctgaccagctatgcccgcatcgtggtggccgtgctgcgggtgcctgctggggccagcagaagaagagccttcagcacctgcagcagccacctggccgtggtgaccaccttctacggcaccctgatgatcttctacgtggcccccagcgctgtgcacagccagctgctgagcaaggtgttcagcctgctgtacacagtggtgacccccctcttcaaccctgtgatctacaccatgaggaacaaggaggtgcaccaggccctgaggaagatcctgtgcatcaagcagacagagaccctggactag

SEQ ID NO: 36224 - DNA, 948 bp, Artificial Sequence; identical to SEQ ID NO: 36223
  Description of Artificial Sequence: Synthetic coding sequence

SEQ ID NO: 36225 - DNA, 948 bp, Artificial Sequence; identical to SEQ ID NO: 36223
  Description of Artificial Sequence: Synthetic coding sequence

SEQ ID NO: 36226 - DNA, 948 bp, Artificial Sequence; identical to SEQ ID NO: 36223
  Description of Artificial Sequence: Synthetic coding sequence

SEQ ID NO: 36227 - DNA, 948 bp, Artificial Sequence; identical to SEQ ID NO: 36223
  Description of Artificial Sequence: Synthetic coding sequence

SEQ ID NO: 36228 - DNA, 948 bp, Artificial Sequence; identical to SEQ ID NO: 36223
  Description of Artificial Sequence: Synthetic coding sequence

SEQ ID NO: 36229 - DNA, 948 bp, Artificial Sequence; identical to SEQ ID NO: 36223
  Description of Artificial Sequence: Synthetic coding sequence

SEQ ID NO: 36230 - DNA, 948 bp, Artificial Sequence; identical to SEQ ID NO: 36223
  Description of Artificial Sequence: Synthetic coding sequence

SEQ ID NO: 36231 - DNA, 948 bp, Artificial Sequence; identical to SEQ ID NO: 36223
  Description of Artificial Sequence: Synthetic coding sequence

SEQ ID NO: 36232 - DNA, 948 bp, Artificial Sequence; identical to SEQ ID NO: 36223
  Description of Artificial Sequence: Synthetic coding sequence

SEQ ID NO: 36233 - DNA, 948 bp, Artificial Sequence; identical to SEQ ID NO: 36223
  Description of Artificial Sequence: Synthetic coding sequence

SEQ ID NO: 36234 - DNA, 948 bp, Artificial Sequence; identical to SEQ ID NO: 36223
  Description of Artificial Sequence: Synthetic coding sequence

SEQ ID NO: 36235 - DNA, 948 bp, Artificial Sequence; identical to SEQ ID NO: 36223
  Description of Artificial Sequence: Synthetic coding sequence

SEQ ID NO: 36236 - DNA, 948 bp, Artificial Sequence; identical to SEQ ID NO: 36223
  Description of Artificial Sequence: Synthetic coding sequence

SEQ ID NO: 36237 - DNA, 948 bp, Artificial Sequence; identical to SEQ ID NO: 36223
  Description of Artificial Sequence: Synthetic coding sequence

SEQ ID NO: 36238 - DNA, 948 bp, Artificial Sequence; identical to SEQ ID NO: 36223
  Description of Artificial Sequence: Synthetic coding sequence

SEQ ID NO: 36239 - DNA, 948 bp, Artificial Sequence; identical to SEQ ID NO: 36223
  Description of Artificial Sequence: Synthetic coding sequence

SEQ ID NO: 36240 - DNA, 948 bp, Artificial Sequence; identical to SEQ ID NO: 36223
  Description of Artificial Sequence: Synthetic coding sequence

SEQ ID NO: 36241 - DNA, 948 bp, Artificial Sequence; identical to SEQ ID NO: 36223
  Description of Artificial Sequence: Synthetic coding sequence

SEQ ID NO: 36242 - DNA, 948 bp, Artificial Sequence; identical to SEQ ID NO: 36223
  Description of Artificial Sequence: Synthetic coding sequence

SEQ ID NO: 36243 - DNA, 948 bp, Artificial Sequence; identical to SEQ ID NO: 36223
  Description of Artificial Sequence: Synthetic coding sequence

SEQ ID NO: 36244 - DNA, 1038 bp, Artificial Sequence
  Description of Artificial Sequence: Synthetic coding sequence
atgcacttcctgagccagaatgacctgaacatcaacctgatcccccacctgtgcctgcaccgccacagcgtgattgctggggccttcaccatccaccgccacatgaagatcttcaacagccccagcaacagcagcaccttcaccggcttcatcctgctgggcttcccctgcccccgggagggccagatcctgctgtttgtgctcttcaccgtggtgtacctgctgaccctgatgggaaatggcagcatcatctgtgctgtgcactgggaccagaggctgcacgcccccatgtacatcctgctggccaacttctccttcctggagatctgctacgtgaccagcacagtgcccagcatgctggccaacttcctgagtgacaccaagatcatctccttcagcggctgcttcctgcagttctacttcttcttcagcctgggcagcacagagtgcttcttcctggccgtgatggcctttgaccgctacctggccatctgccggcccctgcgctaccccaccatcatgacccggcggctgtgcaccaacctggtggtgaactgctgggtgctgggcttcatctggttcctgatccccatcgtgaacatcagccagatgtccttctgtggcagccgcatcatcgaccacttcctgtgtgaccctgcccccctgctgaccctgacctgcaagaagggccctgtgattgagctggtgttttctgtgctgagccccctgcccgtcttcatgctgttcctgttcatcgtgggcagctatgccctggtggtgcgggctgtgctgcgggtgcccagcgctgctggccgcaggaaggccttcagcacctgtggcagccacctggccgtggtgtccctcttctacggctctgtgctggtgatgtatggcagcccccccagcaagaatgaggccggcaagcagaagacagtgaccctcttctacagcgtggtgacccccctgctgaaccctgtgatctacagcctgaggaacaaggacatgaggaaggccctgaagaagttctggggcacctag

SEQ ID NO: 36245 - DNA, 981 bp, Artificial Sequence
  Description of Artificial Sequence: Synthetic coding sequence
atgtgccccctgaccctgcaggtgacaggcctgatgaatgtgtctgagcccaacagcagctttgcctttgtgaatgagttcatcctgcagggcttcagctgtgagtggaccatccagatcttcctgttcagcctcttcaccaccacctacgccctgaccatcactggaaatggagccatcgcctttgtgctgtggtgtgaccggcggctgcacacccccatgtacatgttcctgggcaacttctccttcctggagatctggtacgtgagcagcacagtgcccaagatgctggtgaacttcctgtctgagaagaagaacatcagctttgctggctgcttcctgcagttctacttcttcttcagcctgggcaccagcgagtgcctgctgctgactgtgatggcctttgaccagtacctggccatctgccggcccctgctgtaccccaacatcatgacaggccacctgtatgccaagctggtgatcctgtgctgggtgtgtggcttcctgtggttcctgatccccatcgtgctgatcagccagatgcccttctgtggccccaacatcatcgaccacgtggtgtgtgaccccggccccaggtttgccctggactgtgtgtctgccccccgcatccagctgttctgctacaccctgagcagcctggtgatctttggaaacttcctgttcatcatcggcagctacaccctggtgctgaaggccatgctgggcatgcccagcagcacaggccgccacaaggccttcagcacctgtggcagccacctggccgtggtgtccctgtgctacagcagcctgatggtgatgtatgtgtccccaggcctgggccacagcacaggcatgcagaagattgagaccctcttctacgccatggtgacccccctcttcaaccccctcatctacagcctgcagaacaaggagatcaaggccgccctgaggaaggtgctgggcagcagcaacatcatctag

SEQ ID NO: 36246 - DNA, 975 bp, Artificial Sequence
  Description of Artificial Sequence: Synthetic coding sequence
atgtccttcttctttgtggacctgcggcccatgaacagaagtgccacccacatcgtgacagagttcatcctgctgggcttccctggctgctggaagatccagatcttcctgttcagcctcttcctggtgatctacgtgctgaccctgctgggcaatggagccatcatctatgctgtgcgctgcaaccccctgctgcacacccccatgtacttcctgctgggcaactttgccttcctggagatctggtacgtgagcagcaccatccccaacatgctggtgaacatcctgagcaagaccaaggccatctccttcagcggctgcttcctgcagttctacttcttcttcagcctgggcaccacagaatgtctcttcctggccgtgatggcctatgaccgctacctggccatctgccaccccctgcagtacccagccatcatgacagtgcgcttctgtgggaagctggtgtccttctgctggctgattggcttcctgggctaccccatccccatcttctacatcagccagctgcccttctgtggccccaacatcatcgaccacttcctgtgtgacatggaccccctgatggccctgagctgtgccccagcccccatcacagagtgcatcttctacacccagagcagcctggtgctcttcttcacctccatgtacatcctgcggagctacatcctgctgctgacagctgtgttccaggtgcccagcgctgctggccgcaggaaggccttcagcacctgtggcagccacctggtggtggtgtccctcttctacggcaccgtgatggtgatgtatgtgagccccacctacggcatccccaccctgctgcagaagatcctgaccctggtgtacagcgtgaccacccccctcttcaaccccctcatctacaccctgaggaacaaggacatgaagctggccctgagaaatgtgctgtttggcatgaggatccggcagaacagctag

SEQ ID NO: 36247 - DNA, 993 bp, Artificial Sequence
  Description of Artificial Sequence: Synthetic coding sequence
atgttcttcatcatccacagcctggtgacctctgtgttcctgacagccctgggcccccagaacagaaccatgcactttgtgacagaatttgtgctgctgggcttccacggccagcgggagatgcagagctgcttcttctccttcatcctggtgctgtacctgctgaccctgctgggcaatggagccatcgtgtgtgctgtgaagctggaccggcggctgcacacccccatgtacatcctgctgggcaactttgccttcctggagatctggtacatcagcagcacagtgcccaacatgctggtgaacatcctgtctgagatcaagaccatctccttcagcggctgcttcctgcagttctacttcttcttcagcctgggcaccacagagtgcttcttcctgtctgtgatggcctatgaccgctacctggccatctgccggcccctgcactaccccagcatcatgaccgggaagttctgcatcatcctggtgtgtgtgtgctgggtgggcggcttcctgtgctaccctgtgcccatcgtgctgatcagccagctgcccttctgtggccccaacatcatcgaccacctggtgtgtgaccccggccccctgtttgccctggcctgcatcagcgcccccagcacagagctgatctgctacaccttcaacagcatgatcatcttcggccccttcctgagcatcctgggcagctacaccctggtgatccgggctgtgctgtgcatccccagcggggccggccgcaccaaggccttcagcacctgtggcagccacctgatggtggtgtccctcttctacggcaccctgatggtgatgtatgtgagccccaccagcggcaacccagctggcatgcagaagatcatcaccctggtgtacacagccatgacccccttcctgaaccccctcatctacagcctgaggaacaaggacatgaaggatgccctgaagagggtgctgggcctgactgtgtcccagaactag

SEQ ID NO: 36248 - DNA, 969 bp, Artificial Sequence
  Description of Artificial Sequence: Synthetic coding sequence
atggagccccagaacaccagcacagtgaccaacttccagctgctgggcttccagaacctgctggagtggcaggccctgctcttcgtcatcttcctgctgatctactgcctgaccatcattggaaatgtggtgatcatcaccgtggtgtcccagggcctgcggctgcacagccccatgtacatgttcctgcagcacctgtccttcctggaggtgtggtacaccagcaccaccgtgcccctgctgctggccaacctgctgtcctggggccaggccatctccttcagcgcctgcatggcccagctgtacttctttgtgttcctgggcgccacagagtgcttcctgctggccttcatggcctatgaccgctacctggccatctgcagccccctgcgctaccccttcctgatgcaccggggcctgtgtgcccggctggtggtggtgtcctggtgcacaggagtgtccacaggcttcctgcccagcctgatgatcagccggctggacttctgtggcaggaaccagatcaaccacttcttctgtgacctgccccccctgatgcagctgagctgcagccgggtgtacatcacagaggtgaccatcttcatcctgagcattgctgtgctgtgcatctgcttcttcctgaccctgggcccctacgtgttcatcgtgagcagcatcctgcgcatccccagcaccagcggccgcaggaagaccttcagcacctgtggcagccacctggccgtggtgaccctgtactacggcaccatgatctccatgtatgtgtgccccagcccccacctgctgcctgagatcaacaagatcatctctgtgttctacacagtggtgacccccctgctgaaccctgtgatctacagcctgaggaacaaggacttcaaggaggccgtgaggaaggtgatgaggaggaaatgtggcatcctgtggagcaccagcaagaggaagttcctgtactag

SEQ ID NO: 36249 - DNA, 924 bp, Artificial Sequence
  Description of Artificial Sequence: Synthetic coding sequence
atgctgaacaccacctctgtgacagagttcctgctgctgggcgtgacagacatccaggagctgcagcccttcctgtttgtggtgttcctgaccatctacttcatctctgtgactggaaatggagctgtgctgatgatcgtcatcagtgacccccggctgcacagcctgatgtacttcttcctgggcaacctgagctacctggacatctgctacagcacagtgaccctgcccaagatgctgcagaacttcctgagcacccacaaggccatctccttcctgggctgcatcagccagctgcacttcttccacagcctgggcagcacagagagcatgctgtttgctgtgatggcctttgacctgtctgtggccatctgcaagcccctgcgctacaccgtcatcatgaacccccagctgtgcacccagatggccatcaccatctgggtgattggcttcttccacgccctgctgcacagcgtgatgaccagccggctgaacttctgtggcagcaaccgcatccaccacttcctgtgtgacatcaagcccctgctgaagctggcctgtggcaacacagagctgaaccagtggctgctgagcacagtgacaggcaccatcgccatgggccccttcttcctgaccctgctgagctacttctacatcatcacctacctgttcttcaagaccaggagctgcagcatgctgtgcaaggccctgagcacctgtgccagccacttcatggtggtgatcctcttctacgcccctgtgctcttcacctacatccacccagccctggagagcttcatggaccaggaccgcatcgtggccatcatgtacacagtggtgacccctgtgctgaaccccctcatctacaccctgaggaacaaggaggtgaagggggccctgggccgggtcatccggcggctgtag

SEQ ID NO: 36250 - DNA, 924 bp, Artificial Sequence
  Description of Artificial Sequence: Synthetic coding sequence
atgctgaacaccacctctgtgacagagttcctgctgctgggcgtgacagacatccaggagctgcagcccttcctgtttgtggtgttcctgaccatctacttcatctctgtgactggaaatggagctgtgctgatgatcttcatcagtgacccccggctgcacagccccatgtacttcttcctgggcaacctgagctacctggacatctgctacagcacagtgaccctgcccaagatgctgcagaacttcctgagcacccacaaggccatctccttcctgggctgcatcagccagctgcacttcttccacttcctgggcagcacagagagcatgctgctggccgtgatggcctttgacagatctgtggccatctgcaagcccctgcgctacaccgtcatcatgaacccccagctgtgcacccagatggccatcaccatctgggtgattggcttcttccacgccctgctgcacagcatcatgaccagccggctgaacttctgtggcagcaaccgcatccaccacttcctgtgtgacatcaagcccctgctgaagctggcctgtggcaacacagagctgaaccagtggctgctgagcacagtgacaggcaccatcgccatgggccccttcttcctgaccctgctgagctacttctacatcatcacctacctgttcttcaagaccaggagctgcagcatgctgtgcaaggccctgagcacctgtgccagccacttcatggtggtgatcctcttctacgcccctgtgctcttcacctacatccacccagccctggagagcttcatggaccaggaccgcatcgtggccatcatgtacacagtggtgacccctgtgctgaaccccctcatctacaccctgaggaacaaggaggtgaagggggccctgggccgggtcatccggcggctgtag

SEQ ID NO: 36251 - DNA, 924 bp, Artificial Sequence
  Description of Artificial Sequence: Synthetic coding sequence
atgctgaacaccacctctgtgacagagttcctgctgctgggcgtgacagacatccaggagctgcagcccttcctgtttgtggtgttcctgaccatctacttcatctctgtgactggaaatggagctgtgctgatgatcttcatcagtgacccccggctgcacagccccatgtacttcttcctgggcaacctgagctacctggacatctgctacagcacagtgaccctgcccaagatgctgcagaacttcctgagcacccacaaggccatctccttcctgggctgcatcagccagctgcacttcttccacttcctgggcagcacagagagcatgctgctggccgtgatggcctttgacagatgtgtggccatctgcaagcccctgcgctacaccgtcatcatgaacccccagctgtgcacccagatggccatcaccatctgggtgattggcttcttccacgccctgctgcacagcatcatgaccagccggctgaacttctgtggcagcaaccgcatccaccacttcctgtgtgacatcaagcccctgctgaagctggcctgtggcaacacagagctgaaccagtggctgctgagcacagtgacaggcaccatcgccatgggccccttcttcctgaccctgctgagctacttctacatcatcacctacctgttcttcaagaccaggagctgcagcatgctgtgcaaggccctgagcacctgtgccagccacttcatggtggtgatcctcttctacgcccctgtgctcttcacctacatccacccagccctggagagcttcatggaccaggaccgcatcgtggccatcatgtacacagtggtgacccctgtgctgaaccccctcatctacaccctgaggaacaaggaggtgaagggggccctgggccgggtcatccggcggctgtag

SEQ ID NO: 36252 - DNA, 951 bp, Artificial Sequence
  Description of Artificial Sequence: Synthetic coding sequence
atggagaatgtgaccaccatgaatgagttcctgctgctgggcctgactggagtgcaggagctgcagcccttcttcttcggcatcttcctgatcatctacctgatcaacctgattggaaatggcagcatcctggtgatggtggtgctggagccccagctgcacagccccatgtacttcttcctgggcaacctgagctgcctggacatctcctacagctctgtgaccctgcccaagctgctggtgaacctggtgtgcagcagaagagccatctccttcctgggctgcatcacccagctgcacttcttccacttcctgggcagcacagaggccatcctgctggccatcatggcctttgacagatttgtggccatctgcaaccccctgcgctacaccgtcatcatgaacccccaggtgtgcatcctgctggccgctgctgcctggctgatctccttcttctacgccctgatgcacagcgtgatgacagcccacctgtccttctgtggcagccagaagctgaaccacttcttctatgatgtgaagcccctgctggagctggcctgcagcgacaccctgctgaaccagtggctgctgagcatcgtgacaggcagcatctccatgggcgccttcttcctgaccctgctgagctgcttctacgtgattggcttcctgctcttcaagaacagaagctgccgcatcctgcacaaggccctgagcacctgtgccagccacttcatggtggtgtgcctcttctacggccctgtgggcttcacctacatccggcctgccagcgccacctccatgatccaggaccgcatcatggccatcatgtacagcgctgtgacccctgtgctgaaccccctcatctacaccctgaggaacaaggaggtgatgatggccctgaagaagatcttcggcaggaagctgttcaaggactggcagcagcaccactag

SEQ ID NO: 36253 - DNA, 951 bp, Artificial Sequence; identical to SEQ ID NO: 36252
  Description of Artificial Sequence: Synthetic coding sequence

SEQ ID NO: 36254 - DNA, 951 bp, Artificial Sequence; identical to SEQ ID NO: 36252
  Description of Artificial Sequence: Synthetic coding sequence

SEQ ID NO: 36255 - DNA, 951 bp, Artificial Sequence; identical to SEQ ID NO: 36252
  Description of Artificial Sequence: Synthetic coding sequence

SEQ ID NO: 36256 - DNA, 951 bp, Artificial Sequence; identical to SEQ ID NO: 36252
  Description of Artificial Sequence: Synthetic coding sequence

SEQ ID NO: 36257 - DNA, 951 bp, Artificial Sequence; identical to SEQ ID NO: 36252
  Description of Artificial Sequence: Synthetic coding sequence

SEQ ID NO: 36258 - DNA, 951 bp, Artificial Sequence; identical to SEQ ID NO: 36252
  Description of Artificial Sequence: Synthetic coding sequence

SEQ ID NO: 36259 - DNA, 951 bp, Artificial Sequence; identical to SEQ ID NO: 36252
  Description of Artificial Sequence: Synthetic coding sequence

SEQ ID NO: 36260 - DNA, 987 bp, Artificial Sequence
  Description of Artificial Sequence: Synthetic coding sequence
atgaagctgtggatggagagccacctgattgtgcctgagacccggcccagccccaggatgatgagcaaccagaccctggtgacagagttcatcctgcagggcttcagcgagcaccctgagtacagagtcttcctgttcagctgcttcctgttcctgtacagcggggccctgactggaaatgtgctgatcaccctggccatcaccttcaaccctggcctgcacgcccccatgtacttcttcctgctgaacctggccaccatggacatcatctgcaccagcagcatcatgcccaaggccctggccagcctggtgtctgaggagagcagcatctcctatggaggctgcatggcccagctgtacttcctgacctgggccgccagcagcgagctgctgctgctgactgtgatggcctatgacagatatgctgccatctgccaccccctgcactacagctccatgatgagcaaggtgttctgcagcggcctggccacagctgtgtggctgctgtgtgctgtgaacacagccatccacacaggcctgatgctgcggctggacttctgtggccccaacgtcatcatccacttcttctgtgaggtgccccccctgctgctgctgagctgcagcagcacctacgtgaatggagtgatgattgtgctggctgatgccttctacggcatcgtgaacttcctgatgaccatcgccagctatggcttcatcgtgagcagcatcctgaaggtgaagacagcctggggccggcagaaggccttcagcacctgcagcagccacctgactgtggtgtgcatgtactacacagctgtgttctacgcctacatcagccctgtgtctggctacagcgctgggaagagcaagctggccggcctgctgtacacagtgctgagccccaccctgaaccccctcatctacaccctgaggaacaaggaggtgaaggccgccctgaggaagctgttccccttcttcagaaattag

SEQ ID NO: 36261 - DNA, 987 bp, Artificial Sequence; identical to SEQ ID NO: 36260
  Description of Artificial Sequence: Synthetic coding sequence

SEQ ID NO: 36262 - DNA, 987 bp, Artificial Sequence; identical to SEQ ID NO: 36260
  Description of Artificial Sequence: Synthetic coding sequence

SEQ ID NO: 36263 - DNA, 957 bp, Artificial Sequence
  Description of Artificial Sequence: Synthetic coding sequence
atggagtgggagaaccacaccatcctggtggagttcttcctgaagggcctgagcggccacccccggctggagctgctcttctttgtgctgatcttcatcatgtatgtggtgatcctgctgggcaatggcaccctcatcctgatcagcatcctggacccccacctgcacacccccatgtacttcttcctgggcaacctgtccttcctggacatctgctacaccaccaccagcatccccagcaccctggtgtccttcctgtctgagaggaagaccatcagcctgagcggctgtgctgtgcagatgttcctgggcctggccatgggcaccacagaatgtgtgctgctgggcatgatggcctttgacagatatgtggccatctgcaaccccctgcgctaccccatcatcatgagcaaggatgcctacgtgcccatggccgccggctcctggatcattggagctgtgaacagcgctgtgcagagcgtgtttgtggtgcagctgcccttctgcaggaacaacatcatcaaccacttcacctgtgagatcctggccgtgatgaagctggcctgtgccgacatcagtgacaatgagttcatcatgctggtggccaccaccctcttcatcctgacccccctgctgctgatcatcgtgtcctacaccctcatcatcgtgtccatcttcaagatcagcagcagcgagggccgcagcaaggccagcagcacctgcagcgcccacctgactgtggtgatcatcttctacggcaccatcctcttcatgtacatgaagcccaagagcaaggagaccctgaacagtgatgacctggatgccacagacaagatcatctccatgttctacggcgtgatgacccccatgatgaaccccctcatctacagcctgaggaacaaggatgtgaaggaggccgtgaagcacctgctgaacagacgcttcttcagcaagtag

SEQ ID NO: 36264 - DNA, 1044 bp, Artificial Sequence
  Description of Artificial Sequence: Synthetic coding sequence
atgattgtgcagctgatctgcaccgtgtgcttcctggccgtgaacaccttccacgtgcgcagcagctttgacttcctgaaggcagatgacatgggagagatcaaccagaccctggtgtctgagttcctgctgctgggcctgagcggctaccccaagattgaaattgtgtactttgccctgatcctggtgatgtacctggtgatcctgattggaaatggagtgctgatcatcgccagcatctttgacagccacttccacacccccatgtacttcttcctgggcaacctgtccttcctggacatctgctacaccagcagctctgtgcccagcaccctggtgtccctcatcagcaagaagaggaacatctccttcagcggctgtgctgtgcagatgttctttggatttgccatgggcagcacagaatgtctgctgctgggcatgatggcctttgacagatatgtggccatctgcaaccccctgcgctaccccatcatcctgagcaaggtggcctacgtgctgatggcctctgtgtcctggctgagcggcggcatcaacagcgctgtgcagaccctgctggccatgaggctgcccttctgtggcaacaacatcatcaaccactttgcctgtgagatcctggccgtgctgaagctggcctgtgccgacatcagcctgaacatcatcaccatggtgatcagcaacatggccttcctggtgctgcccctgatggtgatcttcttctcctacatgttcatcctgtacaccatcctgcagatgaacagcgccaccggccgcaggaaggccttcagcacctgcagcgcccacctgactgtggtgatcatcttctacggcaccatcttcttcatgtatgccaagcccaagagccaggacctgattggagaggagaagctgcaggccctggacaagctgatcagcctcttctacggcgtggtgacccccatgctgaaccccatcctgtacagcctgaggaacaaggatgtgaaggctgctgtgaagtacctgctgaacaagaagcccatccactag

SEQ ID NO: 36265 - DNA, 957 bp, Artificial Sequence
  Description of Artificial Sequence: Synthetic coding sequence
atggacaagatcaaccagacctttgtgcgggagttcatcctgctgggcctgagcggctaccccaagctggagatcatcttctttgccctgatcctggtgatgtatgtggtgatcctgattggaaatggagtgctgatcatcgccagcatcctggacagccggctgcacatgcccatgtacttcttcctgggcaacctgtccttcctggacatctgctacaccaccagcagcatccccagcaccctggtgtccctcatcagcaagaagaggaacatctccttcagcggctgtgctgtgcagatgttctttggatttgccatgggcagcacagagtgcttcctgctgggcatgatggcctttgacagatatgtggccatctgcaaccccctgcgctaccccatcatcatgaacaaggtggtgtatgtgctgctgacctctgtgtcctggctgagcggcggcatcaacagcacagtgcagaccagcctggccatgcgctggcccttctgtggcaacaacatcatcaaccacttcctgtgtgagatcctggccgtgctgaagctggcctgcagcgacatctctgtgaacatcgtgaccctggccgtgagcaacatcgccttcctggtgctgcccctgctggtgatcttcttctcctacatgttcatcctgtacaccatcctgcggaccaacagcgccaccggccgccacaaggccttcagcacctgcagcgcccacctgactgtggtgatcatcttctacggcaccatcttcttcatgtatgccaagcccaagagccaggacctgctgggcaaggacaacctgcaggccacagagggcctggtgtccatgttctacggcgtggtgacccccatgctgaaccccatcatctacagcctgaggaacaaggatgtgaaggccgccatcaagtacctgctgagcaggaaggccatcaaccagtag

SEQ ID NO: 36266 - DNA, 1041 bp, Artificial Sequence
  Description of Artificial Sequence: Synthetic coding sequence
atgttcatccaggtgatcttctacatctgctgcctggccgtgaagatcctgtacatcggcagcagctttggcatcctgaaggctgacatggacaagatcaaccagacctttgtgcgggagttcatcctgctgggcctgagcggctaccccaagctggagatcatcttctttgccctgatcctggtgatgtatgtggtgatcctgattggaaatggagtgctgatcatcgccagcatcctggacagccggctgcacatgcccatgtacttcttcctgggcaacctgtccttcctggacatctgctacaccaccagcagcatccccagcaccctggtgtccctcatcagcaagaagaggaacatctccttcagcggctgtgctgtgcagatgttcttcggctttgccatgggcagcacagagtgcttcctgctgggcatgatggcctttgaccgctacgtggccatctgcaaccccctgcgctaccccatcatcatgaacaaggtggtgtatgtgctgctgacctctgtgtcctggctgagcggcggcatcaacagcacagtgcagaccagcctggccatgcgctggcccttctgtggcaacaacatcatcaaccacttcctgtgtgagatcctggccgtgctgaagctggcctgcagcgacatctctgtgaacatcgtgaccctggccgtgagcaacatcgccttcctggtgctgcccctgctggtgatcttcttctcctacatgttcatcctgtacaccatcctgcggaccaacagcgccaccggccgccacaaggccttcagcacctgcagcgcccacctgactgtggtgatcatcttctacggcaccatcttcttcatgtatgccaagcccaagagccaggacctgctgggcaaggacaacctgcaggccacagagggcctggtgtccatgttttatggagtggtgacccccatgctgaaccccatcatctacagcctgaggaacaaggatgtgaaggccgccatcaagtacctgctgagcaggaaggccatcaactag

SEQ ID NO: 36267 - DNA, 957 bp, Artificial Sequence
  Description of Artificial Sequence: Synthetic coding sequence
atggagtgggagaaccacaccatcctggtggagttcttcctgaagggcctgagcggccacccccggctggagctgctcttctttgtgctgatcttcatcatgtatgtggtgatcctgctgggcaatggcaccctcatcctgatcagcatcctggacccccacctgcacacccccatgtacttcttcctgggcaacctgtccttcctggacatctgctacaccaccaccagcatccccagcaccctggtgtccttcctgtctgagaggaagaccatcagcctgagcggctgtgctgtgcagatgttcctgagcctggccatgggcaccacagaatgtgtgctgctgggcgtgatggcctttgacagatatgtggccatctgcaaccccctgcgctaccccatcatcatgagcaaggatgcctacgtgcccatggccgccggctcctggatcattggagctgtgaacagcgctgtgcagacagtgtttgtggtgcagctgcccttctgcaggaacaacatcatcaaccacttcacctgtgagatcctggccgtgatgaagctggcctgtgccgacatctctggaaatgagttcatcctgctggtgaccaccaccctcttcctgctgacccccctgctgctgatcatcgtgtcctacaccctcatcatcctgagcatcttcaagatcagcagcagcgagggccgcagcaagcccagcagcacctgcagcgcccggctgactgtggtgatcaccttctgtggcaccatcttcctgatgtacatgaagcccaagagccaggagaccctgaacagtgatgacctggatgccacagacaagctgatcttcatcttctacagagtgatgacccccatgatgaaccccctcatctacagcctgaggaacaaggatgtgaaggaggccgtgaagcacctgctgcggaggaagaacttcaacaagtag

SEQ ID NO: 36268 - DNA, 963 bp, Artificial Sequence
  Description of Artificial Sequence: Synthetic coding sequence
atggagaggaccaatgacagcaccagcacagagttcttcctggtgggcctgagcgcccaccccaagctgcagacagtgttctttgtgctgatcctgtggatgtacctgatgatcctgctgggcaatggagtgctgatcagcgtcatcatctttgacagccacctgcacacccccatgtacttcttcctgtgcaacctgtccttcctggatgtgtgctacaccagcagctctgtgcccctcatcctggccagcttcctggccgtgaagaagaaggtgtccttcagcggctgcatggtgcagatgttcatcagctttgccatgggcgccacagagtgcatgatcctgggcaccatggccctggacagatatgtggccatctgctaccccctgcgctaccctgtgatcatgagcaagggggcctacgtggccatggccgccggctcctgggtgacaggcctggtggacagcgtggtgcagacagcctttgccatgcagctgcccttctgtgccaacaacgtcatcaagcactttgtgtgtgagatcctggccatcctgaagctggcctgtgccgacatcagcatcaacgtcatctccatgacaggcagcaacctgattgtgctggtgatccccctgctggtgatcagcatctcctacatcttcatcgtggccaccatcctgcgcatccccagcacagagggcaagcacaaggccttcagcacctgcagcgcccacctgactgtggtgatcatcttctacggcaccatcttcttcatgtatgccaagccagagagcaaggcctctgtggacagcggaaatgaagacatcatcgaggccctgatcagcctcttctacggcgtgatgacccccatgctgaaccccctcatctacagcctgaggaacaaggatgtgaaggctgctgtgaagaacatcctgtgcaggaagaacttcagtgatggcaagtag

SEQ ID NO: 36269 - DNA, 957 bp, Artificial Sequence
  Description of Artificial Sequence: Synthetic coding sequence
atggagtgggagaaccagaccatcctggtggagttcttcctgaagggccacagcgtgcacccccggctggagctgctcttctttgtgctgatcttcatcatgtatgtggtgatcctgctgggcaatggcaccctcatcctgatcagcatcctggacccccacctgcacacccccatgtacttcttcctgggcaacctgtccttcctggacatctgctacaccaccaccagcatccccagcaccctggtgtccttcctgtctgagaggaagaccatctccttcagcggctgtgctgtgcagatgttcctgggcctggccatgggcaccacagaatgtgtgctgctgggcatgatggcctttgacagatatgtggccatctgcaaccccctgcgctaccccatcatcatgagcaagaatgcctacgtgcccatggctgtgggctcctggtttgctggcatcgtgaacagcgctgtgcagaccacctttgtggtgcagctgcccttctgcaggaagaatgtcatcaaccacttcagctgtgagatcctggccgtgatgaagctggcctgtgccgacatctctggaaatgagttcctgatgctggtggccaccatcctcttcaccctgatgcccctgctgctgattgtcatctcctacagcctcatcatcagcagcatcctgaagatccacagcagcgagggccgcagcaaggccttcagcacctgcagcgcccacctgactgtggtgatcatcttctacggcaccatcctcttcatgtacatgaagcccaagagcaaggagaccctgaacagtgatgacctggatgccacagacaagatcatctccatgttctacggcgtgatgacccccatgatgaaccccctcatctacagcctgaggaacaaggatgtgaaggaggccgtgaagcacctgcccaacagacgcttcttcagcaagtag

SEQ ID NO: 36270 - DNA, 1041 bp, Artificial Sequence
  Description of Artificial Sequence: Synthetic coding sequence
atgtaccgcttcacagactttgatgtgagcaacatcagcatctacctgaaccacgtgctcttctacaccacccagcaggccggggacctggagcacatggagaccaggaactacagcgccatgacagagttcttcctggtgggcctgagccagtacccagagctgcagctgttcctgttcctgctgtgcctgatcatgtacatgatcatcctgctgggcaacagcctgctgatcatcatcaccatcctggacagccggctgcacacccccatgtacttcttcctgggcaacctgtccttcctggacatctgctacaccagcagcagcatcccccccatgctgatcatcttcatgtctgagaggaagagcatctccttcatcggctgtgccctgcagatggtggtgtccctgggcctgggcagcacagaatgtgtgctgctggccgtgatggcctatgaccactacgtggccatctgcaaccccctgcgctacagcatcatcatgaatggagtgctgtatgtgcagatggccgcctggagctggatcatcggctgcctgaccagcctgctgcagacagtgctgaccatgatgctgcccttctgtggcaacaacgtcatcgaccacatcacctgtgagatcctggccctgctgaagctggtgtgcagcgacatcaccatcaacgtgctgatcatgacagtgaccaacatcgtgtccctggtgatcctgctgctgctgatcttcatctcctatgtgttcatcctgagcagcatcctgcgcatcaactgtgccgagggcaggaagaaggccttcagcacctgcagcgcccacagcatcgtggtgatcctcttctacggcagcgccctcttcatgtacatgaagcccaagagcaagaacaccaacaccagtgatgagatcatcggcctgtcctatggagtggtgagccccatgctgaaccccatcatctacagcctgaggaacaaggaggtgaaggaggccgtgaagaaggtgctgagccgccacctgcacctgctgaagatgtag

SEQ ID NO: 36271 - DNA, 960 bp, Artificial Sequence
  Description of Artificial Sequence: Synthetic coding sequence
atgtttcctgccaactggacctctgtgaaggtgttcttcttcctgggcttcttccactaccccaaggtgcaggtgatcatctttgctgtgtgcctgctgatgtacctgatcaccctgctgggcaacatcttcctgatcagcatcaccatcctggacagccacctgcacacccccatgtacctgttcctgagcaacctgtccttcctggacatctggtacagcagcagcgccctgagccccatgctggccaactttgtgtctggaagaaacaccatctccttcagcggctgtgccacccagatgtacctgagcctggccatgggcagcacagaatgtgtgctgctgcccatgatggcctatgacagatatgtggccatctgcaaccccctgcgctaccctgtgatcatgaacagaaggacctgtgtgcagattgctgctggctcctggatgacaggctgcctgacagccatggtggagatgatgtctgtgctgcccctgagcctgtgtggcaacagcatcatcaaccacttcacctgtgagatcctggccatcctgaagctggtgtgtgtggacaccagcctggtgcagctgatcatgctggtgatctctgtgctgctgctgcccatgcccatgctgctgatctgcatctcctatgccttcatcctggccagcatcctgcgcatcagctctgtggagggccgcagcaaggccttcagcacctgcacagcccacctgatggtggtggtgctcttctacggcacagccctgtccatgcacctgaagcccagcgctgtggacagccaggagattgacaagttcatggccctggtgtatgccggccagacccccatgctgaaccccatcatctacagcctgaggaacaaggaggtgaaggtggccctgaagaagctgctgatccggaaccacttcaacacagccttcatcagcatcctgaagtag

SEQ ID NO: 36272 - DNA, 927 bp, Artificial Sequence
  Description of Artificial Sequence: Synthetic coding sequence
atggccatggacaacgtgacagctgtgttccagttcctgctgattggcatcagcaactacccccagtggagggacaccttcttcaccctggtgctgatcatctacctgagcaccctgctgggcaatggcttcatgatcttcctgatccactttgaccccaacctgcacacccccatctacttcttcctgagcaacctgtccttcctggacctgtgctatggaacagcctccatgccccaggccctggtgcactgcttcagcacccacccctacctgagctacccccgctgcctggcccagacctctgtgtccctggccctggccacagcagaatgtctgctgctggccgccatggcctatgacagagtggtggccatcagcaaccccctgcgctacagcgtggtgatgaatggacctgtgtgtgtgtgcctggtggccacctcctggggcaccagcctggtgctgacagccatgctgatcctgagcctgcggctgcacttctgtggggccaacgtcatcaaccactttgcctgtgagatcctgagcctcatcaagctgacctgcagcgacaccagcctgaatgagttcatgatcctgatcaccagcatcttcaccctgctgctgcccttcggctttgtgctgctgagctacatccgcatcgccatggccatcatccgcatccgcagcctgcagggccgcctgaaggccttcaccacctgtggcagccacctgactgtggtgaccatcttctacggcagcgccatctccatgtacatgaagacccagagcaagagctacccagaccaggacaagttcatcagcgtcttctatggagccctgacccccatgctgaaccccctcatctacagcctgaggaagaaggatgtgaagagggccatcaggaaggtgatgctgaagaggacatag

SEQ ID NO: 36273 - DNA, 939 bp, Artificial Sequence
  Description of Artificial Sequence: Synthetic coding sequence
atggagcccctgaacagaacagaggtgtctgagttcttcctgaagggcttcagcggctacccagccctggagcacctgctcttccccctgtgcagcgccatgtacctggtgaccctgctgggcaacacagccatcatggctgtgtctgtgctggacatccacctgcacacccctgtgtacttcttcctgggcaacctgagcaccctggacatctgctacacccccacctttgtgcccctgatgctggtgcacctgctgagcagcaggaagaccatcagctttgctgtgtgtgccatccagatgtgcctgagcctgagcacaggcagcacagaatgtctgctgctggccatcacagcctatgaccgctacctggccatctgccagcccctgcgctaccacgtgctgatgagccaccggctgtgtgtgctgctgatgggcgccgcctgggtgctgtgcctgctgaagtctgtgacagagatggtgatctccatgaggctgcccttctgtggccaccacgtggtgagccacttcacctgcaagatcctggccgtgctgaagctggcctgtggcaacacctctgtgtctgaggacttcctgctggccggcagcatcctgctgctgcctgtgcccctggccttcatctgcctgagctacctgctgatcctggccaccatcctgcgggtgcccagcgctgcccgctgctgcaaggccttcagcacctgcctggcccacctggccgtggtgctgctcttctacggcaccatcatcttcatgtacctgaagcccaagagcaaggaggcccacatcagtgatgaggtgttcaccgtgctgtatgccatggtgaccaccatgctgaaccccaccatctacagcctgaggaacaaggaggtgaaggaggccgccaggaaggtgtggggccgcagccgggccagcaggtag

SEQ ID NO: 36274 - DNA, 930 bp, Artificial Sequence
  Description of Artificial Sequence: Synthetic coding sequence
atggccaacctgaccatcgtgacagagttcatcctgatgggcttcagcaccaacaagaacatgtgcatcctgcacagcatcctcttcctgctgatctacctgtgtgccctgatgggaaatgtgctgatcatcatgatcaccaccctggaccaccacctgcacacccctgtgtacttcttcctgaagaacctgtccttcctggacctgtgcctgatctctgtgacagcccccaagagcatcgccaacagcctcatccacaacaacagcatctccttcctgggctgtgtgtcccaggtgttcctgctgctgagcagcgccagcgctgagctgctgctgctgactgtgatgagctttgaccgctacacagccatctgccaccccctgcactatgatgtgatcatggacaggagcacctgtgtgcagagggccaccgtgtcctggctgtatggaggcctgattgctgtgatgcacacagctggcaccttcagcctgagctactgcggcagcaacatggtgcaccagttcttctgtgacatcccccagctgctggccatcagctgcagtgaaaatctcatccgggagatcgccctgatcctgatcaacgtggtgctggacttctgctgcttcatcgtcatcatcatcacctacgtgcacgtgttcagcacagtgaagaagatccccagcacagagggccagagcaaggcctacagcatctgcctgccccacctgctggtggtgctcttcctgagcacaggcttcatcgcctacctgaagccagccagcgagagccccagcatcctggatgctgtgatcagcgtcttctacaccatgctgccccccaccttcaaccccatcatctacagcctgaggaacaaggccatcaaggtggccctgggcatgctgatcaagggcaagctgaccaagaagtag

SEQ ID NO: 36275 - DNA, 945 bp, Artificial Sequence
  Description of Artificial Sequence: Synthetic coding sequence
atggccaacgtgaccctggtgacaggcttcctgctgatgggcttcagcaacatccagaagctgcgcatcctgtatggagtgctcttcctgctgatctacctggccgccctgatgagcaacctgctgatcatcaccctcatcaccctggatgtgaagctgcagacccccatgtacttcttcctgaagaacctgtccttcctggatgtgttcctggtgtctgtgcccatccccaagttcatcgtgaacaacctgacccacaacaacagcatcagcatcctgggctgtgccttccagctgctgctgatgaccagcttctctgctggggagatcttcatcctgacagccatgtcctatgacagatatgtggccatctgctgccccctgaactatgaggtgatcatgaacacaggagtgtgtgtgctgatggcctctgtgtcctgggccatcggcggcctgtttggaacagcctacacagctggcaccttctccatgcccttctgtggcagcagcgtcatcccccagttcttctgtgatgtgcccagcctgctgcgcatcagctgcagcgagaccctgatggtgatctatgccggcatcggcgtgggcgcctgcctgagcatcagctgcttcatctgcatcgtcatctcctacatctacatcttcagcacagtgctgaagatccccaccaccaagggccagagcaaggccttcagcacctgcttcccccacctgaccgtcttcaccgtcttcatcatcacagcctactttgtgtacctgaagccacccagcaacagccccagcgtcatcgaccggctgctgagcgtcatctacacagtgatgcctcctgtgttcaaccctgtgacctacagcctgagaaataatgacatgaagtgtgccctgatccggctgctgcagaagacctacggccaggaggcctacttcatctag

SEQ ID NO: 36276 - DNA, 939 bp, Artificial Sequence
  Description of Artificial Sequence: Synthetic coding sequence
atgcccaacagcaccaccgtgatggagttcctgctgatgaggttcagtgatgtgtggaccctgcagatcctgcacagcgccagcttcttcatgctgtacctggtgaccctgatgggcaacatcctgattgtgacagtgaccacctgtgacagcagcctgcacatgcccatgtacttcttcctgaggaacctgagcatcctggatgcctgctacatctctgtgacagtgcccaccagctgtgtgaacagcctgctggacagcaccaccatcagcaaggccggctgtgtggcccaggtgttcctggtggtgttctttgtgtatgtggagctgctcttcctgaccatcatggcccatgacagatatgtggccgtgtgccagcccctgcactaccctgtgattgtgaacagccgcatctgcatccagatgaccctggccagcctgctgagcggcctggtgtatgccggcatgcacacaggcagcaccttccagctgcccttctgccgcagcaatgtcatccaccagttcttctgtgacatccccagcctgctgaagctgagctgcagcgacaccttcagcaatgaggtgatgattgtggtgtctgccctgggcgtgggcggcggctgcttcatcttcatcatccgcagctacatccacatcttcagcacagtgctgggcttccccagaggagctgacaggaccaaggccttcagcacctgcatcccccacatcctggtggtgtctgtgttcctgagcagctgcagctctgtgtacctgcggcccccagccatcccagctgccacccaggacctgatcctgagcggcttctacagcatcatgccacccctcttcaaccccatcatctacagcctgaggaacaagcagatcaaggtggccatcaagaagatcatgaagaggatcttctacagtgaaaatgtgtag

SEQ ID NO: 36277 - DNA, 3666 bp, Artificial Sequence
  Description of Artificial Sequence: Synthetic coding sequence
atgatgttcagaagtgacaggatgtggagctgccactggaagtggaagcccagccccctgctcttcctgtttgccctgtacatcatgtgtgtgccccacagcgtgtggggctgtgccaactgccgggtggtgctgagcaaccccagcggcaccttcaccagcccctgctacccaaatgactaccccaacagccaggcctgcatgtggaccctgcgggcccccaccggctacatcatccagatcaccttcaatgactttgacatcgaggaggcccccaactgcatctatgacagcctgagcctggacaatggagagagccagaccaagttctgtggggccacagccaagggcctgtccttcaacagcagcgccaatgagatgcacgtgtccttcagcagtgacttcagcatccagaagaagggcttcaatgccagctacatccgggtggccgtgtccctgaggaaccagaaggtgatcctgccccagaccagtgatgcctaccaggtgtctgtggccaagagcatcagcatccctgagctgagcgccttcaccctgtgctttgaggccaccaaggtgggccatgaagattctgactggacagccttctcctacagcaatgccagcttcacccagctgctgagctttgggaaggccaagagcggctacttcctgagcatcagtgacagcaagtgcctgctgaacaatgccctgcctgtgaaggagaaggaggacatctttgctgagagctttgagcagctgtgcctggtgtggaacaacagcctgggcagcattggagtgaacttcaagaggaactatgagaccgtgccctgtgacagcaccatcagcaaggtgattcctggaaatggcaagctgctgctgggcagcaaccagaatgagatcgtgtccctgaagggggacatctacaacttccggctgtggaacttcaccatgaatgccaagatcctgagcaacctgagctgcaatgtgaagggaaatgtggtggactggcagaatgacttctggaacatccccaacctggccctgaaggccgagagcaacctgagctgtggcagctacctgatccccctgcctgctgctgagctggccagctgtgccgacctgggcaccctgtgccaggccaccgtgaacagccccagcaccaccccacccaccgtgaccaccaacatgcctgtgaccaacagaattgacaagcagagaaatgatggcatcatctaccgcatctctgtggtgatccagaacatcctgcggcaccctgaggtgaaggtgcagagcaaggtggccgagtggctgaacagcaccttccagaactggaactacacagtgtatgtggtgaacatctccttccacctgtctgctggggaggacaagatcaaggtgaagaggagcctggaggatgagccccggctggtgctgtgggccctgctggtgtacaatgccaccaacaacaccaacctggagggcaagatcatccagcagaagctgctgaagaacaatgaaagcctggatgagggcctgcggctgcacacagtgaatgtgcggcagctgggccactgcctggccatggaggagcccaagggctactactggcccagcatccagcccagtgaatatgtgctgccctgcccagacaagccaggcttcagcgccagccgcatctgcttctacaatgccaccaaccccctggtgacctactggggccctgtggacatcagcaactgcctgaaggaggccaatgaggtggccaaccagatcctgaacctgacagcagatggccagaacctgaccagcgccaacatcaccaacatcgtggagcaggtgaagagaattgtgaacaaggaggagaacatcgacatcaccctgggcagcaccctgatgaacatcttcagcaacatcctgagcagcagtgacagcgacctgctggagagcagcagcgaggccctgaagaccattgatgagctggccttcaagattgacctgaacagcaccagccacgtgaacatcaccaccaggaacctggccctgtctgtgagcagcctgctgcccggcaccaatgccatcagcaacttcagcatcggcctgcccagcaacaatgaaagctacttccagatggactttgagagcggccaggtggaccccctggccagcgtcatcctgccccccaacctgctggagaacctgagccctgaggacagcgtgctggtgcggcgggcccagttcaccttcttcaacaagacaggcctcttccaggatgtgggcccccagaggaagaccctggtgtcctatgtgatggcctgcagcatcggcaacatcaccatccagaacctgaaggaccctgtgcagatcaagatcaagcacaccaggacccaggaggtgcaccaccccatctgtgccttctgggacctgaacaagaacaagagctttggaggctggaacaccagcggctgtgtggcccaccgggacagtgatgccagcgagaccgtgtgcctgtgcaaccacttcacccactttggagtgctgatggacctgcccaggtctgccagccagctggatgccaggaacaccaaggtgctgaccttcatctcctacatcggctgcggcatcagcgccatcttctctgctgccaccctgctgacctacgtggcctttgagaagctgcggcgggactaccccagcaagatcctgatgaacctgagcacagccctgctcttcctgaacctgctcttcctgctggatggctggatcaccagcttcaacgtggatggcctgtgcatcgctgtggccgtgctgctgcacttcttcctgctggccaccttcacctggatgggcctggaggccatccacatgtacatcgccctggtgaaggtgttcaacacctacatccgccgctacatcctgaagttctgcatcatcggctggggcctgcctgccctggtggtgtctgtggtgctggccagcaggaacaacaatgaggtgtatggcaaggagagctatggcaaggagaagggagatgagttctgctggatccaggaccccgtcatcttctacgtgacctgtgccggctactttggagtgatgttcttcctgaacatcgccatgtttattgtggtgatggtgcagatctgtggcagaaatggcaagaggagcaacagaaccctgcgggaggaggtgctgaggaacctgcggtctgtggtgtccctgaccttcctgctgggcatgacctggggctttgccttctttgcctggggccccctgaacatccccttcatgtacctgttcagcatcttcaacagcctgcagggcctcttcatcttcatcttccactgtgccatgaaggaaaatgtgcagaagcagtggaggcagcacctgtgctgcggccgcttccggctggccgacaacagcgactggagcaagacagccaccaacatcatcaagaagagcagtgacaacctgggcaagagcctgagcagcagcagcatcggcagcaacagcacctacctgaccagcaagagcaagagcagcagcaccacctacttcaagaggaacagccacacagacaacgtgtcctatgagcacagcttcaacaagagcggcagcctgcggcagtgcttccacggccaggtgctggtgaagacaggcccctgctag

SEQ ID NO: 36278 - DNA, 966 bp, Artificial Sequence
  Description of Artificial Sequence: Synthetic coding sequence
atggtgaacctgacctccatgagcggcttcctgctgatgggcttcagtgatgagaggaagctgcagatcctgcacgccctggtgttcctggtgacctacctgctggccctgaccggcaacctgctgatcatcaccatcatcaccgtggaccggcggctgcacagccccatgtactacttcctgaagcacctgagcctgctggacctgtgcttcatctctgtgacagtgccccagagcatcgccaacagcctgatgggaaatggctacatcagcctggtgcagtgcatcctgcaggtgttcttcttcatcgccctggccagcagcgaggtggccatcctgactgtgatgtcctatgacagatatgctgccatctgccagcccctgcactatgagaccatcatggacccccgggcctgcagacatgctgtgattgctgtgtggattgctgggggcctgagcggcctgatgcacgccgccatcaacttcagcatccccctgtgtgggaagagggtcatccaccagttcttctgtgatgtgccccagatgctgaagctggcctgcagctatgagttcatcaatgaaattgccctggccgccttcaccaccagcgctgccttcatctgcctgatcagcatcgtgctgagctacatccgcatcttcagcacagtgctgcgcatccccagcgctgagggccgcaccaaggtgttcagcacctgcctgccccacctgtttgtggccaccttcttcctgtctgctgctggctttgagttcctgcggctgcccagcgacagcagcagcacagtggacctggtgttttctgtgttctacaccgtcatcccccccaccctgaaccctgtgatctacagcctgagaaatgacagcatgaaggccgccctgaggaagatgctgagcaaggaggagctgccccagaggaagatgtgcctgaaggccatgttcaagctgtag

SEQ ID NO: 36279 - DNA, 966 bp, Artificial Sequence; identical to SEQ ID NO: 36278
  Description of Artificial Sequence: Synthetic coding sequence

SEQ ID NO: 36280 - DNA, 945 bp, Artificial Sequence
  Description of Artificial Sequence: Synthetic coding sequence
atgaccaaccagacccagatgatggagttcctgctggtgcgcttcacagagaactgggtgctgctgcggctgcacgccctgctcttcagcctcatctacctgacagctgtgctgatgaacctggtgatcatcctgctgatgatcctggaccaccggctgcacatggccatgtacttcttcctgcggcacctgtccttcctggacctgtgcctgatcagcgccaccgtgcccaagagcatcctgaacagcgtggccagcacagacagcatctccttcctgggctgtgtgctgcagctgttcctggtggtgctgctggccggcagcgagatcggcatcctgacagccatgtcctatgacagatatgctgccatctgctgccccctgcactgtgaggccgtgatgagccggggcctgtgtgtgcagctgatggccctgtcctggctgaacagaggagccctgggcctgctgtacacagctggcaccttcagcctgaacttctacggcagtgatgagctgcaccagttcttctgtgatgtgcctgccctgctgaagctgacctgcagcaaggagcacgccatcatctctgtgtctgtggccatcggcgtgtgctacgccttcagctgcctggtgtgcatcgtggtgtcctatgtgtacatcttctctgctgtgctgcgcatcagccagaggcagaggcagagcaaggccttcagcaactgtgtgccccacctgattgtggtgacagtgttcctggtgactggagctgtggcctacctgaagccaggcagtgatgcccccagcatcctggacctgctggtgtctgtgttctacagcgtggccccacccaccctgaaccctgtgatctactgcctgaagaacaaggacatcaagagcgccctgagcaaggtgctgtggaatgtgcgcagcagtggagtgatgaagaggtag

SEQ ID NO: 36281 - DNA, 933 bp, Artificial Sequence
  Description of Artificial Sequence: Synthetic coding sequence
atgggagagaaccagaccatggtgacagagttcctgctgctgggcttcctgctgggcccccgcatccagatgctgctgtttggcctcttcagcctcttctacatcttcaccctgctgggcaatggagccatcctgggcctcatcagcctggacagccggctgcacacccccatgtacttcttcctgagccacctggccgtggtggacatcgcctacaccaggaacacagtgccccagatgctggccaacctgctgcacccagccaagcccatcagctttgctggctgcatgacccagaccttcctgtgcctgagctttggccacagcgagtgcctgctgctggtgctgatgtcctatgaccgctacgtggccatctgccaccccctgcgctacagcgtcatcatgacctggagggtgtgcatcaccctggccgtgacctcctggacctgtggcagcctgctggccctggcccacgtggtgctgatcctgcggctgcccttcagcggcccccatgagatcaaccacttcttctgtgagatcctgtctgtgctgcggctggcctgtgccgacacctggctgaaccaggtggtgatctttgctgcctgtgtgttcttcctggtgggcccccccagcctggtgctggtgtcctacagccacatcctggccgccatcctgcgcatccagagcggggagggccgcaggaaggccttcagcacctgcagcagccacctgtgtgtggtgggcctcttctttggaagtgccatcatcatgtacatggcccccaagagccgccaccctgaggagcagcagaaggtgttcttcctgttctacagcttcttcaaccccaccctgaaccccctcatctacagcctgagaaatggagaggtgaagggggccctgcggcgggccctgggcaaggagagccacagctag

SEQ ID NO: 36282 - DNA, 933 bp, Artificial Sequence
  Description of Artificial Sequence: Synthetic coding sequence
atggagagcaaccagacctggatcacagaggtgatcctgctgggcttccaggtggaccctgccctggagctgttcctgtttggcttcttcctgctcttctacagcctgaccctgatgggaaatggcatcatcctgggcctcatctacctggacagccggctgcacacccccatgtatgtgttcctgagccacctggccatcgtggacatgtcctatgccagcagcacagtgcccaagatgctggccaacctggtgatgcacaagaaggtgatcagctttgccccctgcatcctgcagaccttcctgtacctggcctttgccatcacagagtgcctgatcctggtgatgatgtgctatgaccgctacgtggccatctgccaccccctgcagtacaccctcatcatgaactggagggtgtgcaccgtgctggccagcacctgctggatcttctccttcctgctggccctggtgcacatcaccctcatcctgcggctgcccttctgtggcccccagaagatcaaccacttcttctgccagatcatgtctgtgttcaagctggcctgtgccgacacccggctgaaccaggtggtgctgtttgctggcagcgccttcatcctggtgggccccctgtgcctggtgctggtgtcctacctgcacatcctggtggccatcctgcgcatccagagcggggagggccgcaggaaggccttcagcacctgcagcagccacctgtgtgtggtgggcctcttctttggaagtgccatcgtgatgtacatggcccccaagagcagccacagccaggagaggaggaagatcctgagcctcttctacagcctcttcaaccccatcctgaaccccctcatctacagcctgagaaatgctgaggtgaagggggccctgaagagggtgctgtggaagcagaggtccatgtag

SEQ ID NO: 36283 - DNA, 933 bp, Artificial Sequence
  Description of Artificial Sequence: Synthetic coding sequence
atggagggcaacaagacctggatcacagacatcaccctgccccgcttccaggtgggccctgccctggagatcctgctgtgtggcctcttcagcgccttctacaccctgaccctgctgggcaatggagtcatcttcggcatcatctgcctggactgcaagctgcacacccccatgtacttcttcctgagccacctggccatcgtggacatctcctatgccagcaactacgtgcccaagatgctgaccaacctgatgaaccaggagagcaccatctccttcttcccctgcatcatgcagaccttcctgtacctggcctttgcccacgtggagtgcctgatcctggtggtgatgtcctatgacagatatgctgacatctgccaccccctgcgctacaacagcctgatgtcctggagggtgtgcaccgtgctggccgtggcctcctgggtgttctccttcctgctggccctggtgcccctggtgctgatcctgagcctgcccttctgtggcccccatgagatcaaccacttcttctgtgagatcctgtctgtgctgaagctggcctgtgccgacacctggctgaaccaggtggtgatctttgctgcctgtgtgttcatcctggtgggccccctgtgcctggtgctggtgtcctacctgcgcatcctggccgccatcctgcgcatccagagcggggagggccgcaggaaggccttcagcacctgcagcagccacctgtgtgtggtgggcctcttctttggaagtgccatcgtgacctacatggcccccaagagccgccaccctgaggagcagcagaaggtgctgagcctcttctacagcctcttcaaccccatgctgaaccccctcatctacagcctgagaaatgctgaggtgaagggggccctgcggcgggccctgaggaaggagcggctgacctag

SEQ ID NO: 36284 - DNA, 957 bp, Artificial Sequence
  Description of Artificial Sequence: Synthetic coding sequence
atggagggcaaccagacctggatcacagacatcaccctgctgggcttccaggtgggccctgccctggccatcctgctgtgtggcctcttctctgtgttctacaccctgaccctgctgggcaatggagtcatcttcggcatcatctgcctggacagcaagctgcacacccccatgtacttcttcctgagccacctggccatcatcgacatgtcctatgccagcaacaacgtgcccaagatgctggccaacctgatgaaccagaagaggaccatcagctttgtgccctgcatcatgcagaccttcctgtacctggcctttgctgtgacagagtgcctgatcctggtggtgatgtcctatgaccgctacgtggccatctgccaccccttccagtacaccgtcatcatgtcctggagggtgtgcaccatcctggtgctgacctcctggagctgtggctttgccctgagcctggtgcatgagatcctgctgctgcggctgcccttctgtggccccagagatgtgaaccacctgttctgtgagatcctgtctgtgctgaagctggcctgtgccgacacctgggtgaaccaggtggtgatctttgccacctgtgtgtttgtgctggtgggccccctgagcctcatcctggtgtcctacatgcacatcctgggcgccatcctgaagatccagaccaaggagggccgcatcaaggccttcagcacctgcagcagccacctgtgtgtggtgggcctcttctttggaattgccatggtggtgtacatggtgcctgacagcaaccagcgggaggagcaggagaagatgctgagcctcttccacagcgtcttcaaccccatgctgaaccccctcatctacagcctgagaaatgcccagctgaagggggccctgcaccgggccctgcagaggaagaggtccatgaggacagtgtatggcctgtgcctgtag

SEQ ID NO: 36285 - DNA, 933 bp, Artificial Sequence
  Description of Artificial Sequence: Synthetic coding sequence
atgggcggcaaccagaccagcatcacagagttcctgctgctgggcttccccatcggcccccgcatccagatgctgctgtttggcctcttcagcctcttctacatcttcatcctgctgggcaatggcaccatcctgggcctcatcagcctggacagccggctgcacacccccatgtacttcttcctgagccacctggccgtggtggacatcgcctgtgcctgcagcacagtgccccagatgctggtgaacctgctgcacccagccaagcccatcagctttgctggctgcatgacccagatgttcctgttcctgagctttgcccacacagagtgcctgctgctggtggtgatgtcctatgaccgctacgtggccatctgccaccccctgcgctacagcaccatcatgacctggaaggtgtgcatcaccctggccctgacctcctggatcctgggcgtgctgctggccctggtgcacctggtgctgctgctgcccctgtccttctgtggcccccagaagctgaaccacttcttctgtgagatcatggctgtgctgaagctggcctgtgccgacacccacatcaatgaggtgatggtgctggccggggctgtgtctgtgctggtgggcgccttcttcagcaccgtcatctcctatgtgcacatcctgtgtgccatcctgaagatccagagcggggagggctgccagaaggccttcagcatctgcagcagccacctgtgtgtggtgggcctcttctatggaacagccatcatcatgtatgtggagccccagtatgagagccccaaggagcagaagaagtacctgctgctcttccacagcctcttcaaccccatgctgaaccccctcatctacagcctgaggaacaaggaggtgcagggcaccctgaagaggatgctggagaagaagaggaccagctag

SEQ ID NO: 36286 - DNA, 933 bp, Artificial Sequence
  Description of Artificial Sequence: Synthetic coding sequence
atgggagacaacatcaccagcatccgggagttcctgctgctgggcttccctgtgggcccccgcatccagatgctgctgtttggcctcttcagcctcttctacgtgttcaccctgctgggcaatggcaccatcctgggcctcatcagcctggacagccggctgcacgcccccatgtacttcttcctgagccacctggccgtggtggacatcgcctatgcctgcaacacagtgcccaggatgctggtgaacctgctgcacccagccaagcccatcagctttgctggccgcatgatgcagaccttcctgttcagcacctttgctgtgacagagtgcctgctgctggtggtgatgtcctatgacctgtatgtggccatctgccaccccctgcgctacctggccatcatgacctggagggtgtgcatcaccctggccgtgacctcctggaccaccggggtgctgctgagcctcatccacctggtgctgctgctgcccctgcccttctgccggccccagaagatctaccacttcttctgtgagatcctggccgtgctgaagctggcctgtgccgacacccacatcaatgaaaacatggtgctggccggggccatcagcggcctggtgggccccctgagcaccatcgtggtgtcctacatgtgcatcctgtgtgccatcctgcagatccagagccgggaggtgcagaggaaggccttccgcacctgcttcagccacctgtgtgtgattggcctggtgtatggaacagccatcatcatgtatgtgggccccaggtatggcaaccccaaggagcagaagaagtacctgctgctcttccacagcctcttcaaccccatgctgaaccccctcatctgcagcctgaggaacagcgaggtgaagaacaccctgaagagggtgctgggcgtggagcgggccctgtag

SEQ ID NO: 36287 - DNA, 933 bp, Artificial Sequence; identical to SEQ ID NO: 36281
  Description of Artificial Sequence: Synthetic coding sequence

SEQ ID NO: 36288 - DNA, 936 bp, Artificial Sequence
  Description of Artificial Sequence: Synthetic coding sequence
atgaccaagaaccagacctgggtgacagagttcatcctgctgggcttccccctgagcctgcgcatccagatgctgctgagcggcctcttcagcctgctgtatgtgttcaccctgctgggcaatggagccatcctgggcctcatctggctggacagccggctgcacacccccatgtacttcttcctgagccacctggccatcatcgacatctcctatgccagcaacaacgtgcccaagatgctgaccaacctgggcctgaacaagaggaagaccatcagctttgtgccctgcaccatgcagaccttcctgtacatggcctttgcccacacagaatgtctcatcctggtgatgatgtcctatgaccgctacatggccatctgccaccccctgcagtacagcgtcatcatgcgctggggcgtgtgcaccgtgctggccgtgacctcctgggcctgtggcagcctgctggccctggtgcacgtggtgctgatcctgcggctgcccttctgtggcccccatgagatcaaccacttcttctgtgagatcctgtctgtgctgaagctggcctgtgccgacacctggctgaaccaggtggtgatctttgctgcctctgtgttcatcctggtgggccccctgtgcctggtgctggtgtcctacagccgcatcctggccgccatcctgcgcatccagagcggggagggccgcaggaaggccttcagcacctgcagcagccacctgtgcatggtgggcctcttcttcggcagcgccatcgtgatgtacatggcccccaagagccgccaccctgaggagcagcagaaggtgctgagcctcttctacagcctcttcaaccccatgctgaaccccctcatctacagcctgagaaatgctgaggtgaagggggccctgaagagggtgctgtggaagcagaggagcaagtag

SEQ ID NO: 36289 - DNA, 933 bp, Artificial Sequence
  Description of Artificial Sequence: Synthetic coding sequence
atgggagacaacatcaccagcatcacagagttcctgctgctgggcttccctgtgggcccccgcatccagatgctgctgtttggcctcttcagcctcttctacgtgttcaccctgctgggcaatggcaccatcctgggcctcatcagcctggacagccggctgcacgcccccatgtacttcttcctgagccacctggccgtggtggacatcgcctatgcctgcaacacagtgcccaggatgctggtgaacctgctgcacccagccaagcccatcagctttgctggccgcatgatgcagaccttcctgttcagcacctttgctgtgacagagtgcctgctgctggtggtgatgtcctatgacctgtatgtggccatctgccaccccctgcgctacctggccatcatgacctggagggtgtgcatcaccctggccgtgacctcctggaccaccggggtgctgctgagcctcatccacctggtgctgctgctgcccctgcccttctgccggccccagaagatctaccacttcttctgtgagatcctggccgtgctgaagctggcctgtgccgacacccacatcaatgaaaacatggtgctggccggggccatcagcggcctggtgggccccctgagcaccatcgtggtgtcctacatgtgcatcctgtgtgccatcctgcagatccagagccgggaggtgcagaggaaggccttctgcacctgcttcagccacctgtgtgtgattggcctcttctatggaacagccatcatcatgtatgtgggccccaggtatggcaaccccaaggagcagaagaagtacctgctgctcttccacagcctcttcaaccccatgctgaaccccctcatctgcagcctgaggaacagcgaggtgaagaacaccctgaagagggtgctgggcgtggagcgggccctgtag

SEQ ID NO: 36290 - DNA, 972 bp, Artificial Sequence
  Description of Artificial Sequence: Synthetic coding sequence
atgtggcagaagaaccagaccagcctggccgacttcatcctggagggcctgtttgatgacagcctgacccacctgttcctgttcagcctgaccatggtggtgttcctgattgctgtgtctggcaacaccctgaccatcctgctgatctgcatcgacccccagctgcacacccccatgtacttcctgctgagccagctgagcctgatggacctgatgcacgtgtccaccatcatcctgaagatggccaccaactacctgagcggcaagaagagcatcagctttgtgggctgtgccacccagcacttcctgtacctgtgcctgggcggcgctgagtgcttcctgctggccgtgatgtcctatgacagatatgtggccatctgccaccccctgcgctatgctgtgctgatgaacaagaaggtgggcctgatgatggctgtgatgtcctggctgggcgcctctgtgaacagcctcatccacatggccatcctgatgcacttccccttctgtggccccaggaaggtgtaccacttctactgtgagttccctgctgtggtgaagctggtgtgtggggacatcaccgtgtatgagaccaccgtgtacatcagcagcatcctgctgctgctgcccatcttcctgatcagcaccagctatgtgttcatcctgcagagcgtcatccagatgaggagcagcggcagcaagagaaatgcctttgccacctgtggcagccacctgactgtggtgtccctgtggtttggagcctgcatcttctcctacatgaggcccaggagccagtgcaccctgctgcagaacaaggtgggcagcgtcttctacagcatcatcacccccaccctgaacagcctcatctacaccctgaggaacaaggatgtggccaaggccctgcggcgggtgctgcggagagatgtgatcacccagtgcatccagaggctgcagctgtggctgccccgggtgtag

SEQ ID NO: 36291 - DNA, 951 bp, Artificial Sequence
  Description of Artificial Sequence: Synthetic coding sequence
atggagctgtggaacttcaccctgggcagcggcttcatcctggtgggcatcctgaatgattctggcagccctgagctgctgtgtgccaccatcaccatcctgtacctgctggccctgatcagcaatggcctgctgctgctggccatcaccatggaggcccggctgcacatgcccatgtacctgctgctgggccagctgagcctgatggacctgctcttcacctctgtggtgacccccaaggccctggccgacttcctgcggcgggagaacaccatcagctttggaggctgtgccctgcagatgttcctggccctgaccatgggcggcgctgaggacctgctgctggccttcatggcctatgacagatatgtggccatctgccaccccctgacctacatgaccctgatgagcagccgggcctgctggctgatggtggccacctcctggatcctggccagcctgagcgccctgatctacacagtgtacaccatgcactaccccttctgccgggcccaggagatccgccacctgctgtgtgagatcccccacctgctgaaggtggcctgtgccgacaccagccgctatgagctgatggtgtatgtgatgggcgtgaccttcctgatccccagcctggccgccatcctggccagctacacccagatcctgctgactgtgctgcacatgcccagcaatgaaggaaggaagaaggccctggtgacctgcagcagccacctgactgtggtgggcatgttctacggggccgccaccttcatgtatgtgctgcccagcagcttccacagcacccggcaggacaacatcatctctgtgttctacaccatcgtgaccccagccctgaaccccctcatctacagcctgaggaacaaggaggtgatgagggccctgcggcgggtgctgggcaagtacatgctgcctgcccacagcaccctgtag

SEQ ID NO: 36292 - DNA, 987 bp, Artificial Sequence
  Description of Artificial Sequence: Synthetic coding sequence
atgggccaccagaaccacaccttcagcagtgacttcatcctgctgggcctcttcagcagcagccccacctctgtggtgttcttcctggtgctcttcgtcatcttcatcatgtctgtgacagagaacaccctgatgatcctgctgatccgcagtgacagccggctgcacacccccatgtacttcctgctgagccacctgagcctgatggacatcctgcacgtgagcaacatcgtgcccaagatggtgaccaacttcctgagcggcagcaggaccatcagctttgctggctgcggcttccaggtgttcctgagcctgaccctgctgggcggagaatgtctgctgctggccgccatgagctgtgacagatatgtggccatctgccaccccctgcgctaccccatcctgatgaaggagtatgccagcgccctgatggccggcggctcctggctgattggagtcttcaacagcacagtgcacacagcctatgccctgcagttccccttctgtggcagccgggccatcgaccacttcttctgtgaggtgcctgccatgctgaagctgagctgtgccgacaccaccaggtatgagcggggcgtgtgtgtgtctgctgtgatcttcctgctgatccccttcagcctcatcagcgccagctatggccagatcatcctgactgtgctgcagatgaagagcagcgaggccaggaagaagagcttcagcacctgcagcttccacatgattgtggtgaccatgtactacggccccttcatcttcacctacatgaggcccaagagctaccacaccccaggccaggacaagttcctggccatcttctacaccatcctgacccccaccctgaaccccttcatctacagcttcaggaacaaggatgtgctggccgtgatgaagaacatgctgaagagcaacttcctgcacaagaagatgaacaggaagatcccagaatgtgtgttctgcctcttcctgtgctag

SEQ ID NO: 36293 - DNA, 1008 bp, Artificial Sequence
  Description of Artificial Sequence: Synthetic coding sequence
atgaacatcagtgatgtgatcagctttgacatcctggtgtctgccatgaagacaggcaaccagagctttggaacagacttcctgctggtgggcctcttccagtatggctggatcaacagcctgctgtttgtggtgattgccaccctcttcaccgtggccctgactggaaacatcatgctgatccacctgatccggctgaacacccggctgcacacccccatgtacttcctgctgagccagctgagcatcgtggacctgatgtacatcagcaccaccgtgcccaagatggctgtgtccttcctgagccagagcaagaccatccgcttcctgggctgtgagatccagacctacgtgttcctggccctgggcggcacagaggccctgctgctgggcttcatgtcctatgaccgctacgtggccatctgccaccccctgcactaccccatgctgatgagcaagaagatctgctgcctgatggtggcctgtgcctgggccagcggcagcatcaatgccttcatccacaccctgtatgtgttccagctgcccttctgccgcagccgcctcatcaaccacttcttctgtgaggtgcctgccctgctgagcctggtgtgccaggacaccagccagtatgagtacacagtgctgctgagcggcctcatcatcctgctgctgcccttcctggccatcctggccagctatgcccgggtgctgattgtggtgttccagatgagcagcggcaagggccaggccaaggctgtgtccacctgcagcagccacctgattgtggccagcctcttctacgccaccaccctcttcacctacacccggccccacagcctgcggagccccagccgggacaaggctgtggccgtgttctacaccatcgtgacccccctgctgaaccccttcatctacagcctgaggaacaaggaggtgactggagctgtgcggcggctgctgggctactggatctgctgcaggaaatatgacttccgcagcctgtactag

SEQ ID NO: 36294 - DNA, 930 bp, Artificial Sequence
  Description of Artificial Sequence: Synthetic coding sequence
atgaagaacaagacagtgctgacagagttcatcctgctgggcctgacagatgtgcctgagctgcaggtggccgtgttcaccttcctgttcctggcctacctgctgagcatcctgggcaacctgaccatcctgatcctgaccctgctggacagccacctgcagacccccatgtacttcttcctgaggaacttctccttcctggagatctccttcaccaacatcttcatcccccgggtgctgatcagcatcaccactggaaacaagagcatcagctttgctggctgcttcacccagtacttctttgccatgttcctgggcgccacagagttctacctgctggccgccatgtcctatgacagatatgtggccatctgcaagcccctgcactacaccaccatcatgagcagccgcatctgcatccagctgatcttctgctcctggctgggcggcctgatggccatcatccccaccatcaccctgatgagccagcaggacttctgtgccagcaaccggctgaaccactacttctgtgactatgagcccctgctggagctgagctgcagcgacaccagcctgattgagaaggtggtgttcctggtggcctctgtgaccctggtggtgaccctggtgctggtgatcctgtcctatgccttcatcatcaagaccatcctgaagctgcccagcgcccagcagaggaccaaggccttcagcacctgcagcagccacatgatcgtcatcagcctgtcctatggcagctgcatgttcatgtacatcaaccccagcgccaaggagggggacaccttcaacaagggcgtggccctgctgatcacctctgtggcccccctgctgaaccccttcatctacaccctgaggaaccagcaggtgaagcagcccttcaaggacatggtgaagaagctgctgaacctgtag

SEQ ID NO: 36295 - DNA, 963 bp, Artificial Sequence
  Description of Artificial Sequence: Synthetic coding sequence
atggatgccacagcctgcaatgaatctgtggatggcagccctgtgttctacctgctgggcatccccagcctgcctgagaccttcttcctgcctgtgttcttcatcttcctgctcttctacctgctgatcctgatgggaaatgccctgatcctggtggccgtggtggccgagcccagcctgcacaagcccatgtacttcttcctgatcaacctgagcaccctggacatcctcttcaccaccaccaccgtgcccaagatgctgagcctcttcctgctgggggaccgcttcctgtccttcagcagctgcctgctgcagatgtacctgttccagagcttcacctgcagcgaggccttcatcctggtggtgatggcctatgaccgctacgtggccatctgccaccccctgcactaccctgtgctgatgaacccccagaccaatgccaccctggccgccagcgcctggctgacagccctgctgctgcccatcccagctgtggtgaggaccagccagatggcctacaacagcatcgcctacatctaccactgcttctgtgaccacctggccgtggtgcaggccagctgcagcgacaccaccccccagaccctgatgggcttctgcatcgccatggtggtgtccttcctgcccctgctgctggtgctgctgtcctatgtgcacatcctggcctctgtgctgcgcatcagcagcctggagggccgggccaaggccttcagcacctgcagcagccacctgctggtggtgggcacctactacagcagcatcgccatcgcctacgtggcctacagagctgacctgcccctggacttccacatcatgggaaatgtggtgtatgccatcctgacccccatcctgaaccccctcatctacaccctgaggaacagagatgtgaaggccgccatcaccaagatcatgagccaggaccccggctgtgacaggagcatctag

SEQ ID NO: 36296 - DNA, 954 bp, Artificial Sequence
  Description of Artificial Sequence: Synthetic coding sequence
atgaagagtgacaaccacagcttcctgggggacagccccaaggccttcatcctgctgggcgtgtctgaccggccctggctggagctgcccctgtttgtggtgctgctgctgtcctatgtgctggccatgctgggcaatgtggccatcatcctggccagccgggtggacccccagctgcacagccccatgtacatcttcctgagccacctgtccttcctggacctgtgctacaccaccaccaccgtgccccagatgctggtgaacatgggcagcagccagaagaccatctcctatggaggctgcaccgtgcagtatgctgtgttccactggctgggctgcacagaatgtattgtgctggccgccatggccctggacagatatgtggccatctgcaagcccctgcactatgctgtgctgatgcaccgggccctgtgccagcagctggtggccctggcctggctgagcggctttggaaacagctttgtgcaggtggtgctgactgtgcagctgcccttctgtggccggcaggtgctgaacaacttcttctgtgaggtgcctgctgtgatcaagctgagctgtgccgacacagctgtgaatgacaccatcctggccgtgctggtggccttctttgtgctggtgcccctggccctgatcctgctgtcctatggcttcatcgcccgggctgtgctgcgcatccagagcagcaagggccgccacaaggccttcggcacctgcagcagccacctgatgattgtgtccctcttctacctgcctgccatctacatgtacctgcagccccccagcagctacagccaggagcagggcaagttcatcagcctcttctacagcatcatcacccccaccctgaaccccttcacctacaccctgaggaacaaggacatgaagggggccctgcggcggctgctggcccgcatctggaggctgtgtggctag

SEQ ID NO: 36297 - DNA, 1074 bp, Artificial Sequence
  Description of Artificial Sequence: Synthetic coding sequence
atgaactgggtgaacaagtctgtgccccaggagttcatcctgctggtgttcagtgaccagccctggctggagatccccccatttgtgatgttcctgttctcctacatcctgaccatcttcggcaacctgaccatcatcctggtgagccacgtggacttcaagctgcacacccccatgtacttcttcctgagcaacctgagcctgctggacctgtgctacaccaccagcacagtgccccagatgctggtgaacatctgcaacaccaggaaggtgatctcctatggaggctgtgtggcccagctgttcatcttcctggccctgggcagcacagaatgtctgctgctggccgtgatgtgctttgacagatttgtggccatctgccggcccctgcactacagcatcatcatgcaccagaggctgtgcttccagctggccgccgcctcctggatcagcggcttcagcaacagcgtgctgcagagcacctggaccctgaagatgcccctgtgtggccacaaggaggtggaccacttcttctgtgaggtgcctgccctgctgaagctgagctgtgtggacaccacagccaatgaagctgagctgttcttcatctctgtgctcttcctgctgatccctgtgaccctcatcctgatctcctatgccttcatcgtgcaggccgtgctgcgcatccagagcgctgagggccagaggaaggccttcggcacctgtggcagccacctgattgtggtgtccctcttctacggcacagccatctccatgtacctgcagccccccagccccagcagcaaggaccggggcaagatggtgtccctcttctgtggcatcatcgcccccatgctgaaccccctcatctacaccctgaggaacaaggaggtgaaggaggccttcaagaggctggtggccaagagcctgctgaaccaggagatccggaacatgcagatgatcagctttgccaaggacacagtgctgacctacctgaccaacttcagcgccagctgccccatctttgtgatcaccatcgagaactactgcaacctgccccagaggaagttcccctag

SEQ ID NO: 36298 - DNA, 942 bp, Artificial Sequence
  Description of Artificial Sequence: Synthetic coding sequence
atgaactgggagaatgaaagcagccccaaggagttcatcctgctgggcttcagtgaccgggcctggctgcagatgcccctgtttgtggtgctgctgatctcctacaccatcaccatctttggaaatgtgtccatcatgatggtgtgcatcctggaccccaagctgcacacccccatgtacttcttcctgaccaacctgagcatcctggacctgtgctacaccaccaccaccgtgccccacatgctggtgaacatcggctgcaacaagaagaccatctcctatgccggctgtgtggcccacctgatcatcttcctggccctgggcgccacagaatgtctgctgctggccgtgatgagctttgacagatatgtggccgtgtgccggcccctgcactacgtggtgatcatgaactactggttctgcctgaggatggccgccttctcctggctgattggatttggaaacagcgtgctgcagagcagcctgaccctgaacatgccccgctgtggccaccaggaggtggaccacttcttctgtgaggtgcctgccctgctgaagctgagctgtgccgacaccaagcccattgaagctgagctgttcttcttctctgtgctgatcctgctgatccctgtgaccctcatcctgatctcctatggcttcatcgcccaggccgtgctgaagatccgctctgctgagggccggcagaaggccttcggcacctgtggcagccacatgattgtggtgtccctcttctacggcacagccatctacatgtacctgcagccccccagcagcaccagcaaggactggggcaagatggtgtccctcttctacggcatcatcacctccatgctgaacagcctcatctacagcctgaggaacaaggacatgaaggaggccttcaagaggctgatgccccgcatcttcttctgcaagaagtag

SEQ ID NO: 36299 - DNA, 942 bp, Artificial Sequence; identical to SEQ ID NO: 36298
  Description of Artificial Sequence: Synthetic coding sequence

SEQ ID NO: 36300 - DNA, 942 bp, Artificial Sequence; identical to SEQ ID NO: 36298
  Description of Artificial Sequence: Synthetic coding sequence

SEQ ID NO: 36301 - DNA, 942 bp, Artificial Sequence; identical to SEQ ID NO: 36298
  Description of Artificial Sequence: Synthetic coding sequence

SEQ ID NO: 36302 - DNA, 942 bp, Artificial Sequence; identical to SEQ ID NO: 36298
  Description of Artificial Sequence: Synthetic coding sequence

SEQ ID NO: 36303 - DNA, 942 bp, Artificial Sequence; identical to SEQ ID NO: 36298
  Description of Artificial Sequence: Synthetic coding sequence

SEQ ID NO: 36304 - DNA, 942 bp, Artificial Sequence; identical to SEQ ID NO: 36298
  Description of Artificial Sequence: Synthetic coding sequence

SEQ ID NO: 36305 - DNA, 942 bp, Artificial Sequence; identical to SEQ ID NO: 36298
  Description of Artificial Sequence: Synthetic coding sequence

SEQ ID NO: 36306 - DNA, 942 bp, Artificial Sequence
  Description of Artificial Sequence: Synthetic coding sequence
atgaactgggtgaatgacagcatcatccaggagttcatcctgctgggcttcagtgaccggccctggctggagttccccctgctggtggtgttcctgatctcctacacagtgaccatcttcggcaacctgaccatcatcctggtgtcccggctggacaccaagctgcacacccccatgtacttcttcctgaccaacctgagcctgctggacctgtgctacaccacctgcaccgtgccccagatgctggtgaacctgtgcagcatcaggaaggtgatctcctaccggggctgtgtggcccagctgttcatcttcctggccctgggcgccacagagtacctgctgctggccgtgatgagctttgacagatttgtggccatctgccggcccctgcactacagcgtcatcatgcaccagaggctgtgcctgcagctggccgccgcctcctgggtgacaggcttcagcaacagcgtgtggctgagcaccctgaccctgcagctgcccctgtgtgacccctacgtgattgaccacttcctgtgtgaggtgcctgccctgctgaagctgagctgtgtggagaccacagccaatgaagctgagctgttcctggtgtctgagctgttccacctgatccccctgaccctcatcctgatctcctatgccttcatcgtgcgggctgtgctgcgcatccagagcgctgagggccggcagaaggccttcggcacctgtggcagccacctgattgtggtgtccctcttctacagcacagctgtgtctgtgtacctgcagccccccagccccagcagcaaggaccagggcaagatggtgtccctcttctacggcatcatcgcccccatgctgaaccccctcatctacaccctgaggaacaaggaggtgaaggagggcttcaagaggctggtggcccgggtcttcctgatcaagaagtag

SEQ ID NO: 36307 - DNA, 939 bp, Artificial Sequence
  Description of Artificial Sequence: Synthetic coding sequence
atggatggagtgaatgacagcagcctgcagggctttgtgctgatgggcatcagtgaccacccccagctggagatgatcttcttcatcgccatcctcttctcctacctgctgaccctgctgggcaacagcaccatcatcctgctgagccggctggaggcccggctgcacacccccatgtacttcttcctgagcaacctgagcagcctggacctggcctttgccaccagctctgtgccccagatgctgatcaacctgtggggccctgggaagaccatctcctatggaggctgcatcacccagctgtatgtgttcctgtggctgggcgccacagagtgcatcctgctggtggtgatggcctttgacagatatgtggccgtgtgccggcccctgcgctacacagccatcatgaacccccagctgtgctggctgctggccgtgattgcctgcctgggcggcctgggcaacagcgtcatccagagcaccttcaccctgcagctgcccctgtgtggccaccggcgggtggagggcttcctgtgtgaggtgcctgccatgatcaagctggcctgtggggacaccagcctgaaccaggccgtgctgaatggagtgtgcaccttcttcaccgctgtgcccctgagcatcatcgtcatctcctactgcctgattgcccaggccgtgctgaagatccgctctgctgagggccgcaggaaggccttcaacacctgcctgagccacctgctggtggtgttcctgttctacggcagcgccagctatggctacctgctgcctgccaagaacagcaagcaggaccagggcaagttcatcagcctcttctacagcctggtgacccccatggtgaaccccctcatctacaccctgaggaacatggaggtgaagggggccctgcggcggctgctgggcaagggccgggaggtgggctag

SEQ ID NO: 36308 - DNA, 963 bp, Artificial Sequence
  Description of Artificial Sequence: Synthetic coding sequence
atgatggagatcgccaacgtgagcagccctgaggtgtttgtgctgctgggcttcagcacccggcccagcctggagaccgtgctcttcatcgtggtgctgtccttctacatggtgtccatcctgggcaatggcatcatcatcctggtgagccacacagatgtgcacctgcacacccccatgtacttcttcctggccaacctgcccttcctggacatgtccttcaccaccagcatcgtgccccagctgctggccaacctgtggggcccccagaagaccatctcctatggaggctgtgtggtgcagttctacatcagccactggctgggcgccacagaatgtgtgctgctggccaccatgtcctatgacagatatgctgccatctgccggcccctgcactacaccgtcatcatgcacccccagctgtgcctgggcctggccctggcctcctggctgggcggcctgaccacctccatggtgggcagcaccctgaccatgctgctgcccctgtgtggcaacaactgcatcgaccacttcttctgtgagatgcccctcatcatgcagctggcctgtgtggacaccagcctgaatgagatggagatgtacctggccagctttgtgtttgtggtgctgcccctgggcctcatcctggtgtcctatggccacatcgcccgggctgtgctgaagatccgctctgctgagggccgcaggaaggccttcaacacctgcagcagccacgtggccgtggtgtccctcttctacggcagcatcatcttcatgtacctgcagcctgccaagagcaccagccatgagcagggcaagttcatcgccctcttctacacagtggtgaccccagccctgaaccccctcatctacaccctgaggaacacagaggtgaagagcgccctgcggcacatggtgctggagaactgctgcggcagcgctgggaagctggcccagatctag

SEQ ID NO: 36309 - DNA, 927 bp, Artificial Sequence
  Description of Artificial Sequence: Synthetic coding sequence
atgaggcagatcaaccagacccaggtgacagagttcctgctgctgggcctgagtgatggcccccacacagagcagctgctcttcatcgtgctgctgggcgtgtacctggtgacagtgctgggcaacctgctgctgatcagcctggtgcacgtggacagccagctgcacacccccatgtacttcttcctgtgcaacctgagcctggccgacctgtgcttcagcaccaacatcgtgccccaggccctggtgcacctgctgagcaggaagaaggtgattgccttcaccctgtgtgccgcccggctgctcttcttcctgatcttcggctgcacccagtgtgccctgctggccgtgatgtcctatgacagatatgtggccatctgcaaccccctgcgctaccccaacatcatgacctggaaggtgtgtgtgcagctggccaccggctcctggaccagcggcatcctggtgtctgtggtggacaccaccttcatcctgcggctgccctaccggggcagcaacagcatcgcccacttcttctgtgaggccccagccctgctgatcctggccagcacagacacccacgccagcgagatggccatcttcctgatgggcgtggtgatcctgctgatccctgtgttcctgatcctggtgtcctatggccgcatcatcgtgacagtggtgaagatgaagagcacagtgggcagcctgaaggccttcagcacctgtggcagccacctgatggtggtgatcctcttctacggcagcgccatcatcacctacatgacccccaagagcagcaagcagcaggagaagtctgtgtctgtgttctacgccatcgtgacccccatgctgaaccccctcatctacagcctgaggaacaaggatgtgaaggccgccctgaggaaggtggccaccaggaacttcccctag

SEQ ID NO: 36310 - DNA, 993 bp, Artificial Sequence
  Description of Artificial Sequence: Synthetic coding sequence
atgtgcagcttcttcctgtgccagacaggcaagcaggccaagatctccatgggagaggagaaccagacctttgtgtccaagttcatcttcctgggcctgagccaggacctgcagacccagatcctgctcttcatcctcttcctgatcatctacctgctgactgtgctgggcaaccagctgatcatcatcctgatcttcctggacagccggctgcacacccccatgtacttcttcctgaggaacctgagctttgctgacctgtgcttcagcaccagcatcgtgccccaggtgctggtgcacttcctggtgaagaggaagaccatctccttctacggctgcatgacccagatcatcgtgttcctgctggtgggctgcacagaatgtgccctgctggccgtgatgtcctatgacagatatgtggccgtgtgcaagcccctgtactacagcaccatcatgacccagagggtgtgcctgtggctgtccttccgctcctgggccagcggggccctggtgtccctggtggacaccagcttcaccttccacctgccctactggggccagaacatcatcaaccactacttctgtgagcccccagccctgctgaagctggccagcattgacacctacagcacagagatggccatcttctccatgggcgtggtgatcctgctggcccctgtgtccctcatcctgggcagctactggaacatcatcagcaccgtcatccagatgcagagcggggagggccgcctgaaggccttcagcacctgtggcagccacctgattgtggtggtgctcttctacggcagcggcatcttcacctacatgaggcccaacagcaagaccaccaaggagctggacaagatgatctctgtgttctacacagctgtgacccccatgctgaaccccatcatctacagcctgaggaacaaggatgtgaagggggccctgaggaagctggtgggcaggaagtgcttcagccaccggcagtag

SEQ ID NO: 36311 - DNA, 954 bp, Artificial Sequence
  Description of Artificial Sequence: Synthetic coding sequence
atgggcacagacaaccagacctgggtgtctgagttcatcctgctgggcctgagcagtgactgggacaccagggtgtccctgtttgtgctcttcctggtgatgtatgtggtgacagtgctgggcaactgcctgattgtgctgctgatccggctggacagccggctgcacacccccatgtacttcttcctgaccaacctgagcctggtggatgtgtcctatgccacctctgtggtgccccagctgctggcccacttcctggccgagcacaaggccatccccttccagagctgtgccgcccagctgttcttcagcctggccctgggcggcatcgagtttgtgctgctggccgtgatggcctatgacagatatgtggccgtgtgtgatgccctgcgctacagcgccatcatgcatggaggcctgtgtgcccggctggccatcacctcctgggtgtctggcttcatcagcagccctgtgcagacagccatcaccttccagctgcccatgtgcaggaacaagttcatcgaccacatcagctgtgagctgctggccgtggtgcggctggcctgtgtggacaccagcagcaatgaggtgaccatcatggtgagcagcatcgtgctgctgatgacccccttctgcctggtgctgctgagctacatccagatcatcagcaccatcctgaagatccagagccgggagggcaggaagaaggccttccacacctgtgccagccacctgactgtggtggccctgtgctacggcgtggccatcttcacctacatccagccccacagcagccccagcgtgctgcaggagaagctgttctctgtgttctacgccatcctgacccccatgctgaaccccatgatctacagcctgaggaacaaggaggtgaagggggcctggcagaagctgctgtggaagttcagcggcctgaccagcaagctggccacctag

SEQ ID NO: 36312 - DNA, 954 bp, Artificial Sequence
  Description of Artificial Sequence: Synthetic coding sequence
atggagattgacaaccagacctgggtgcgggagttcatcctgctgggcctgagcagtgactggtgcacccagatcagcctcttcagcctcttcctggtgacctacctgatgacagtgctgggcaactgcctgattgtgctgctgatccggctggacagccggctgcacacccccatgtacttcttcctgaccaacctgagcctggtggatgtgtcctatgccacctctgtggtgccccagctgctggcccacttcctggccgagcacaaggccatccccttccagagctgtgccgcccagctgttcttcagcctggccctgggcggcatcgagtttgtgctgctggccgtgatggcctatgacagacatgtggccgtgtctgaccggctgcgctacagcgccatcatgcatggaggcctgtgtgcccggctggccatcacctcctgggtgtctggcagcatcaacagcctggtgcagacagccatcaccttccagctgcccatgtgcaccaacaagttcatcgaccacatcagctgtgagctgctggccgtggtgcggctggcctgtgtggacaccagcagcaatgaagctgccatcatggtgagcagcatcgtgctgctgatgacccccttctgcctggtgctgctgagctacatccgcatcatcagcaccatcctgaagatccagagccgggagggcaggaagaaggccttccacacctgtgccagccacctgactgtggtggccctgtgctacggcaccaccatcttcacctacatccagccccacagcggccccagcgtgctgcaggagaagctgatctctgtgttctacgccatcgtgatgcccctgctgaaccctgtgatctacagcctgaggaacaaggaggtgaagggggcctggcacaagctgctggagaagttcagcggcctgaccagcaagctgggcacctag

SEQ ID NO: 36313 - DNA, 954 bp, Artificial Sequence
  Description of Artificial Sequence: Synthetic coding sequence
atgggcatggtgcgccacaccaatgaaagcaacctggccggcttcatcctgctgggcttcagtgactacccccagctgcagaaggtgctgtttgtgctgatcctgatcctgtacctgctgaccatcctgggcaacaccaccatcatcctggtgtcccggctggagcccaagctgcacatgcccatgtacttcttcctgagccacctgtccttcctgtaccgctgcttcaccagcagcgtcatcccccagctgctggtgaacctgtgggagcccatgaagaccatcgcctatggaggctgcctggtgcacctgtacaacagccacgccctgggcagcacagaatgtgtgctgcctgctgtgatgagctgtgaccgctacgtggccgtgtgccggcccctgcactacacagtgctgatgcacatccacctgtgcatggccctggcctccatggcctggctgagcggcatcgccaccaccctggtgcagagcaccctgaccctgcagctgcccttctgtggccaccggcaggtggaccacttcatctgtgaggtgcctgtgctgatcaagctggcctgtgtgggcaccaccttcaatgaggccgagctgtttgtggccagcatcctcttcctgattgtgcctgtgtccttcatcctggtgagcagcggctacatcgcccatgctgtgctgcgcatcaagagcgccacccggcggcagaaggccttcggcacctgcttcagccacctgactgtggtgaccatcttctacggcaccatcatcttcatgtacctgcagcctgccaagagccgcagccgggaccagggcaagtttgtgtccctcttctacacagtggtgaccaggatgctgaaccccctcatctacaccctgcgcatcaaggaggtgaagggggccctgaagaaggtgctggccaaggccctgggcgtgaacatcctgtag

SEQ ID NO: 36314 - DNA, 930 bp, Artificial Sequence
  Description of Artificial Sequence: Synthetic coding sequence
atgggcctgggcaatgaaagcagcctgatggacttcatcctgctgggcttcagtgaccacccccggctggaggccgtgctgtttgtgtttgtgctcttcttctacctgctgaccctggtgggcaacttcaccatcatcatcatctcctacctggacccccccctgcacacccccatgtacttcttcctgagcaacctgagcctgctggacatctgcttcaccaccagcctggccccccagaccctggtgaacctgcagaggcccaagaagaccatcacctacggcggctgtgtggcccagctgtacatcagcctggccctgggcagcacagagtgcatcctgctggccgacatggccctggaccgctacatcgctgtgtgcaagcccctgcactacgtggtgatcatgaacccccggctgtgccagcagctggccagcatctcctggctgagcggcctggccagcagcctcatccacgccaccttcaccctgcagctgcccctgtgtggcaaccaccggctggaccacttcatctgtgaggtgcctgccctgctgaagctggcctgtgtggacaccaccgtgaatgagctggtgctgtttgtggtgtctgtgctgtttgtggtgatccccccagccctgatcagcatctcctatggcttcatcacccaggccgtgctgcgcatcaagtctgtggaggcccggcacaaggccttcagcacctgcagcagccacctgactgtggtgatcatcttctacggcaccatcatctacgtgtacctgcagcccagcgacagctatgcccaggaccagggcaagttcatcagcctcttctacaccatggtgacccccaccctgaaccccatcatctacaccctgaggaacaaggacatgaaggaggccctgaggaagctgctgagcggcaagctgtag

SEQ ID NO: 36315 - DNA, 951 bp, Artificial Sequence
  Description of Artificial Sequence: Synthetic coding sequence
atggaggagaccaacaacagcagcgagaagggcttcctgctgctgggcttcagtgaccagccccagctggagcgcttcctgtttgccatcatcctgtacttctacgtgctgagcctgctgggcaacacagccctgatcctggtgtgctgcctggacagccggctgcacacccccatgtacttcttcctgagcaacctgagctgtgtggacatctgcttcaccacctctgtggccccccagctgctggtgaccatgaacaagaaggacaagaccatgtcctatggaggctgtgtggcccagctgtatgtggccatgggcctgggcagcagcgagtgcatcctgctggccgtgatggcctatgacagatatgctgctgtgtgccggcccctgcgctacatcgccatcatgcacccccgcttctgtgccagcctggccggcggggcctggctgagcggcctcatcaccagcctcatccagtgcagcctgactgtgcagctgcccctgtgtggccacaggaccctggaccacatcttctgtgaggtgcctgtgctgatcaagctggcctgtgtggacaccaccttcaatgaagctgagctgtttgtggcctctgtggtgttcctgattgtgcctgtgctgctgatcctggtgtcctatggcttcatcacccaggccgtgctgcgcatcaagtctgctgctggccggcagaaggccttcggcacctgcagcagccacctggtggtggtgatcatcttctacggcaccatcatcttcatgtacctgcagcctgccaacagaagaagcaagaaccagggcaagtttgtgtccctcttctacaccatcgtgacccccctgctgaaccccatcatctacaccctgaggaacaaggatgtgaagggggccctgcggaccctcatcctgggcagcgctgctggccagagccacaaggactag

SEQ ID NO: 36316 - DNA, 951 bp, Artificial Sequence
  Description of Artificial Sequence: Synthetic coding sequence
atggtgaaccagagcagccccatgggcttcctgctgctgggcttcagcgagcacccagccctggagaggaccctgtttgtggtggtgttcaccagctacctgctgaccctggtgggcaacaccctcatcatcctgctgtctgtgctgtacccccggctgcacagccccatgtacttcttcctgagtgacctgtccttcctggacctgtgcttcaccaccagctgtgtgccccagatgctggtgaacctgtggggccccaagaagaccatctccttcctgggctgcagcgtgcagctgttcatcttcctgagcctgggcaccacagagtgcatcctgctgactgtgatggcctttgacagatatgtggccgtgtgccagcccctgcactacgccaccatcatccacccccggctgtgctggcagctggcctctgtggcctgggtgatgagcctggtgcagagcatcgtgcagacccccagcaccctgcacctgcccttctgcccccaccagcagattgatgacttcctgtgtgaggtgcccagcctcatccggctgagctgtggggacaccagctacaatgagatccagctggccgtgtcctctgtcatctttgtggtggtgcccctgagcctcatcctggccagctatggagccacagcccaggccgtgctgcgcatcaacagcgccacagcctggaggaaggccttcggcacctgcagcagccacctgactgtggtgaccctcttctacagctctgtgattgctgtgtacctgcagcccaagaacccctatgcccagggccggggcaagttcttcggcctcttctatgctgtgggcacccccagcctgaaccccctggtgtacaccctgaggaacaaggagatcaagagggccctgcggcggctgctgggcaaggagcgggacagccgggagagctggagggctgcctag

SEQ ID NO: 36317 - DNA, 951 bp, Artificial Sequence; identical to SEQ ID NO: 36316
  Description of Artificial Sequence: Synthetic coding sequence

SEQ ID NO: 36318 - DNA, 951 bp, Artificial Sequence; identical to SEQ ID NO: 36316
  Description of Artificial Sequence: Synthetic coding sequence

SEQ ID NO: 36319 - DNA, 951 bp, Artificial Sequence; identical to SEQ ID NO: 36316
  Description of Artificial Sequence: Synthetic coding sequence

SEQ ID NO: 36320 - DNA, 951 bp, Artificial Sequence; identical to SEQ ID NO: 36316
  Description of Artificial Sequence: Synthetic coding sequence

SEQ ID NO: 36321 - DNA, 951 bp, Artificial Sequence; identical to SEQ ID NO: 36316
  Description of Artificial Sequence: Synthetic coding sequence

SEQ ID NO: 36322 - DNA, 951 bp, Artificial Sequence; identical to SEQ ID NO: 36316
  Description of Artificial Sequence: Synthetic coding sequence

SEQ ID NO: 36323 - DNA, 951 bp, Artificial Sequence; identical to SEQ ID NO: 36316
  Description of Artificial Sequence: Synthetic coding sequence

SEQ ID NO: 36324 - DNA, 951 bp, Artificial Sequence; identical to SEQ ID NO: 36316
  Description of Artificial Sequence: Synthetic coding sequence

SEQ ID NO: 36325 - DNA, 951 bp, Artificial Sequence; identical to SEQ ID NO: 36316
  Description of Artificial Sequence: Synthetic coding sequence

SEQ ID NO: 36326 - DNA, 951 bp, Artificial Sequence; identical to SEQ ID NO: 36316
  Description of Artificial Sequence: Synthetic coding sequence

SEQ ID NO: 36327 - DNA, 951 bp, Artificial Sequence; identical to SEQ ID NO: 36316
  Description of Artificial Sequence: Synthetic coding sequence

SEQ ID NO: 36328 - DNA, 951 bp, Artificial Sequence; identical to SEQ ID NO: 36316
  Description of Artificial Sequence: Synthetic coding sequence

SEQ ID NO: 36329 - DNA, 951 bp, Artificial Sequence; identical to SEQ ID NO: 36316
  Description of Artificial Sequence: Synthetic coding sequence

SEQ ID NO: 36330 - DNA, 951 bp, Artificial Sequence; identical to SEQ ID NO: 36316
  Description of Artificial Sequence: Synthetic coding sequence

SEQ ID NO: 36331 - DNA, 951 bp, Artificial Sequence; identical to SEQ ID NO: 36316
  Description of Artificial Sequence: Synthetic coding sequence

SEQ ID NO: 36332 - DNA, 951 bp, Artificial Sequence; identical to SEQ ID NO: 36316
  Description of Artificial Sequence: Synthetic coding sequence

SEQ ID NO: 36333 - DNA, 951 bp, Artificial Sequence; identical to SEQ ID NO: 36316
  Description of Artificial Sequence: Synthetic coding sequence

SEQ ID NO: 36334 - DNA, 951 bp, Artificial Sequence; identical to SEQ ID NO: 36316
  Description of Artificial Sequence: Synthetic coding sequence

SEQ ID NO: 36335 - DNA, 951 bp, Artificial Sequence; identical to SEQ ID NO: 36316
  Description of Artificial Sequence: Synthetic coding sequence

SEQ ID NO: 36336 - DNA, 951 bp, Artificial Sequence; identical to SEQ ID NO: 36316
  Description of Artificial Sequence: Synthetic coding sequence

SEQ ID NO: 36337 - DNA, 951 bp, Artificial Sequence; identical to SEQ ID NO: 36316
  Description of Artificial Sequence: Synthetic coding sequence

SEQ ID NO: 36338 - DNA, 951 bp, Artificial Sequence; identical to SEQ ID NO: 36316
  Description of Artificial Sequence: Synthetic coding sequence

SEQ ID NO: 36339 - DNA, 951 bp, Artificial Sequence; identical to SEQ ID NO: 36316
  Description of Artificial Sequence: Synthetic coding sequence

SEQ ID NO: 36340 - DNA, 951 bp, Artificial Sequence; identical to SEQ ID NO: 36316
  Description of Artificial Sequence: Synthetic coding sequence

SEQ ID NO: 36341 - DNA, 951 bp, Artificial Sequence; identical to SEQ ID NO: 36316
  Description of Artificial Sequence: Synthetic coding sequence

SEQ ID NO: 36342 - DNA, 951 bp, Artificial Sequence; identical to SEQ ID NO: 36316
  Description of Artificial Sequence: Synthetic coding sequence

SEQ ID NO: 36343 - DNA, 951 bp, Artificial Sequence; identical to SEQ ID NO: 36316
  Description of Artificial Sequence: Synthetic coding sequence

SEQ ID NO: 36344 - DNA, 951 bp, Artificial Sequence; identical to SEQ ID NO: 36316
  Description of Artificial Sequence: Synthetic coding sequence

SEQ ID NO: 36345 - DNA, 951 bp, Artificial Sequence; identical to SEQ ID NO: 36316
  Description of Artificial Sequence: Synthetic coding sequence

SEQ ID NO: 36346 - DNA, 951 bp, Artificial Sequence; identical to SEQ ID NO: 36316
  Description of Artificial Sequence: Synthetic coding sequence

SEQ ID NO: 36347 - DNA, 951 bp, Artificial Sequence; identical to SEQ ID NO: 36316
  Description of Artificial Sequence: Synthetic coding sequence

SEQ ID NO: 36348 - DNA, 951 bp, Artificial Sequence; identical to SEQ ID NO: 36316
  Description of Artificial Sequence: Synthetic coding sequence

SEQ ID NO: 36349 - DNA, 951 bp, Artificial Sequence; identical to SEQ ID NO: 36316
  Description of Artificial Sequence: Synthetic coding sequence

SEQ ID NO: 36350 - DNA, 951 bp, Artificial Sequence; identical to SEQ ID NO: 36316
  Description of Artificial Sequence: Synthetic coding sequence

SEQ ID NO: 36351 - DNA, 951 bp, Artificial Sequence; identical to SEQ ID NO: 36316
  Description of Artificial Sequence: Synthetic coding sequence

SEQ ID NO: 36352 - DNA, 951 bp, Artificial Sequence; identical to SEQ ID NO: 36316
  Description of Artificial Sequence: Synthetic coding sequence

SEQ ID NO: 36353 - DNA, 951 bp, Artificial Sequence; identical to SEQ ID NO: 36316
  Description of Artificial Sequence: Synthetic coding sequence

SEQ ID NO: 36354 - DNA, 951 bp, Artificial Sequence; identical to SEQ ID NO: 36316
  Description of Artificial Sequence: Synthetic coding sequence

SEQ ID NO: 36355 - DNA, 951 bp, Artificial Sequence; identical to SEQ ID NO: 36316
  Description of Artificial Sequence: Synthetic coding sequence

SEQ ID NO: 36356 - DNA, 939 bp, Artificial Sequence
  Description of Artificial Sequence: Synthetic coding sequence
atggtgaaccagagcagcaccccaggcttcctgctgctgggcttcagcgagcaccctggcctggagaggaccctgtttgtggtggtgctgaccagctacctgctgaccctggtgggcaacaccctcatcatcctgctgagcgccctggaccccaagctgcacagccccatgtacttcttcctgagcaacctgtccttcctggacctgtgcttcaccaccagctgtgtgccccagatgctggtgaacctgtggggccccaagaagaccatctccttcctggactgcagcgtgcagatcttcatcttcctgagcctgggcaccacagagtgcatcctgctgactgtgatggcctttgacagatatgtggccgtgtgccagcccctgcactacgccaccatcatccacccccggctgtgctggcagctggcctctgtggcctgggtgattggcctggtggagagcgtggtgcagacccccagcaccctgcacctgcccttctgcccagaccggcaggtggatgactttgtgtgtgaggtgcctgccctgatccggctgagctgtgaggacaccagctacaatgagatccaggtggccgtggcctctgtgttcatcctggtggtgcccctgagcctcatcctggtgtcctatggagccatcacctgggccgtgctgcgcatcaacagcgccaagggccgcaggaaggccttcggcacctgcagcagccacctgactgtggtgaccctcttctacagctctgtgattgctgtgtacctgcagcccaagaacccctatgcccaggagcggggcaagttcttcggcctcttctatgctgtgggcacccccagcctgaaccccctcatctacaccctgaggaacaaggaggtgacccgggccttccggcggctgctgggcaaggagatgggcctgacccagagctag

SEQ ID NO: 36357 - DNA, 939 bp, Artificial Sequence; identical to SEQ ID NO: 36356
  Description of Artificial Sequence: Synthetic coding sequence

SEQ ID NO: 36358 - DNA, 939 bp, Artificial Sequence; identical to SEQ ID NO: 36356
  Description of Artificial Sequence: Synthetic coding sequence

SEQ ID NO: 36359 - DNA, 939 bp, Artificial Sequence
  Description of Artificial Sequence: Synthetic coding sequence
atgctgatgaagaagaatgccagctttgaggacttcttcctgctgctgggcttcagcaactggccccacctggaggtggtgctgtttgtggtgatcctgatcttctacctgatcaccctgattggcaacctcttcatcatcatcctgagctacctggacagccacctgcacacccccatgtacttcttcctgagcaacctgtccttcctggacctgtgctacaccaccagcagcatcccccagctgctggtgaacctgtggggccctgagaagaccatctcctatgccggctgcaccgtgcagctgtactttgtgctggccctgggcacagcagaatgtgtgctgctggtggtgatgtcctatgacagatatgctgctgtgtgccggcccctgcactacacagtgctgatgcacccccgcttctgccgcctgctggccgccgcctcctgggtgtctggcttcaccaccagcgccctgcacagcagcttcaccttctggatccccctgtgccgccaccggctggtggaccacttcttctgtgaggtgcctgccctgctgcggctgagctgtgtggacacccaggccaatgagctgaccctgatggtgatgagcagcatctttgtgctgatccccctcatcctgatcctgaccagctatggagccatcgcccgggctgtgctgtccatgcagagcaccaccggcctgcagaaggtgctgcggacctgtggggcccacctgatggtggtgtccctcttcttcatccctgtgatgtgcatgtacctgcagcccccatctgagaacagccaggaccagggcaagttcatcgccctcttctacacagtggtgacccccagcctgaaccccctcatctacaccttcaggaacaaggatgtgagaggagctgtgaagaggctgatgggctgggagtggggcatgtag

SEQ ID NO: 36360 - DNA, 939 bp, Artificial Sequence
  Description of Artificial Sequence: Synthetic coding sequence
atgatgatcaagaagaatgccagcagcgaggacttcttcatcctgctgggcttcagcaactggccccagctggaggtggtgctgtttgtggtgatcctgatcttctacctgatgaccctgactggaaacctcttcatcatcatcctgtcctatgtggacagccacctgcacacccccatgtacttcttcctgagcaacctgtccttcctggacctgtgccacaccaccagcagcatcccccagctgctggtgaacctgcggggccctgagaagaccatctcctatgccggctgcatggtgcagctgtactttgtgctggccctgggcattgctgaatgtgtgctgctggtggtgatgtcctatgaccgctacgtggccgtgtgccggcccctgcactacacagtgctgatgcacccccgcttctgccacctgctggccgccgcctcctgggtgattggcttcaccatcagcgccctgcacagcagcttcaccttctgggtgcccctgtgtggccaccggctggtggaccacttcttctgtgaggtgcctgccctgctgcggctgagctgtgtggacacccacgccaatgagctgaccctgatggtgatgagcagcatctttgtgctgatccccctcatcctgatcctgacagcctatggagccatcgcccgggctgtgctgtccatgcagagcaccaccggcctgcagaaggtgttccgcacctgtggggcccacctgatggtggtgtccctcttcttcatccctgtgatgtgcatgtacctgcagcccccatctgagaacagcccagaccagggcaagttcatcgccctcttctacacagtggtgacccccagcctgaaccccctcatctacaccctgaggaacaagcacgtgaagggagctgccaagaggctgctgggctgggagtggggcaagtag

SEQ ID NO: 36361 - DNA, 939 bp, Artificial Sequence; identical to SEQ ID NO: 36360
  Description of Artificial Sequence: Synthetic coding sequence

SEQ ID NO: 36362 - DNA, 939 bp, Artificial Sequence; identical to SEQ ID NO: 36360
  Description of Artificial Sequence: Synthetic coding sequence

SEQ ID NO: 36363 - DNA, 939 bp, Artificial Sequence; identical to SEQ ID NO: 36360
  Description of Artificial Sequence: Synthetic coding sequence

SEQ ID NO: 36364 - DNA, 939 bp, Artificial Sequence; identical to SEQ ID NO: 36360
  Description of Artificial Sequence: Synthetic coding sequence

SEQ ID NO: 36365 - DNA, 936 bp, Artificial Sequence
  Description of Artificial Sequence: Synthetic coding sequence
atgaatgatgatggcaaggtgaatgccagcagcgagggctacttcatcctggtgggcttcagcaactggccccacctggaggtggtgatctttgtggtggtgctgatcttctacctgatgaccctgattggcaacctcttcatcatcatcctgagctacctggacagccacctgcacacccccatgtacttcttcctgagcaacctgtccttcctggacctgtgctacaccaccagcagcatcccccagctgctggtgaacctgtggggccctgagaagaccatctcctatgccggctgcatgatccagctgtactttgtgctggccctgggcaccacagaatgtgtgctgctggtggtgatgtcctatgacagatatgctgctgtgtgccggcccctgcactacacagtgctgatgcacccccgcttctgccacctgctggccgtggcctcctgggtgtctggcttcaccaacagcgccctgcacagcagcttcaccttctgggtgcccctgtgtggccaccggcaggtggaccacttcttctgtgaggtgcctgccctgctgcggctgagctgtgtggacacccacgtgaatgagctgaccctgatgatcaccagcagcatctttgtgctgatccccctcatcctgatcctgaccagctatggagccatcgtgcgggctgtgctgaggatgcagagcaccaccggcctgcagaaggtgtttggcacctgtggggcccacctgatggctgtgtccctcttcttcatcccagccatgtgcatctacctgcagcccccatctggcaacagccaggaccagggcaagttcatcgccctcttctacacagtggtgacccccagcctgaaccccctcatctacaccctgaggaacaaggtggtgagaggagctgtgaagaggctgatgggctgggagtag

SEQ ID NO: 36366 - DNA, 936 bp, Artificial Sequence; identical to SEQ ID NO: 36365
  Description of Artificial Sequence: Synthetic coding sequence

SEQ ID NO: 36367 - DNA, 936 bp, Artificial Sequence; identical to SEQ ID NO: 36365
  Description of Artificial Sequence: Synthetic coding sequence

SEQ ID NO: 36368 - DNA, 936 bp, Artificial Sequence; identical to SEQ ID NO: 36365
  Description of Artificial Sequence: Synthetic coding sequence

SEQ ID NO: 36369 - DNA, 777 bp, Artificial Sequence
  Description of Artificial Sequence: Synthetic coding sequence
atgaatgatgatggcaaggtgaatgccagcagcgagggctacttcatcctggtgggcttcagcaactggccccacctggaggtggtgatctttgtggtggtgctgatcttctacctgatgaccctgattggcaacctcttcatcatcatcctgagctacctggacagccacctgcacacccccatgtacttcttcctgagcaacctgtccttcctggacctgtgctacaccaccagcagcatcccccagctgctggtgaacctgtggggccctgagaagaccatctcctatgccggctgcatgatccagctgtactttgtgctggccctgggcaccacagaatgtgtgctgctggtggtgatgtcctatgacagatatgctgctgtgtgccggcccctgcactacacagtgctgatgcacccccgcttctgccacctgctggccgtggcctcctgggtgtctggcttcaccaacagcgccctgcacagcagcttcaccttctgggtgcccctgtgtggccaccggcaggtggaccacttcttctgtgaggtgcctgccctgctgcggctgagctgtgtggacacccacgtgaatgagctgaccctgatgatcaccagcagcatctttgtgctgatccccctcatcctgatcctgaccagctatggagccatcgtgcaggccgtgctgaggatgcagagcaccaccggcctgcagaaggtgtttggcacctgtggggcccacctgatggctgtgtccctcttcttcatcccagcctag

SEQ ID NO: 36370 - DNA, 936 bp, Artificial Sequence; identical to SEQ ID NO: 36365
  Description of Artificial Sequence: Synthetic coding sequence

SEQ ID NO: 36371 - DNA, 936 bp, Artificial Sequence; identical to SEQ ID NO: 36365
  Description of Artificial Sequence: Synthetic coding sequence

SEQ ID NO: 36372 - DNA, 951 bp, Artificial Sequence
  Description of Artificial Sequence: Synthetic coding sequence
atgcagggcgagaacttcaccatctggagcatcttcttcctggagggcttcagccagtacccaggcctggaggtggtgctgtttgtgttcagcctggtgatgtacctgaccaccctgctgggcaacagcaccctcatcctgatcaccatcctggacagccggctgaagacccccatgtacctgttcctgggcaacctgtccttcatggacatctgctacaccagcgcctctgtgcccaccctgctggtgaacctgctgagcagccagaagaccatcatcttcagcggctgtgctgtgcagatgtacctgagcctggccatgggcagcacagaatgtgtgctgctggccgtgatggcctatgacagatatgtggccatctgcaaccccctgcgctacagcatcatcatgaacagatgtgtgtgtgccaggatggccaccgtgtcctgggtgacaggctgcctgacagccctgctggagaccagctttgccctgcagatccccctgtgtggcaacctgattgaccacttcacctgtgagatcctggccgtgctgaagctggcctgcaccagcagcctgctgatgaacaccatcatgctggtggtgtccatcctgctgctgcccatccccatgctgctggtgtgcatctcctacatcttcatcctgagcaccatcctgcgcatcaccagcgctgagggcaggaacaaggccttcagcacctgtggggcccacctgactgtggtgatcctgtactatggagctgccctgtccatgtacctgaagcccagcagcagcaatgcccagaagattgacaagatcatcagcctgctgtatggagtgctgacccccatgctgaaccccatcatctacagcctgaggaacaaggaggtgaaggatgccatgaagaagctgctgggcaagatcaccctgcaccagacccatgagcacctgtag

SEQ ID NO: 36373 - DNA, 1038 bp, Artificial Sequence
  Description of Artificial Sequence: Synthetic coding sequence
atgaacatcaccctgtacagcttcctgtatgtgctgcggctgaatgaaggcaacagcacaggcaggaacattgatgagaggaagaagatgcagggcgagaacttcaccatctggagcatcttcttcctggagggcttcagccagtacccaggcctggaggtggtgctgtttgtgttcagcctggtgatgtacctgaccaccctgctgggcaacagcaccctcatcctgatcaccatcctggacagccggctgaagacccccatgtacctgttcctgggcaacctgtccttcatggacatctgctacaccagcgcctctgtgcccaccctgctggtgaacctgctgagcagccagaagaccatcatcttcagcggctgtgctgtgcagatgtacctgagcctggccatgggcagcacagaatgtgtgctgctggccgtgatggcctatgaccgctacgtggccatctgcaaccccctgcgctacagcatcatcatgaacagatgtgtgtgtgccaggatggccaccgtgtcctgggtgacaggctgcctgacagccctgctggagaccagctttgccctgcagatccccctgtgtggcaacctgattgaccacttcacctgtgagatcctggccgtgctgaagctggcctgcaccagcagcctgctgatgaacaccatcatgctggtggtgtccatcctgctgctgcccatccccatgctgctggtgtgcatctcctacatcttcatcctgagcaccatcctgcgcatcaccagcgctgagggcaggaacaaggccttcagcacctgtggggcccacctgactgtggtgatcctgtactacggggccgccctgtccatgtacctgaagcccagcagcagcaatgcccagaagattgacaagatcatcagcctgctgtatggagtgctgacccccatgctgaaccccatcatctacagcctgaggaacaaggaggtgaaggatgccatgaagaagctgctgggcaagatcaccctgcaccagacccatgagcacctgtag

SEQ ID NO: 36374 - DNA, 939 bp, Artificial Sequence
  Description of Artificial Sequence: Synthetic coding sequence
atggagaagtggaaccacaccagcaatgacttcatcctgctgggcctgctgccccccaaccagacaggcatcttcctgctgtgcctgatcatcctgatcttcttcctggcctctgtgggcaacagcgccatgatccacctgattcatgtggacccccggctgcacacccccatgtacttcctgctgagccagctgagcctgatggacctgatgtacatcagcaccaccgtgcccaagatggcctacaacttcctgagcggccagaagggcatctccttcctgggctgcggcgtgcagagcttcttcttcctgaccatggcctgcagcgagggcctgctgctgacctccatggcctatgaccgctacctggccatctgccacagcctgtactaccccatccgcatgagcaagatgatgtgtgtgaagatgattggaggctcctggaccctgggcagcatcaacagcctggcccacacagtgtttgccctgcacatcccctactgccgcagccgggccatcgaccacttcttctgtgatgtgcctgccatgctgctgctggcctgcacagacacctgggtgtatgagtacatggtgtttgtgtccaccagcctcttcctgctcttccccttcatcggcatcaccagcagctgtggccgggtgctgtttgctgtgtaccacatgcacagcaaggagggcaggaagaaggccttcaccaccatcagcacccacctgactgtggtgatcttctactatgccccctttgtgtacacctacctgcggcccaggaacctgcggagccctgctgaggacaagatcctggccgtgttctacaccatcctgacccccatgctgaaccccatcatctacagcctgaggaacaaggaggtgctgggcgccatgagaagagtgtttggcatcttctccttcctgaaggagtag

SEQ ID NO: 36375 - DNA, 939 bp, Artificial Sequence; identical to SEQ ID NO: 36374
  Description of Artificial Sequence: Synthetic coding sequence

SEQ ID NO: 36376 - DNA, 939 bp, Artificial Sequence
  Description of Artificial Sequence: Synthetic coding sequence
atggagaactacaaccagaccagcacagacttcatcctgctgggcctcttcccccagagccgcatcggcctgtttgtgttcaccctcatcttcctgatcttcctgatggccctgattggcaacctgtccatgatcctgctgatcttcctggacatccacctgcacacccccatgtacttcctgctgagccagctgagcctgattgacctgaactacatcagcaccatcgtgcccaagatggtgtatgacttcctgtatggcaacaagagcatctccttcaccggctgcggcatccagagcttcttcttcctgaccctggccgtggccgagggcctgctgctgacctccatggcctatgaccgctacgtggccatctgcttccccctgcactaccccatccgcatcagcaagagggtgtgtgtgatgatgatcaccggctcctggatgatcagcagcatcaacagctgtgcccacacagtgtatgccctgtgcatcccctactgcaagagccgggccatcaaccacttcttctgtgatgtgcctgccatgctgaccctggcctgcacagacacctgggtgtatgagagcacagtgttcctgagcagcaccatcttcctggtgctgcccttcaccggcatcgcctgcagctatggccgggtgctgctggccgtgtacaggatgcacagcgctgagggcaggaagaaggcctacagcacctgcagcacccacctgactgtggtgtccttctactatgccccctttgcctacacctacgtgcggcccaggagcctgcggagccccacagaggacaagatcctggccgtgttctacaccatcctgacccccatgctgaaccccatcatctacagcctgaggaacaaggaggtgatgggcgccctgacccaggtgatccagaagatcttctctgtgaagatgtag

SEQ ID NO: 36377 - DNA, 939 bp, Artificial Sequence
  Description of Artificial Sequence: Synthetic coding sequence
atggagaactacaaccagaccagcacagacttcatcctgctgggcttcttcccccccagccgcatcggcctcttcctgttcatcctgattgtgttcatcttcctgatggccctgattggcaacctgtccatgatcctgctgatcttcctggacacccacctgcacacccccatgtacttcctgctgagccagctgagcctgattgacctgaactacatcagcaccatcgtgcccaagatggccagtgacttcctgagcggcaacaagagcatctccttcaccggctgcggcatccagagcttcttcttcagcgccctgggcggcgctgaggccctgctgctggcctccatggcctatgaccgctacatcgccatctgcttccccctgcactaccccatccgcatgagcaagaggatgtgtgtgctgatgatcaccggctcctggatcatcggcagcatcaatgcctgtgcccacacagtgtatgtgctgcacatcccctactgccagagccgggccatcaaccacttcttctgtgatgtgcctgccatggtgaccctggcctgcatggacacctgggtgtatgagggcaccgtcttcctgagcaccaccatcttcctggtgttccccttcatcgccatcagctgcagctatggccgggtgctgctggccgtgtaccacatgaagtctgctgagggcaggaagaaggcctacctgacctgcagcacccacctgactgtggtgaccttctactatgccccctttgtgtacacctacctgcggcccaggagcctgcggagccccacagaggacaaggtgctggccgtgttctacaccaccctgacccccatgctgaaccccatcatctacagcctgaggaacaaggaggtgatgggcgccctgaccagggtgtcccagaggatctgcagcggcaagatgtag

SEQ ID NO: 36378 - DNA, 939 bp, Artificial Sequence
  Description of Artificial Sequence: Synthetic coding sequence
atggagaactacaaccagaccagcacagacttcatcctgctgggcctcttcccccccagcaagattggcctcttcctgttcatcctgtttgtgctgatcttcctgatggccctgattggcaacctgtccatgatcctgctgatcttcctggacacccacctgcacacccccatgtacttcctgctgagccagctgagcctgattgacctgaactacatcagcaccatcgtgcccaagatggccagtgacttcctgtatggcaacaagagcatctccttcatcggctgcggcatccagagcttcttcttcatgacctttgctggagctgaggccctgctgctgacctccatggcctatgaccgctacgtggccatctgcttccccctgcactaccccatccgcatgagcaagaggatgtatgtgctgatgatcaccggctcctggatgattggcagcatcaacagctgtgcccacacagtgtatgccttccgcatcccctactgcaagagccgggccatcaaccacttcttctgtgatgtgcctgccatgctgaccctggcctgcacagacacctgggtgtatgagtacacagtgttcctgagcagcaccatcttcctggtgttccccttcaccggcatcgcctgcagctatggctgggtgctgctggccgtgtacaggatgcacagcgctgagggcaggaagaaggcctacagcacctgcagcacccacctgactgtggtgaccttctactatgccccctttgcctacacctacctgtgccccaggagcctgcggagcctgacagaggacaaggtgctggccgtgttctacaccatcctgacccccatgctgaaccccatcatctacagcctgaggaacaaggaggtgatgggcgccctgaccagggtcatccagaacatcttctctgtgaagatgtag

SEQ ID NO: 36379 - DNA, 939 bp, Artificial Sequence
  Description of Artificial Sequence: Synthetic coding sequence
atggagaactacaaccagaccagcacagacttcatcctgctgggcctcttcccccccagcagaattgacctcttcttcttcatcctgattgtgttcatcttcctgatggccctgattggcaacctgtccatgatcctgctgatcttcctggacacccacctgcacacccccatgtacttcctgctgagccagctgagcctgattgacctgaactacatcagcaccatcgtgcccaagatggccagtgacttcctgcacggcaacaagagcatctccttcaccggctgcggcatccagagcttcttcttcctggccctgggcggcgctgaggccctgctgctggcctccatggcctatgaccgctacatcgccatctgcttccccctgcactacctgatccgcatgagcaagagggtgtgtgtgctgatgatcaccggctcctggatcatcggcagcatcaatgcctgtgcccacacagtgtatgtgctgcacatcccctactgccgcagccgggccatcaaccacttcttctgtgatgtgcctgccatggtgaccctggcctgcatggacacctgggtgtatgagggcaccgtcttcctgagcgccaccatcttcctggtgttccccttcatcggcatcagctgcagctatggccaggtgctgtttgctgtgtaccacatgaagtctgctgagggcaggaagaaggcctacctgacctgcagcacccacctgactgtggtgaccttctactatgccccctttgtgtacacctacctgcggcccaggagcctgcggagccccacagaggacaaggtgctggccgtgttctacaccatcctgacccccatgctgaaccccatcatctacagcctgaggaacaaggaggtgatgggcgccctgaccagggtgtcccagaggatctgcagcgtgaagatgtag

SEQ ID NO: 36380 - DNA, 1044 bp, Artificial Sequence
  Description of Artificial Sequence: Synthetic coding sequence
atggcctgggagaaccagaccttcaacagcgacttcatcctgctgggcatcttcaaccacagccccccccacaccttcctgttcttcctggtgctgggcatcttcctggtggccttcatgggcaacagcgtgatggtgctgctgatctacctggacacccagctgcacacccccatgtacttcctgctgagccagctgagcctgatggacctgatgctgatctgcaccaccgtgcccaagatggccttcaactacctgagcggcagcaagagcatctccatggccggctgtgtgacccagatcttcttctacatcagcctgagcggcagcgagtgcttcctgctggccgtgatggcctatgaccgctacatcgccatctgccaccccctgcgctacaccaacctgatgaaccccaagatctgtggcctgatggccaccttctcctggatcctgggcagcacagatggcatcattgatgctgtggccaccttctccttctccttctgtggcagccgggagatcgcccacttcttctgtgagttccccagcctgctgatcctgagctgcaatgacaccagcatctttgaggaggtgatcttcatctgctgcatcgtgatgctggtgtttcctgtggccatcatcatcgccagctatgcccgggtcatcctggccgtcatccacatgggcagcggggagggccgctgcaaggccttcaccacctgcagcagccacctgatggtggtgggcatgtactacggggccgccctcttcatgtacatccggcccaccagtgaccacagccccacccaggacaagatggtgtctgtgttctacaccatcctgacccccatgctgaaccccctcatctacagcctgaggaacaaggaggtgacccgggccttcatgaagatcctgggcaagggcaagtctgagagcgagctgccccacaagctgtatgtgctgctgtttgccaagttcttcttcctgatcagcatcttcttctatgatgtgaagatcctggccctgatcatgtacatcgcctag

SEQ ID NO: 36381 - DNA, 939 bp, Artificial Sequence
  Description of Artificial Sequence: Synthetic coding sequence
atggcccgggagaacagcaccttcaacagcgacttcatcctgctgggcatcttcaaccacagccccacccacaccttcctgttcttcctggtgctggccatcttctctgtggccttcatgggcaacagcgtgatggtgctgctgatctacctggacacccagctgcacacccccatgtacctgctgctgagccagctgagcctgatggacctgatgctgatctgcaccaccgtgcccaagatggccttcaactacctgagcggcagcaagagcatctccatggccggctgtgccacccagatcttcttctacaccagcctgctgggcagcgagtgcttcctgctggccgtgatggcctatgaccgctacacagccatctgccaccccctgcgctacaccaacctgatgagccccaagatctgtggcctgatgacagccttctcctggatcctgggcagcacagatggcatcattgatgtggtggccaccttctccttctcctactgcggcagccgggagatcgcccacttcttctgtgacttccccagcctgctgatcctgagctgcagcgacaccagcatctttgagaagatcctcttcatctgctgcatcgtgatgattgtgtttcctgtggccatcatcatcgccagctatgcccgggtcatcctggccgtcatccacatgggcagcggggagggccgcaggaaggccttcaccacctgcagcagccacctgctggtggtgggcatgtactacggggccgccctcttcatgtacatccggcccaccagtgacaggagccccacccaggacaagatggtgtctgtgttctacaccatcctgacccccatgctgaaccccctcatctacagcctgaggaacaaggaggtgacccgggccttcatgaagatcctgggcaagggcaagagcggggagtag

SEQ ID NO: 36382 - DNA, 936 bp, Artificial Sequence
  Description of Artificial Sequence: Synthetic coding sequence
atggtgtgggagaaccagaccttcaacagcatcttcatcctgctgggcatcttcaaccacagccccacccacaccttcctgttcagcctggtgctgggcatcttcagcctggccctgatggagaacatctccatggtgctgctgatctacatcgagaagcagctgcacacccccatgtacttcctgctgagccagctgagcctgatggacctgatgctgatctgcaccaccctgcccaagatgatcttctcctacctgagcggcaagaagagcatcagcctggccggctgcggcacccagatcttcttctacgtgtccctgctgggcgctgagtgcttcctgctggccgtgatggcctatgacagatatgtggccatctgccaccccctgcagtacaccatcctgatgaaccccaagctgtgtgtgttcatgacagtggcctcctggaccctgggcagcctggatggcatcatcgtgctggccgctgtgctgtccttctcctactgcagcagcctggagatccaccacttcttctgtgatgtggccgccctgctgcccctgagctgcacagagaccagcgcctttgagcggctgctggtgatctgctgcgtggtgatgctgatcttccctgtgtctgtcatcatcctgagctacagccacgtgctgcgggccgtcatccacatgggcagcggggagagcaggaggaaggccttcaccacctgcagcagccacctgtctgtggtgggcctgtactacggggccgccatgttcatgtacatgaggcctgccagcaagcacaccccagaccaggacaagatggtgtctgccttctacaccatcctgacccccatgctgaaccccctcatctacagcctgaggaacaaggaggtgttccgggccctgcagaaggtgctgaagaagaggaagctgatctag

SEQ ID NO: 36383 - DNA, 939 bp, Artificial Sequence
  Description of Artificial Sequence: Synthetic coding sequence
atggcctgggagaaccagaccttcaacagcgacttcatcctgctgggcatcttcaaccacagccccacccacaccttcctgttcttcctggtgctggccatcttctctgtggccttcatgggcaacagcgtgatggtgctgctgatctacctggacacccagctgcacacccccatgtacttcctgctgagccagctgttcctgatggacctgatgctgatctgcagcacagtgcccaagatggccttcaactacctgagcggcagcaagagcatctccatggccggctgtgccacccagatcttcttctacgtgtccctgctgggcagcgagtgcttcctgctggccgtgatgtcctatgaccgctacatcgccatctgccaccccctgcgctacaccaacctgatgaggcccaagatctgtggcctgatgacagccttctcctggatcctgggctccatggatgccatcattgatgctgtggccaccttctccttctcctactgcggcagccgggagatcgcccacttcttctgtgacttccccagcctgctgatcctgagctgcaatgacaccagcatctttgagaaggtgctcttcatctgctgcatcgtgatgattgtgtttcctgtggccatcatcatcgccagctatgcccgggtcatcctggccgtcatccacatgggcagcggggagggccgcaggaaggccttcaccacctgcagcagccacctgatggtggtgggcatgtactacggggccggcctcttcatgtacatccggcccaccagtgacaggagccccatgcaggacaagctggtgtctgtgttctacaccatcctgacccccatgctgaaccccctcatctacagcctgaggaacaaggaggtgacccgggccctgaggaaggtgctgggcaaaggaaaatgtggggagtag

SEQ ID NO: 36384 - DNA, 939 bp, Artificial Sequence
  Description of Artificial Sequence: Synthetic coding sequence
atggcctgggagaaccagaccttcaacagcgacttcctgctgctgggcatcttcaaccacagccccacccacaccttcctgttcttcctggtgctggccatcttctctgtggccttcatgggcaacagcatcatggtgctgctgatctacctggacacccagctgcacacccccatgtacttcctgctgagccagctgagcctgatggacctgatgctgatctgcaccaccgtgcccaagatggccttcaactacctgagcggcagcaagagcatctccatggccggctgtgccacccagatcttcttctacatcagcctgctgggcagcgagtgcttcctgctggccgtgatgtcctatgaccgctacacagccatctgccaccccctgcgctacaccaacctgatgaggcccaagatctgtggcctgatgacagccttctcctggatcctgggcagcacagatggcatcattgatgctgtggccaccttctccttctcctactgcggcagccgggagatcgcccacttctgctgtgacttccccagcctgctgatcctgagctgcaatgacaccagcatctttgaggaggtgatcttcatctgctgcatcgtgatgctggtgtttcctgtggccatcatcatcaccagctatgcccgggtcatcctggccgtcatccacatgggcagcggggagggccgcaggaaggccttcaccacctgcagcagccacctgatggtggtgggcatgtactacggggccggcctcttcatgtgcatccagcccaccagccaccacagccccatgcaggacaagatggtgtctgtgttctacaccatcgtgacccccatgctgaaccccctcatctacagcctgaggaacaaggaggtgacccgggccctgatgaagatcctgggcaagggcaagagcggggactag

SEQ ID NO: 36385 - DNA, 960 bp, Artificial Sequence
  Description of Artificial Sequence: Synthetic coding sequence
atggagaaggccaatgagaccagccctgtgatgggctttgtgctgctgcggctgagcgcccaccctgagctggagaagaccttctttgtgctgatcctgctgatgtacctggtgatcctgctgggcaatggagtgctgatcctggtgaccatcctggacagccggctgcacacccccatgtacttcttcctgggcaacctgtccttcctggacatctgcttcaccaccagctctgtgcccctggtgctggacagcttcctgaccccccaggagaccatctccttcagcgcctgtgctgtgcagatggccctgagctttgccatggccggcacagagtgcctgctgctgtccatgatggcctttgaccgctacgtggccatctgcaaccccctgcgctacagcgtcatcatgagcaaggccgcctacatgcccatggccgccagctcctgggccatcggcggggccgcctctgtggtgcacaccagcctggccatccagctgcccttctgtggggacaacgtcatcaaccacttcacctgtgagatcctggccgtgctgaagctggcctgtgccgacatcagcatcaacgtcatctccatggaggtgaccaacgtcatcttcctgggcgtgcctgtgctcttcatctccttctcctatgtgttcatcatcaccaccatcctgcgcatccccagcgctgagggcaggaagaaggtgttcagcacctgcagcgcccacctgactgtggtgattgtgttctacggcaccctcttcttcatgtatggcaagcccaagagcaaggacagcatgggcgctgacaaggaggacctgagtgacaagctgatccccctcttctatggagtggtgacccccatgctgaaccccatcatctacagcctgaggaacaaggatgtgaaggctgctgtgcggcggctgctgcggcccaagggcttcacccagtag

SEQ ID NO: 36386 - DNA, 1110 bp, Artificial Sequence
  Description of Artificial Sequence: Synthetic coding sequence
atgtggcaggagtactacttcctgaatgtgttcttccccctgctgaaggtgtgctgcctgaccatcaacagccacgtggtgatcctgctgccctgggagtgctaccacctgatctggaagatcctgccctacatcggcaccaccgtgggctccatggaggagtacaacaccagcagcacagacttcaccttcatgggcctcttcaacaggaaggagaccagcggcctcatctttgccatcatcagcatcatcttcttcaccgccctgatggccaacggggtgatgatcttcctgatccagacagacctgcggctgcacacccccatgtacttcctgctgagccacctgagcctgattgacatgatgtacatcagcaccatcgtgcccaagatgctggtgaactacctgctggaccagaggaccatcagctttgtgggctgcacagcccagcacttcctgtacctgaccctggtgggcgctgagttcttcctgctgggcctgatggcctatgacagatatgtggccatctgcaaccccctgcgctaccctgtgctgatgagccggcgggtgtgctggatgatcatcgccggctcctggtttggaggcagcctggatggcttcctgctgacccccatcaccatgtccttccccttctgcaacagccgggagatcaaccacttcttctgtgaggccccagctgtgctgaagctggcctgtgccgacacagccctgtatgaaacagtgatgtatgtgtgctgcgtgctgatgctgctgatccccttctctgtggtgctggccagctatgcccgcatcctgaccaccgtgcagtgcatgagctctgtggagggcaggaagaaggcctttgccacctgcagcagccacatgacagtggtgtccctcttctacggggccgccatgtacacctacatgctgccccacagctaccacaagccagcccaggacaaggtgctgtctgtgttctacaccatcctgacccccatgctgaaccccctcatctacagcctgaggaacaaggatgtgactggagccctgaagagggccctgggccgcttcaagggcccccagagggtgtctggaggagtcttctag

SEQ ID NO: 36387 - DNA, 939 bp, Artificial Sequence
  Description of Artificial Sequence: Synthetic coding sequence
atgaggctggccaaccagaccctgggcggggacttcttcctgctgggcatcttcagccagatcagccaccctggccgcctgtgcctgctgatcttcagcatcttcctgatggctgtgtcctggaacatcaccctcatcctgctgatccacatcgacagcagcctgcacacccccatgtacttcttcatcaaccagctgagcctgattgacctgacctacatctctgtgacagtgcccaagatgctggtgaaccagctggccaaggacaagaccatctctgtgctgggctgcggcacccagatgtacttctacctgcagctgggcggcgctgagtgctgcctgctggccgccatggcctatgacagatatgtggccatctgccaccccctgcgctacagcgtgctgatgagccaccgggtgtgcctgctgctggccagcggctgctggtttgtgggctctgtggatggcttcatgctgacccccatcgccatgtccttccccttctgccgcagccatgagatccagcacttcttctgtgaggtgcctgctgtgctgaagctgagctgcagcgacaccagcctgtacaagatcttcatgtacctgtgctgcgtcatcatgctgctgatccctgtgaccgtcatctctgtgtcctactactacatcatcctgaccatccacaagatgaacagcgtggagggcaggaagaaggccttcaccacctgcagcagccacatcaccgtggtgtccctcttctacggggccgccatctacaactacatgctgcccagcagctaccagaccccagagaaggacatgatgagcagcttcttctacaccatcctgacccctgtgctgaaccccatcatctacagcttcaggaacaaggatgtgacccgggccctgaagaagatgctgtctgtgcagaagccaccctactag

SEQ ID NO: 36388 - DNA, 951 bp, Artificial Sequence
  Description of Artificial Sequence: Synthetic coding sequence
atgaccaacaccagcagcagtgacttcaccctgctgggcctgctggtgaacagcgaggccgccggcatcgtgttcaccgtcatcctggccgtgttcctgggcgctgtgacagccaacctggtgatgatcttcctgatccaggtggacagccggctgcacacccccatgtacttcctgctgagccagctgagcatcatggacaccctcttcatctgcaccaccgtgcccaagctgctggccgacatggtgtccaaggagaagatcatcagctttgtggcctgtggcatccagatcttcctgtacctgaccatgattggcagcgagttcttcctgctgggcctgatggcctatgactgctacgtggccgtgtgcaaccccctgcgctaccctgtgctgatgaacaggaagaagtgcctgctgctggccgccggggcctggtttggaggcagcctggatggcttcctgctgacccccatcaccatgaatgtgccctactgcggcagccgcagcatcaaccacttcttctgtgagatcccagctgtgctgaagctggcctgtgccgacaccagcctgtatgagaccctgatgtacatctgctgcgtgctgatgctgctgatccccatcagcatcatcagcaccagctacagcctcatcctgctgaccatccacaggatgcccagcgctgagggcaggaagaaggccttcaccacctgcagcagccacctgactgtggtgtccatcttctatggagctgccttctacacctacgtgctgccccagagcttccacaccccagagcaggacaaggtggtgtctgccttctacaccatcgtgacccccatgctgaaccccctcatctacagcctgaggaacaaggatgtgattggagccttcaagaaggtgtttgcctgctgcagcagcgcccagaaggtggccaccagtgatgcctag

SEQ ID NO: 36389 - DNA, 963 bp, Artificial Sequence
  Description of Artificial Sequence: Synthetic coding sequence
atggagatgaggaacaccaccccagacttcatcctgctgggcctcttcaaccacacccgggcccaccaggtgctcttcatgatgctgctggccaccgtgctgaccagcctcttcagcaatgccctgatgatcctgctgatccactgggaccaccggctgcaccggcccatgtacttcctgctgagccagctgagcctgatggacatgatgctggtgtccaccaccgtgcccaagatggctgctgactacctgactggaaacaaggccatcagcagagctggctgcggcgtgcagatcttcttcctgcccaccctgggcggcggggagtgcttcctgctggccgccatggcctatgacagatatgctgctgtgtgccaccccctgcgctaccccaccctgatgtcctggcagctgtgcctgaggatgaccatgagctcctggctgctgggcgctgctgatggcctgctgcaggccgtggccaccctgtccttcccctactgtggggcccacgagattgaccacttcttctgtgaggcccctgtgctggtgcggctggcctgtgccgacacctctgtgtttgaaaatgccatgtacatctgctgcgtgctgatgctgctggtgcccttcagcctcatcctgagcagctatggcctcatcctggccgctgtgctgctgatgaggagcacagaggccaggaagaaggcctttgccacctgcagcagccacgtggccgtggtgggcctcttctacggggccggcatcttcacctacatgaggcccaagagccacaggagcaccaaccacgacaaggtggtgtctgccttctacaccatgttcacccccctgctgaaccccctcatctacagcgtgagaaattctgaggtgaaggaggccctgaagcgctggctgggcacctgtgtgaacctgaagcaccagcagaatgaggcccacaggagcaggtag

SEQ ID NO: 36390 - DNA, 975 bp, Artificial Sequence
  Description of Artificial Sequence: Synthetic coding sequence
atgggcatggagggcctgctgcagaacagcaccaactttgtgctgaccggcctcatcacccacccagccttccctggcctgctgtttgccatcgtgttcagcatctttgtggtggccatcacagccaacctggtgatgatcctgctgatccacatggacagccggctgcacacccccatgtacttcctgctgagccagctgagcatcatggacaccatctacatctgcatcaccgtgcccaagatgctgcaggacctgctgagcaaggacaagaccatctccttcctgggctgtgctgtgcagatcttcctgtacctgaccctgattggaggagagttcttcctgctgggcctgatggcctatgaccgctacgtggccgtgtgcaaccccctgcgctaccccctgctgatgaacagaagagtgtgcctcttcatggtggtgggctcctgggtgggcggcagcctggatggcttcatgctgacccctgtgaccatgtccttccccttctgccgcagccgggagatcaaccacttcttctgtgagatcccagctgtgctgaagctgagctgcacagacaccagcctgtatgagaccctgatgtatgcctgctgcgtgctgatgctgctgatccccctgagcgtcatctctgtgtcctacacccacatcctgctgactgtgcacaggatgaacagcgctgagggccgcaggaaggcctttgccacctgcagcagccacatcatggtggtgtctgtgttctatggagctgccttctacaccaacgtgctgccccacagctaccacaccccagagaaggacaaggtggtgtctgccttctacaccatcctgacccccatgctgaaccccctcatctacagcctgaggaacaaggatgtggccgccgccctgaggaaggtgctgggccgctgtggcagcagccagagcatccgggtggccaccgtcatcagaaaaggatag

SEQ ID NO: 36391 - DNA, 954 bp, Artificial Sequence
  Description of Artificial Sequence: Synthetic coding sequence
atggagcagagcaactacagcgtgtatgctgacttcatcctgctgggcctcttcagcaatgcccgcttcccctggctgctgtttgccctgatcctgctggtgttcctgaccagcatcgccagcaatgtggtgaagatcatcctgatccacatcgacagccggctgcacacccccatgtacttcctgctgagccagctgagcctgcgggacatcctgtacatcagcaccatcgtgcccaagatgctggtggaccaggtgatgagccagagggccatcagctttgctggctgcacagcccagcacttcctgtacctgaccctggccggggctgagttcttcctgctgggcctgatgtcctatgacagatatgtggccatctgcaaccccctgcactaccctgtgctgatgagcaggaagatctgctggctgattgtggccgccgcctggctgggcggcagcattgatggcttcctgctgacccctgtgaccatgcagttccccttctgtgccagccgggagatcaaccacttcttctgtgaggtgcctgccctgctgaagctgagctgcacagacaccagcgcctatgaaacagccatgtatgtgtgctgcatcatgatgctgctgatccccttcagcgtcatcagcggcagctacacccgcatcctgatcaccgtgtacaggatgtctgaggccgagggccggggcaaggctgtggccacctgcagcagccacatggtggtggtgtccctcttctacggggccgccatgtacacctacgtgctgccccacagctaccacaccccagagcaggacaaggctgtgtctgccttctacaccatcctgacccccatgctgaaccccctcatctacagcctgaggaacaaggatgtgactggagccctgcagaaggtggtgggccgctgtgtgtcctctgggaaggtgaccaccttctag

SEQ ID NO: 36392 - DNA, 948 bp, Artificial Sequence
  Description of Artificial Sequence: Synthetic coding sequence
atggccaacatcaccaggatggccaaccacacaggccgcctggacttcatcctgatgggcctcttccggcagagcaagcacccagccctgctgtctgtggtgatctttgtggtgttcctgaaggccctgtctggaaatgctgtgctgatcctgctgatccactgtgatgcccacctgcacagccccatgtacttcttcatcagccagctgagcctgatggacatggcctacatctctgtgacagtgcccaagatgctgctggaccaggtgatgggcgtgaacaaggtgtctgccccagaatgtggcatgcagatgttcctgtacctgaccctggccggcagcgagttcttcctgctggccaccatggcctatgacagatatgtggccatctgccaccccctgcgctaccctgtgctgatgaaccaccgggtgtgcctcttcctggccagcggctgctggttcctgggctctgtggatggcttcatgctgacccccatcaccatgtccttccccttctgccgctcctgggagatccaccacttcttctgtgaggtgcctgctgtgaccatcctgagctgcagcgacaccagcctgtatgagaccctgatgtacctgtgctgcgtgctgatgctgctgatccctgtgaccatcatcagcagcagctacctgctgatcctgctgactgtgcacaggatgaacagcgctgagggcaggaagaaggcctttgccacctgcagcagccacctgactgtggtgatcctcttctacggggctgctgtgtacacctacatgctgcccagcagctaccacaccccagagaaggacatgatggtgtctgtgttctacaccatcctgacccctgtgctgaaccccctcatctacagcctgaggaacaaggatgtgatgggcgccctgaagaagatgctgactgtgcgctttgtgctgtag

SEQ ID NO: 36393 - DNA, 957 bp, Artificial Sequence
  Description of Artificial Sequence: Synthetic coding sequence
atgtgcagcggcaaccagaccagccagaaccagacagccagcacagacttcaccctgaccggcctgtttgctgagagcaagcatgctgccctgctgtacacagtgaccttcctgctcttcctgatggccctgactggaaatgccctgctgatcctgctgatccacagcgagccccggctgcacacccccatgtacttcttcatcagccagctggccctgatggacctgatgtacctgtgtgtgacagtgcccaagatgctggtgggccaggtgactggagatgacaccatcagccccagcggctgcggcatccagatgttcttctacctgaccctggccggggctgaggtgttcctgctggccgccatggcctatgacagatatgctgctgtgtgccggcccctgcactaccccctgctgatgaaccagagggtgtgccagctgctggtgtctgcctgctgggtgctgggcatggtggatggcctgctgctgacccccatcaccatgtccttccccttctgccagagcaggaagatcctgtccttcttctgtgagaccccagccctgctgaagctgagctgcagtgatgtgtccctgtacaagaccctgatgtacctgtgctgcatcctgatgctgctggcccccatcatggtgatcagcagcagctacaccctcatcctgcacctgatccacaggatgaacagcgctgctggccacaggaaggccctggccacctgcagcagccacatgatcatcgtgctgctgctgtttggagccagcttctacacctacatgctgcccagcagctaccacacagctgagcaggacatgatggtgtctgccttctacaccatcttcacccctgtgctgaaccccctcatctacagcctgaggaacaaggatgtgacccgggccctgcgctccatgatgcagagcaggatgaaccaggagaagtag

SEQ ID NO: 36394 - DNA, 963 bp, Artificial Sequence
  Description of Artificial Sequence: Synthetic coding sequence
atggagatgaggaacaccaccccagacttcatcctgctgggcctcttcaaccacacccgggcccaccaggtgctcttcatgatggtgctgagcatcgtgctgaccagcctgtttggaaacagcctgatgatcctgctgatccactgggaccaccggctgcacacccccatgtacttcctgctgagccagctgagcctgatggacatgatgctggtgtccaccaccgtgcccaagatggctgctgactacctgaccggcagcaaggccatcagcagagctggctgcggcgtgcagatcttcttcctgcccaccctgggcggcggggagtgcttcctgctggccgccatggcctatgacagatatgctgctgtgtgccaccccctgcgctaccccaccctgatgtcctggcagctgtgcctgaggatgaccatgagctgctggctgctgggcgctgctgatggcctgctgcaggccgtggtgaccctgtccttcccctactgtggggcccacgagattgaccacttcttctgtgagacccctgtgctggtgcggctggcctgtgccgacacctctgtgtttgaaaatgccatgtacatctgctgcgtgctgatgctgctggtgcccttcagcctcatcctgagcagctatggcctcatcctggccgctgtgctgcacatgaggagcacagaggccaggaagaaggcctttgccacctgcagcagccacgtggccgtggtgggcctcttctacggggccgccatcttcacctacatgaggcccaagagccacaggagcaccaaccacgacaaggtggtgtctgccttctacaccatgttcacccccctgctgaaccccctcatctacagcgtgaagaacagcgaggtgaagggggccctgaagcgctggctgggcacctgtgtgaacatcaagcaccagcagaatgaggcccacaggagcaggtag

SEQ ID NO: 36395 - DNA, 957 bp, Artificial Sequence
  Description of Artificial Sequence: Synthetic coding sequence
atgtgcagcggcaaccagaccagccagaaccagacagccagcacagacttcaccctgaccggcctgtttgctgagagcaagcatgctgccctgctgtacacagtgaccttcctgctcttcctgatggccctgactggaaatgccctgctgatcctgctgatccacagcgagccccggctgcacacccccatgtacttcttcatcagccagctggccctgatggacctgatgtacctgtgtgtgacagtgcccaagatgctggtgggccaggtgactggagatgacaccatcagccccagcggctgcggcatccagatgttcttccacctgaccctggccggggctgaggtgttcctgctggccgccatggcctatgacagatatgctgctgtgtgccggcccctgcactaccccctgctgatgaaccagagggtgtgccagctgctggtgtctgcctgctgggtgctgggcatggtggatggcctgctgctgacccccatcaccatgtccttccccttctgccagagcaggaagatcctgtccttcttctgtgagaccccagccctgctgaagctgagctgcagtgatgtgtccctgtacaagatgctgacctacctgtgctgcatcctgatgctgctgacccccatcatggtgatcagcagcagctacaccctcatcctgcacctgatccacaggatgaacagcgctgctggaagaaggaaggccctggccacctgcagcagccacatgatcatcgtgctgctgctgtttggagccagcttctacacctacatgctgcggagcagctaccacacagctgagcaggacatgatggtgtctgccttctacaccatcttcacccctgtgctgaaccccctcatctacagcctgaggaacaaggatgtgacccgggccctgcgctccatgatgcagagcaggatgaaccaggagaagtag

SEQ ID NO: 36396 - DNA, 972 bp, Artificial Sequence
  Description of Artificial Sequence: Synthetic coding sequence
atgggcatggagggcctgctgcagaacagcaccaactttgtgctgaccggcctcatcacccacccagccttccctggcctgctgtttgctgtggtgttcagcatctttgtggtggccatcacagccaacctggtgatgatcctgctgatccacatggacagccggctgcacacccccatgtacttcctgctgagccagctgagcatcatggacaccatctacatctgcatcaccgtgcccaagatgctgcaggacctgctgagcaaggacaagaccatctccttcctgggctgtgctgtgcagatcttctacctgaccctcatcggcggggagttcttcctgctgggcctgatggcctatgacagatatgtggccgtgtgcaaccccctgcgctaccccctgctgatgaacagaagagtgtgcctcttcatggtggtgggctcctgggtgggcggcagcctggatggcttcatgctgacccctgtgaccatgtccttccccttctgccgcagccgggagatcaaccacttcttctgtgagatcccagctgtgctgaagctgagctgcacagacaccagcctgtatgagaccctgatgtatgcctgctgcgtgctgatgctgctgatccccctgagcgtcatctctgtgtcctacacccacatcctgctgactgtgcacaggatgaacagcgctgagggccgcaggaaggcctttgccacctgcagcagccacatcatggtggtgtctgtgttctacggggccgccttctacaccaacgtgctgccccacagctaccacaccccagagaaggacaaggtggtgtctgccttctacaccatcctgacccccatgctgaaccccctcatctacagcctgaggaacaaggatgtggccgccgccctgaggaaggtgctgggccgctgtggcagcagccagagcatccgggtggccaccgtcatcaggaagggctag

SEQ ID NO: 36397 - DNA, 1047 bp, Artificial Sequence
  Description of Artificial Sequence: Synthetic coding sequence
atggacaacatcacctggatggccagccacacaggctggagcgacttcatcctgatgggcctcttccggcagagcaagcaccccatggccaacatcacctggatggccaaccacacaggctggagcgacttcatcctgctgggcctcttccggcagagcaagcacccagccctgctgtgtgtggtgatctttgtggtgttcctgatggccctgtctggaaatgctgtgctgatcctgctgatccactgtgatgcccacctgcacacccccatgtacttcttcatcagccagctgagcctgatggacatggcctacatctctgtgacagtgcccaagatgctgctggaccaggtgatgggcgtgaacaagatcagcgccccagaatgtggcatgcagatgttcttctacgtgaccctggccggcagcgagttcttcctgctggccaccatggcctatgacagatatgtggccatctgccaccccctgcgctaccctgtgctgatgaaccaccgggtgtgcctcttcctgagcagcggctgctggttcctgggctctgtggatggcttcaccttcacccccatcaccatgaccttccccttccggggcagccgggagatccaccacttcttctgtgaggtgcctgctgtgctgaacctgagctgcagcgacaccagcctgtatgagatcttcatgtacctgtgctgcgtgctgatgctgctgatccctgtggtgatcatcagcagcagctacctgctgatcctgctgaccatccacggcatgaacagcgctgagggcaggaagaaggcctttgccacctgcagcagccacctgactgtggtgatcctcttctacggggccgccatctacacctacatgctgcccagcagctaccacaccccagagaaggacatgatggtgtctgtgttctacaccatcctgacccctgtggtgaaccccctcatctacagcctgaggaacaaggatgtgatgggcgccctgaagaagatgctgactgtggagcccgccttccagaaggccatggagtag

SEQ ID NO: 36398 - DNA, 948 bp, Artificial Sequence
  Description of Artificial Sequence: Synthetic coding sequence
atggccaacatcaccaggatggccaaccacacaggcaagctggacttcatcctgatgggcctcttcagaagaagcaagcacccagccctgctgtctgtggtgatctttgtggtgttcctgaaggccctgtctggaaatgctgtgctgatcctgctgatccactgtgatgcccacctgcacagccccatgtacttcttcatcagccagctgagcctgatggacatggcctacatctctgtgacagtgcccaagatgctgctggaccaggtgatgggcgtgaacaaggtgtctgccccagaatgtggcatgcagatgttcctgtacctgaccctggccggcagcgagttcttcctgctggccaccatggcctatgacagatatgtggccatctgccaccccctgcgctaccctgtgctgatgaaccaccgggtgtgcctcttcctggccagcggctgctggttcctgggctctgtggatggcttcatgctgacccccatcaccatgtccttccccttctgccgctcctgggagatccaccacttcttctgtgaggtgcctgctgtgaccatcctgagctgcagcgacaccagcctgtatgagaccctgatgtacctgtgctgcgtgctgatgctgctgatccctgtgaccatcatcagcagcagctacctgctgatcctgctgactgtgcacaggatgaacagcgctgagggcaggaagaaggcctttgccacctgcagcagccacctgactgtggtgatcctcttctacggggctgctgtgtacacctacatgctgcccagcagctaccacaccccagagaaggacatgatggtgtctgtgttctacaccatcctgacccctgtgctgaaccccctcatctacagcctgaggaacaaggatgtgatgggcgccctgaagaagatgctgactgtgcgctttgtgctgtag

SEQ ID NO: 36399 - DNA, 927 bp, Artificial Sequence
  Description of Artificial Sequence: Synthetic coding sequence
atgaatgaaaataatgagaccctgacccggggcttcaccctgatgggcctcttcacccacaacaagtgcagcggcttcttcttcggggtcatctgtgctgtgttcttcatggccatgattgccaacggggtgatgatcttcctgatcaacatcgacccccacctgcacacccccatgtacttcctgctgagccacctgtctgtgattgacaccctgtacatcagcaccatcgtgcccaagatgctggtggactacctgatgggagagggcaccatctccttcatcgcctgcacagcccagtgcttcctgtacatgggcttcatgggcgctgagttcttcctgctgggcctgatggcctatgacagatatgtggccatctgcaaccccctgcgctaccctgtgctgatctcctggagggtgtgctggatgatcctggccagctcctggtttggaggagccctggacagcttcctgctgacccccatcaccatgagcctgcccttctgtgccagccaccagatcaaccacttcttctgtgaggcccccaccatgctgcggctggcctgtggggacaagaccacctatgaaacagtgatgtatgtgtgctgcgtggccatgctgctgatccccttctctgtggtgacagccagctacacccgcatcctgatcaccgtgcaccagatgaccagcgctgagggcaggaagaaggcctttgccacctgcagcagccacatgatggtggtgaccctcttctacggggccgccctgtacacctacaccctgccccagagctaccacacccccatcaaggacaaggtgttttctgccttctacaccatcctgacccccctgctgaaccccctcatctacagcctgaggaacagagatgtgatgggcgccctgaagagggtggtggcccgctgctag

SEQ ID NO: 36400 - DNA, 948 bp, Artificial Sequence
  Description of Artificial Sequence: Synthetic coding sequence
atgggccgctgggtgaaccagagctacacagatggcttcttcctgctgggcatcttcagccacagccagacagacctggtgctcttctctgctgtgatggtggtgttcaccgtggccctgtgtggaaatgtgctgctgatcttcctgatctacctggatgctggcctgcacacccccatgtacttcttcctgagccagctgagcctgatggacctgatgctggtgtgcaacatcgtgcccaagatggccgccaacttcctgagcggcaggaagagcatcagctttgtgggctgcggcatccagatcggcttctttgtgtccctggtgggcagcgagggcctgctgctgggcctgatggcctatgaccgctacgtggccgtgagccaccccctgcactaccccatcctgatgaaccagagggtgtgcctgcagatcaccggcagctcctgggccttcggcatcattgatggagtcatccagatggtggccgccatgggcctgccctactgcggcagccgctctgtggaccacttcttctgtgaggtgcaggccctgctgaagctggcctgtgccgacaccagcctgtttgacaccctgctgtttgcctgctgcgtgttcatgctgctgctgcccttcagcatcatcatggccagctatgcctgcatcctgggcgctgtgctgcgcatccgcagcgcccaggcctggaagaaggccctggccacctgcagcagccacctgacagctgtgaccctcttctatggagctgccatgttcatgtacctgcggccccggcgctaccgggcccccagccatgacaaggtggccagcatcttctacacagtgctgacccccatgctgaaccccctcatctacagcctgagaaatggagaggtgatgggcgccctgaggaagggcctggaccgctgcagaattggcagccagcactag

SEQ ID NO: 36401 - DNA, 948 bp, Artificial Sequence
  Description of Artificial Sequence: Synthetic coding sequence
atggagacctgggtgaaccagagctacacagatggcttcttcctgctgggcatcttcagccacagcacagctgacctggtgctcttctctgtggtgatggctgtgttcaccgtggccctgtgtggaaatgtgctgctgatcttcctgatctacatggacccccacctgcacacccccatgtacttcttcctgagccagctgagcctgatggacctgatgctggtgtgcaccaacgtgcccaagatggccgccaacttcctgagcggcaggaagagcatcagctttgtgggctgcggcatccagatcggcctgtttgtgtgcctggtgggcagcgagggcctgctgctgggcctgatggcctatgaccgctacgtggccatcagccaccccctgcactaccccatcctgatgaaccagagggtgtgcctgcagatcaccggcagctcctgggccttcggcatcattgatggcctcatccagatggtggtggtgatgaacttcccctactgcggcctgaggaaggtgaaccacttcttctgtgagatgctgagcctgctgaagctggcctgtgtggacaccagcctgtttgagaaggtgatctttgcctgctgcgtgttcatgctgctcttccccttcagcatcatcgtggccagctatgcccacatcctgggcaccgtgctgcagatgcacagcgcccaggcctggaagaaggccctggccacctgcagcagccacctgacagctgtgaccctcttctatggagctgccatgttcatctacctgcggcccaggcactaccgggcccccagccatgacaaggtggccagcatcttctacacagtgctgacccccatgctgaaccccctcatctacagcctgaggaaccgggaggtgatgggcgccctgaggaagggcctggaccgctgcagaattggcagccagcactag

SEQ ID NO: 36402 - DNA, 963 bp, Artificial Sequence
  Description of Artificial Sequence: Synthetic coding sequence
atggaccagagcaactacagcagcctgcacggcttcatcctgctgggcttcagcaaccaccccaagatggagatgatcctgagcggcgtggtggccatcttctacctgatcaccctggtgggcaacacagccatcatcctggccagcctgctggacagccagctgcacacccccatgtacttcttcctgaggaacctgtccttcctggacctgtgcttcaccaccagcatcatcccccagatgctggtgaacctgtggggccctgacaagaccatctcctatgtgggctgcatcatccagctgtatgtgtacatgtggctgggctctgtggagtgcctgctgctggccgtgatgtcctatgaccgcttcaccgccatctgcaagcccctgcactactttgtggtgatgaacccccacctgtgcctgaagatgatcatcatgatctggagcatcagcctggccaacagcgtggtgctgtgcaccctgaccctgaacctgcccacctgtggcaacaacatcctggaccacttcctgtgtgagctgcctgccctggtgaagatcgcctgtgtggacaccaccaccgtggagatgtctgtgtttgccctgggcatcatcatcgtgctgacccccctcatcctgatcctgatctcctatggctacatcgccaaggctgtgctgcggaccaagagcaaggccagccagaggaaggccatgaacacctgtggcagccacctgactgtggtgtccatgttctacggcaccatcatctacatgtacctgcagcccggcaacagagccagcaaggaccagggcaagttcctgaccctcttctacaccgtcatcacccccagcctgaaccccctcatctacaccctgaggaacaaggacatgaaggatgccctgaagaagctgatgaggttccaccacaagagcaccaagatcaagaggaactgcaagagctag

SEQ ID NO: 36403 - DNA, 963 bp, Artificial Sequence; identical to SEQ ID NO: 36402
  Description of Artificial Sequence: Synthetic coding sequence

SEQ ID NO: 36404 - DNA, 963 bp, Artificial Sequence; identical to SEQ ID NO: 36402
  Description of Artificial Sequence: Synthetic coding sequence

SEQ ID NO: 36405 - DNA, 963 bp, Artificial Sequence; identical to SEQ ID NO: 36402
  Description of Artificial Sequence: Synthetic coding sequence

SEQ ID NO: 36406 - DNA, 963 bp, Artificial Sequence; identical to SEQ ID NO: 36402
  Description of Artificial Sequence: Synthetic coding sequence

SEQ ID NO: 36407 - DNA, 963 bp, Artificial Sequence; identical to SEQ ID NO: 36402
  Description of Artificial Sequence: Synthetic coding sequence

SEQ ID NO: 36408 - DNA, 963 bp, Artificial Sequence; identical to SEQ ID NO: 36402
  Description of Artificial Sequence: Synthetic coding sequence

SEQ ID NO: 36409 - DNA, 963 bp, Artificial Sequence; identical to SEQ ID NO: 36402
  Description of Artificial Sequence: Synthetic coding sequence

SEQ ID NO: 36410 - DNA, 945 bp, Artificial Sequence
  Description of Artificial Sequence: Synthetic coding sequence
atggatggcaccaacggcagcacccagacccacttcatcctgctgggcttcagtgaccggccccacctggagcgcatcctgtttgtggtgatcctgattgcctacctgctgaccctggtgggcaacaccaccatcatcctggtgtcccggctggacccccacctgcacacccccatgtacttcttcctggcccacctgtccttcctggacctgtccttcaccaccagcagcatcccccagctgctgtacaacctgaatggctgtgacaagaccatctcctacatgggctgtgccatccagctgttcctgttcctgggcctgggcggcgtggagtgcctgctgctggccgtgatggcctatgacagatgtgtggccatctgcaagcccctgcactacatggtgatcatgaacccccggctgtgccggggcctggtgtctgtgacctggggctgcggcgtggccaacagcctggccatgagccctgtgaccctgcggctgccccgctgtggccaccacgaggtggaccacttcctgcgggagatgcctgccctgatccgcatggcctgtgtgtccacagtggccatcgagggcaccgtgtttgtgctggccgtgggcgtggtgctgagccccctggtgttcatcctgctgagctacagctacatcgtgcgggctgtgctgcagatccgcagcgccagcggccggcagaaggccttcggcacctgtggcagccacctgactgtggtgtccctcttctacggcaacatcatctacatgtacatgcagcccggggccagcagcagccaggaccagggcatgttcctgatgctgttctacaacatcgtgacccccctgctgaaccccctcatctacaccctgaggaaccgggaggtgaagggggccctgggccgcctgctgctgggcaagcgggagctgggcaaggagtag

SEQ ID NO: 36411 - DNA, 945 bp, Artificial Sequence; identical to SEQ ID NO: 36410
  Description of Artificial Sequence: Synthetic coding sequence

SEQ ID NO: 36412 - DNA, 936 bp, Artificial Sequence
  Description of Artificial Sequence: Synthetic coding sequence
atgggcagcttcaacaccagctttgaagatggcttcatcctggtgggcttcagtgactggccccagctggagcccatcctgtttgtgttcatcttcatcttctacagcctgaccctgtttggaaacaccatcatcatcgccctgtcctggctggacctgcggctgcacacccccatgtacttcttcctgagccacctgagcctgctggacctgtgcttcaccaccagcacagtgccccagctgctgatcaacctgtgtggggtggacaggaccatcacccggggcggctgtgtggcccagctgttcatctacctggccctgggcagcacagaatgtgtgctgctggtggtgatggcctttgacagatatgctgctgtgtgccggcccctgcactacatggccatcatgcacccccacctgtgccagaccctggccatcgcctcctggggcgccggctttgtgaacagcctcatccagacaggcctggccatggccatgcccctgtgtggccaccggctgaaccacttcttctgtgagatgcctgtgttcctgaagctggcctgtgccgacacagagggcacagaggccaagatgtttgtggcccgggtcatcgtggtggccgtgcctgctgccctgatcctgggcagctatgtgcacatcgcccatgctgtgctgcgggtgaagagcacagctggaagaaggaaggccttcggcacctgtggcagccacctgctggtggtgttcctgttctacggcagcgccatctacacctacctgcagagcatccacaactacagcgagcgggagggcaagtttgtggccctcttctacaccatcatcacccccatcctgaaccccctcatctacaccctgaggaacaaggatgtgaagggggccctgtggaaggtgctgtggaggggccgggacagcggctag

SEQ ID NO: 36413 - DNA, 945 bp, Artificial Sequence
  Description of Artificial Sequence: Synthetic coding sequence
atgggagatgtgaaccagagcgtggccagtgacttcatcctggtgggcctcttcagccacagcggcagccggcagctgctcttcagcctggtggccgtgatgtttgtgattggcctgctgggcaacacagtgctgctcttcctgatccgggtggacagccggctgcacacccccatgtacttcctgctgagccagctgagcctgtttgatattggctgccccatggtgaccatccccaagatggccagtgacttcctgcggggggagggcgccaccagctatggaggaggagctgcccagatcttcttcctgaccctgatgggcgtggccgagggcgtgctgctggtgctgatgtcctatgacagatatgtggccgtgtgccagcccctgcagtaccctgtgctgatgaggcggcaggtgtgcctgctgatgatgggcagctcctgggtggtgggcgtgctgaatgccagcatccagaccagcatcaccctgcacttcccctactgtgccagcagaattgtggaccacttcttctgtgaggtgcctgccctgctgaagctgagctgtgccgacacctgtgcctatgagatggccctgagcaccagcggcgtgctgatcctgatgctgcccctgagcctcatcgccaccagctatggccacgtgctgcaggccgtgctgtccatgaggtctgaggaggcccggcacaaggctgtgaccacctgcagcagccacatcaccgtggtgggcctcttctacggggctgctgtgttcatgtacatggtgccctgtgcctaccacagcccccagcaggacaacgtggtgtccctcttctacagcctggtgacccccaccctgaaccccctcatctacagcctgagaaatcctgaggtgtggatggccctggtgaaggtgctgagccgggccggcctgcggcagatgtgctag

SEQ ID NO: 36414 - DNA, 948 bp, Artificial Sequence
  Description of Artificial Sequence: Synthetic coding sequence
atgcagcctgagagcggggccaacggcaccgtgattgctgagttcatcctgctgggcctgctggaggcccctggcctgcagcctgtggtgtttgtgctcttcctgtttgcctacctggtgacagtgcggggcaacctgagcatcctggccgctgtgctggtggagcccaagctgcacacccccatgtacttcttcctgggcaacctgtctgtgctggatgtgggctgcatctctgtgacagtgcccagcatgctgagccggctgctgagcaggaagagagctgtgccctgtggggcctgcctgacccagctgttcttcttccacctgtttgtgggcgtggactgcttcctgctgacagccatggcctatgaccgcttcctggccatctgccggcccctgacctacagcaccaggatgagccagacagtgcagaggatgctggtggccgcctcctgggcctgtgccttcaccaatgccctgacccacacagtggccatgagcaccctgaacttctgtggccccaacgtcatcaaccacttctactgtgacctgccccagctgttccagctgagctgcagcagcacccagctgaatgagctgctgctgtttgctgtgggcttcatcatggccggcacccccatggccctgattgtcatctcctacatccacgtggccgctgctgtgctgcgcatccgctctgtggagggcaggaagaaggccttcagcacctgtggcagccacctgactgtggtggccatcttctacggcagcggcatcttcaactacatgaggctgggcagcaccaagctgagtgacaaggacaaggctgtgggcatcttcaacacagtcatcaaccccatgctgaaccccatcatctacagcttcaggaacccagatgtgcagagcgccatctggaggatgctgactggaagaagaagcctggcctag

SEQ ID NO: 36415 - DNA, 966 bp, Artificial Sequence
  Description of Artificial Sequence: Synthetic coding sequence
atgagcctgcagaagctgatggagcctgaggccggcaccaacagaacagctgtggccgagttcatcctgctgggcctggtgcagacagaggagatgcagcctgtggtgtttgtgctgctgctgtttgcctacctggtgaccaccggcggcaacctgagcatcctggccgctgtgctggtggagcccaagctgcacgcccccatgtacttcttcctgggcaacctgtctgtgctggatgtgggctgcatcaccgtgacagtgcctgccatgctgggccgcctgctgagccacaagagcaccatctcctatgatgcctgcctgagccagctgttcttcttccacctgctggccggcatggactgcttcctgctgacagccatggcctatgaccggctgctggccatctgccagcccctgacctacagcaccaggatgagccagacagtgcagaggatgctggtggccgccagcctggcctgtgccttcaccaatgccctgacccacacagtggccatgagcaccctgaacttctgtggccccaatgaggtgaaccacttctactgtgacctgccccagctgttccagctgagctgcagcagcacccagctgaatgagctgctgctgtttgctgtgggcttcatcatggccggcacccccctggtgctgatcatcacagcctacagccacgtggccgctgctgtgctgcgcatccgctctgtggagggcaggaagaaggccttcagcacctgtggcagccacctgactgtggtgtgcctcttcttcggccggggcatcttcaactacatgaggctgggcagcgaggaggccagtgacaaggacaagggcgtgggcgtcttcaacacagtcatcaaccccatgctgaaccccctcatctacagcctgaggaacccagatgtgcagggcgccctgtggcagatcttcctgggcagaagaagcctgacctag

SEQ ID NO: 36416 - DNA, 966 bp, Artificial Sequence
  Description of Artificial Sequence: Synthetic coding sequence
atgagcctgcagaagctgatggagcctgaggccggcaccaacagaacagctgtggccgagttcatcctgctgggcctggtgcagacagaggagatgcagcctgtggtgtttgtgctgctgctgtttgcctacctggtgaccaccggcggcaacctgagcatcctggccgctgtgctggtggagcccaagctgcacgcccccatgtacttcttcctgggcaacctgtctgtgctggatgtgggctgcatcaccgtgacagtgcctgccatgctgggccgcctgctgagccacaagagcaccatctcctatgatgcctgcctgagccagctgttcttcttccacctgctggccggcatggactgcttcctgctgacagccatggcctatgaccggctgctggccatctgccagcccctgacctacagcaccaggatgagccagacagtgcagaggatgctggtggccgcctcctgggcctgtgccttcaccaatgccctgacccacacagtggccatgagcaccctgaacttctgtggccccaatgaggtgaaccacttctactgtgacctgccccagctgttccagctgagctgcagcagcacccagctgaatgagctgctgctgtttgtggccgccgccttcatggctgtggcccccctggtgttcatctctgtgtcctatgcccacgtggtggccgctgtgctgcagatccgctctgctgagggcaggaagaaggccttcagcacctgtggcagccacctgactgtggtgggcatcttctatggaactggagtcttctcctacatgaggctgggctctgtggagagcagtgacaaggacaagggcgtgggcgtcttcatgaccgtcatcaaccccatgctgaaccccctcatctacagcctgaggaacacagatgtgcagggcgccctgtgccagctgctggtgggcaagaggagcctgacctag

SEQ ID NO: 36417 - DNA, 1035 bp, Artificial Sequence
  Description of Artificial Sequence: Synthetic coding sequence
atggagctgctgaccaacaacctgaagttcatcacagacccctttgtgtgccgcctgcggcacctgagccccaccccatctgaggagcacatgaagaacaagaacaacgtgacagagttcatcctgctgggcctgacccagaaccctgagggccagaaggtgctgtttgtgaccttcctgctgatctacatggtgaccatcatgggcaacctgctgatcatcgtgaccatcatggccagccagagcctgggcagccccatgtacttcttcctggccagcctgtccttcatcgacacagtgtacagcacagcctttgcccccaagatgattgtggacctgctgtctgagaagaagaccatctccttccagggctgcatggcccagctgttcatggaccacctgtttgctggagctgaggtgatcctgctggtggtgatggcctatgaccgctacatggccatctgcaagcccctgcacgagctgatcaccatgaacagaagagtgtgtgtgctgatgctgctggccgcctggattggaggcttcctgcacagcctggtgcagttcctgttcatctaccagctgcccttctgtggccccaacgtcatcgacaacttcctgtgtgacctgtaccccctgctgaagctggcctgcaccaacacctacgtgacaggcctgtccatgattgccaacggcggggccatctgtgctgtgaccttcttcaccatcctgctgtcctatggagtcatcctgcacagcctgaagacccagagcctggagggcaagaggaaggccttctacacctgtgccagccacgtgacagtggtgatcctcttctttgtgccctgcatcttcctgtatgcccggcccaacagcaccttccccatcgacaagtccatgacagtggtgctgaccttcatcacccccatgctgaaccccctcatctacaccctgaagaatgctgagatgaagagcgccatgaggaagctgtggagcaagaaggtgtccctggccggcaagtggctgtaccacagctag

SEQ ID NO: 36418 - DNA, 987 bp, Artificial Sequence
  Description of Artificial Sequence: Synthetic coding sequence
atgaggcccagcagcaatgtgacagaatttgtgctgctgggcctgacccaggaccctgatgtgaagaagaccctgtttgtgatgttcctgctgatctacatcgtgaccatggtgggcaacctgctgatctgggtgaccaccatcggcagccccagcctgggcagcctgatgtacttcttcctggcctacctgagcctgatggatgccatctacagcacagccatgagccccaagctgatgattgacctgctgtgtgacaagatcgccatcagcctgagcgcctgcatgggccagctgttcatcgagcacctgctgggcggcgctgaggtgttcctgctggtggtgatggcctatgacagatatgtggccatcagcaagcccctgcactacctgaacatcatgaaccggctggtgtgcatcctgctgctggtggtggccatgattggaggctttgtgcacagcgtggtgcagatcgtgttcctgtacagcctgcccatctgtggccccaacgtcatcgaccacagcgtgtgtgacatgtaccccctgctggagctgctgtgcctggacacctacttcatcggcctgactgtggtggccaacggcggcatcatctgcatggtgatcttcaccttcctgctgatcagctgtggggtcatcctgaacttcctgaagacctacagccaggaggagcggcacaaggccctgcccacctgcatcagccacatcatcgtggtggccctggtgtttgtgccctgcatcttcatgtatgtgcggcctgtgagcaacttcccctttgacaagctgatgaccgtcttctacagcatcatcaccctgatgctgaaccccctcatctacagcctgcggcagagcgagatgaagaatgccatgaagaacctgtggtgtgagaagctgagcatcgtgaggaagagggtgagccccaccctgaacatcttcatccccagcagcaaggccaccaacagaagatag

SEQ ID NO: 36419 - DNA, 930 bp, Artificial Sequence
  Description of Artificial Sequence: Synthetic coding sequence
atggagcccaggaagaatgtgacagactttgtgctgctgggcttcacccagaaccccaaggagcagaaggtgctgtttgtgatgttcctgctcttctacatcctgaccatggtgggcaacctgctgattgtggtgacagtgacagtgtctgagaccctgggcagccccatgtacttcttcctggccggcctgtccttcatcgacatcatctacagcagcagcatcagccccaggctcatcagcggcctcttctttggaaacaacagcatctccttccagagctgcatggcccagctgttcatcgagcacatctttggaggcagcgaggtgttcctgctgctggtgatggcctatgactgctacgtggccatctgcaagcccctgcactacctggtgatcatgaggcagtgggtgtgtgtggtgctgctggtggtgtcctgggtgggcggcttcctgcacagcgtcttccagctgagcatcatctacggcctgcccttctgtggccccaacgtcatcgaccacttcttctgtgacatgtaccccctgctgaagctggtgtgcacagacacccacgccatcggcctgctggtggtggccaacggcggcctggcctgcaccatcgtgttcctgctgctgctgatctcctatggagtcatcctgcacagcctgaagaacctgagccagaagggccggcagaaggccctgagcacctgcagcagccacatgacagtggtggtgttcttctttgtgccctgcatcttcatgtatgcccggcctgcccggaccttccccatcgacaagtctgtgtctgtgttctacaccgtcatcacccccatgctgaaccccctcatctacaccctgaggaacagcgagatgaccagcgccatgaagaagctgtggaggcgggacctgatcagcagcagcacctag

SEQ ID NO: 36420 - DNA, 948 bp, Artificial Sequence
  Description of Artificial Sequence: Synthetic coding sequence
atgaggcagaacaacaacatcacagaatttgtgctgctgggcttcagccaggaccccggggtgcagaaggccctgtttgtgatgttcctgctgacctacctggtgacagtggtgggcaacctgctgattgtggtggacatcatcgccagccccagcctgggcagccccatgtacttcttcctggcctgcctgtccttcattgatgctgcctacagcaccaccatcagccccaagctgattgtgggcctcttctgtgacaagaagaccatctccttccagggctgcatgggccagctgttcatcgaccacttctttggaggagctgaggtgttcctgctggtggtgatggcctgtgacagatatgtggccatctgcaagcccctgcactacctgaccatcatgaaccggcaggtgtgcttcctgctgctggtggtggccatgattggaggctttgtgcacagcgccttccagatcgtggtgtacagcctgcccttctgtggccccaacgtgattgtgcacttcagctgtgacatgcaccccctgctggagctggcctgcacagacacctacttcatcggcctgactgtggtggtgaacagcggggccatctgcatggtgatcttcaacctgctgctgatctcctatggagtcatcctgagcagcctgaagacctacagccaggagaagaggggcaaggccctgagcacctgcagcagcggcagcacagtggtggtgctcttctttgtgccctgcatcttcatctacgtgcggcctgtgagcaacttccccacagacaagttcatgacagtgttctacaccatcatcacccacatgctgagccccctcatctacaccctgagaaattctgagatgagaaatgccatcgagaagctgctgggcaagaagctgaccatcttcatcatcggcggcgtgtctgtgctgatgtag

SEQ ID NO: 36421 - DNA, 930 bp, Artificial Sequence
  Description of Artificial Sequence: Synthetic coding sequence
atggccagcaccagcaatgtgacagagctgatcttcaccggcctcttccaggaccctgctgtgcagagcgtgtgctttgtggtgttcctgcctgtgtacctggccaccgtggtgggcaatggcctgattgtgctgactgtgtccatcagcaagagcctggacagccccatgtacttcttcctgagctgcctgagcctggtggagatctcctacagcagcaccatcgcccccaagttcatcatcgacctgctggccaagatcaagaccatcagcctggagggctgcctgacccagatcttcttcttccacttctttggagtggccgagatcctgctgattgtggtgatggcctatgactgctacgtggccatctgcaagcccctgcactacatgaacatcatcagccggcagctgtgccacctgctggtggccggctcctggctgggcggcttctgccacagcatcatccagatcctggtgatcatccagctgcccttctgtggccccaacgtcatcgaccactacttctgtgacctgcagcccctcttcaagctggcctgcacagacaccttcatggagggcgtcatcgtgctggccaacagcggcctcttctctgtgttctccttcctgatcctggtgtcctcctacatcgtcatcctggtgaacctgaggaaccacagcgctgagggccgccacaaggccctgagcacctgtgccagccacatcaccgtggtgatcctcttctttggacctgccatcttcctgtacatgaggcccagcagcaccttcacagaggacaagctggtggccgtgttctacaccgtcatcacccccatgctgaaccccatcatctacaccctgagaaatgctgaggtgaagatcgccatccggcggctgtggagcaagaaggagaaccctggccgggagtag

SEQ ID NO: 36422 - DNA, 933 bp, Artificial Sequence
  Description of Artificial Sequence: Synthetic coding sequence
atgcagcagaacaacagcgtgcctgagttcatcctgctgggcctgacccaggaccccctgcggcagaagatcgtgtttgtgatcttcctgatcttctacatgggcaccgtggtgggcaacatgctgatcatcgtgaccatcaagagcagcaggaccctgggcagccccatgtacttcttcctgttctacctgagctttgctgacagctgcttcagcaccagcacagcccccaggctcatcgtggatgccctgtctgagaagaagatcatcacctacaatgaatgcatgacccaggtgtttgccctgcacctgtttggctgcatggagatctttgtgctgatcctgatggctgtggacagatatgtggccatctgcaagcccctgcgctaccccaccatcatgagccagcaggtgtgcatcatcctgattgtgctggcctggattggcagcctcatccacagcacagcccagatcatcctggccctgcggctgcccttctgtggcccctacctgattgaccactactgctgtgacctgcagcccctgctgaagctggcctgcatggacacctacatgatcaacctgctgctggtgagcaacagcggggccatctgcagcagcagcttcatgatcctgatcatctcctacatcgtcatcctgcacagcctgaggaaccacagcgccaagggcaagaagaaggccctgagcgcctgcaccagccacatcatcgtggtgatcctcttcttcggcccctgcatcttcatctacaccaggcctcccaccaccttccccatggacaagatggtggccgtgttctacaccatcggcacccccttcctgaaccccctcatctacaccctgagaaatgctgaggtgaagaatgccatgaggaagctgtggcacggcaagatcatcagtgaaaataaaggatag

SEQ ID NO: 36423 - DNA, 930 bp, Artificial Sequence
  Description of Artificial Sequence: Synthetic coding sequence
atggagaagaagaagaatgtgacagagttcatcctgattggcctgacccagaaccccatcatggagaaggtgacctttgtggtgttcctggtgctgtacatgatcaccctgagcggcaacctgctgattgtggtgaccatcaccaccagccaggccctgagcagccccatgtacttcttcctgacccacctgagcctgattgacacagtgtacagcagcagcagcgcccccaagctgattgtggacagcttccaggagaagaagatcatctccttcaacggctgcatggcccaggcctatgcagagcacatctttggagccacagagatcatcctgctgactgtgatggcctgtgactgctacgtggccatctgcaagcccctgaactacaccaccatcatgagccacagcctgtgcatcctgctggtggccgtggcctgggtgggcggcttcctgcacgccaccatccagatcctcttcaccgtgtggctgcccttctgtggccccaacgtcatcggccacttcatgtgtgacctgtaccccctgctgaagctggtgtgcatcgacacccacaccctgggcctgtttgtggccgtgaacagcggcttcatctgcctgctgaacttcctgatcctggtggtgtcctatgtgatcatcctgcggagcctgaagaacaacagcctggagggccgctgcaaggccctgagcacctgcatcagccacatcatcgtggtggtgctcttctttgtgccctgcatctttgtgtacctgcggtctgtgaccaccctgcccatcgacaaggctgtggccgtgttctacaccatggtggtgcccatgctgaaccctgtggtgtacaccctgagaaatgctgaggtgaagagcgccatcaggaagctgtggaggaagaaggtgaccagtgacaatgactag

SEQ ID NO: 36424 - DNA, 930 bp, Artificial Sequence
  Description of Artificial Sequence: Synthetic coding sequence
atggccaacagaaacaacgtgacagagttcatcctgctgggcctgacagagaaccccaagatgcagaagatcatctttgtggtgttcagcgtcatctacatcaatgccatgattggaaatgtgctgattgtggtgaccatcacagccagccccagcctgcggagccccatgtacttcttcctggcctacctgtccttcattgatgcctgctacagctctgtgaacacccccaagctgatcacagacagcctgtatgagaacaagaccatcctcttcaacggctgcatgacccaggtgtttggagagcacttcttccggggcgtggaggtgatcctgctgactgtgatggcctatgaccactacgtggccatctgcaagcccctgcactacaccaccgtgatgaagcagcacgtgtgcagcctgctggtgggcgtgtcctgggtgggcggcttcctgcacgccaccatccagatcctcttcatctgccagctgcccttctgtggccccaacgtcatcgaccacttcatgtgtgacctgtacaccctcatcaacctggcctgcaccaacacccacaccctgggcctcttcatcgccgccaacagcggcttcatctgcctgctgaactgcctgctgctgctggtgtcctgtgtggtgatcctgtacagcctgaagacccacagcctggaggcccggcatgaggccctgagcacctgtgtgagccacatcaccgtggtgatcctgtccttcatcccctgcatctttgtgtacatgaggcccccagccaccctgcccatcgacaaggctgtggccgtgttctacaccatgatcacctccatgctgaaccccctcatctacaccctgagaaatgcccagatgaagaatgccatcaggaagctgtgcagcaggaaggccatcagctctgtgaagtag

SEQ ID NO: 36425 - DNA, 1113 bp, Artificial Sequence
  Description of Artificial Sequence: Synthetic coding sequence
atgttctccatgaccacagaggccctgaacaactttgccctgggctgcaccaacctgctgatgaccatgatcccccagattgacctgaagcagatcttcctgtgccccaactgccgcctgtacatgatccctgtgggcgccttcatcttcagcctgggcaacatgcagaaccagagctttgtgacagaatttgtgctgctgggcctgagccagaaccccaacgtgcaggagatcgtgtttgtggtgttcctgtttgtgtacatcgccaccgtgggcggcaacatgctgattgtggtgaccatcctgagcagccctgccctgctggtgagccccatgtacttcttcctgggcttcctgtccttcctggatgcctgcttcagcagcgtcatcacccccaagatgattgtggacagcctgtatgtgaccaagaccatcagctttgagggctgcatgatgcagctgtttgctgagcacttctttgctggggtggaggtgattgtgctgacagccatggcctatgaccgctacgtggccatctgcaagcccctgcactacagcagcatcatgaacagaaggctgtgtggcatcctgatgggcgtggcctggacaggaggcctgctgcacagcatgatccagatcctcttcaccttccagctgcccttctgtggccccaacgtcatcaaccacttcatgtgtgacctgtaccccctgctggagctggcctgcacagacacccacatcttcggcctgatggtggtgatcaacagcggcttcatctgcatcatcaacttcagcctgctgctggtgtcctatgctgtgatcctgctgagcctgcggacccacagcagcgagggccgctggaaggccctgagcacctgtggcagccacatcgctgtggtgatcctcttctttgtgccctgcatctttgtgtacacccggccccccagcgccttcagcctggacaagatggccgccatcttctacatcatcctgaaccccctgctgaaccccctcatctacaccttcaggaacaaggaggtgaagcaggccatgaggcgcatctggaaccggctgatggtggtgtctgatgagaaggagaacatcaagctgtag

SEQ ID NO: 36426 - DNA, 933 bp, Artificial Sequence
  Description of Artificial Sequence: Synthetic coding sequence
atgcagctgaacaacaacgtgacagagttcatcctgctgggcctgacccaggaccccttctggaagaagatcgtgtttgtgatcttcctgcggctgtacctgggcaccctgctgggcaacctgctgatcatcatctctgtgaagaccagccaggccctgaagaaccccatgttcttcttcctgttctacctgagcctgagtgacacctgcctgagcaccagcatcacccccaggatgattgtggatgccctgctgaagaagaccaccatctccttcagcgagtgcatgatccaggtgttcagcagccacgtgtttggctgcctggagatcttcatcctgatcctgacagctgtggacagatatgtggacatctgcaagcccctgcactacatgaccatcatcagccagtgggtgtgtggggtgctgatggctgtggcctgggtgggcagctgtgtgcacagcctggtgcagatcttcctggccctgagcctgcccttctgtggccccaacgtcatcaaccactgcttctgtgacctgcagcccctgctgaagcaggcctgcagcgagacctacgtggtgaacctgctgctggtgagcaacagcggggccatctgtgctgtgtcctatgtgatgctgatcttctcctatgtgatcttcctgcacagcctgaggaaccacagcgctgaggtgatcaagaaggccctgagcacctgtgtgagccacatcatcgtggtgatcctcttcttcggcccctgcatcttcatgtacacctgcctggccaccgtcttccccatggacaagatgattgctgtgttctacacagtgggcaccagcttcctgaaccctgtgatctacaccctgaagaacacagaggtgaagagcgccatgaggaagctgtggagcaagaagctgatcacagatgacaagaggtag

SEQ ID NO: 36427 - DNA, 990 bp, Artificial Sequence
  Description of Artificial Sequence: Synthetic coding sequence
atgcagctggtgctgctgctgatgttcctgctggtgttcatcggcaacacagccccagccttctctgtgaccctggagagcatggacatcccccagaacatcacagagttcttcatgctgggcctgagccagaacagcgaggtgcagagggtgctgtttgtggtgttcctgctgatctacgtggtgacagtgtgtggcaacatgctgattgtggtgaccatcaccagcagccccaccctggccagccctgtgtacttcttcctggccaacctgtccttcatcgacaccttctacagcagctccatggcccccaagctgattgctgacagcctgtatgagggccgcaccatctcctatgagtgctgcatggcccagctgtttggagcccacttcctgggcggcgtggagatcatcctgctgactgtgatggcctatgaccgctacgtggccatctgcaagcccctgcacaacaccaccatcatgaccaggcacctgtgtgccatgctggtgggcgtggcctggctgggcggcttcctgcacagcctggtgcagctgctgctggtgctgtggctgcccttctgtggccccaacgtcatcaaccactttgcctgtgacctgtaccccctgctggaggtggcctgcaccaacacctacgtgattggcctgctggtggtggccaacagcggcctcatctgcctgctgaacttcctgatgctggccgccagctacatcgtcatcctgtacagcctgcggagccacagcgcagatggccgctgcaaggccctgagcacctgtggggcccacttcatcgtggtggccctcttctttgtgccctgcatcttcacctacgtgcaccccttcagcaccctgcccatcgacaagaacatggccctcttctacggcatcctgacccccatgctgaaccccctcatctacaccctgagaaatgaggaggtgaagaatgccatgaggaagctgttcacctggtag

SEQ ID NO: 36428 - DNA, 603 bp, Artificial Sequence
  Description of Artificial Sequence: Synthetic coding sequence
atcctgctgactgtgatggcctatgacagatatgtggccatctgcaagcccctgcacaacaccaccatcatgaccaggcacctgtgtgccatgctggtgggcgtggcctggctgggcggcttcctgcacagcctggtgcagctgctgctggtgctgtggctgcccttctgtggccccaacgtcatcaaccactttgcctgtgacctgtaccccctgctggaggtggcctgcaccaacacctacgtgattggcctgctggtggtggccaacagcggcctcatctgcctgctgaacttcctgatgctggccgccagctacatcgtcatcctgtacagcctgcggagccacagcgcagatggccgctgcaaggccctgagcacctgtggggcccacttcatcgtggtggccctcttctttgtgccctgcatcttcacctacgtgcaccccttcagcaccctgcccatcgacaagaacatggccctcttctacggcatcctgacccccatgctgaaccccctcatctacaccctgagaaatgaggaggtgaagaacaacaccatcaagcacttctggaagcacatcctggaggaggacaagacctag

SEQ ID NO: 36429 - DNA, 981 bp, Artificial Sequence
  Description of Artificial Sequence: Synthetic coding sequence
atgtatgtgagcaactgcaacccctgtgccatccacaggaagatcaactaccccaacaccaagctggactttgagcaggtgaacaacatcacagagttcatcctgctgggcctgacccagaatgctgaggcccagaagctgctgtttgctgtgttcaccctcatctacttcctgaccatggtggacaacctgatcatcgtggtgaccatcaccaccagccctgccctggacagccctgtgtacttcttcctgtccttcttctccttcattgatggctgcagcagcagcaccatggcccccaagatgatctttgacctgctgacagagaagaagaccatctccttcagcggctgcatgacccagctgtttgtggagcacttcttcggcggcgtggagatcatcctgctggtggtgatggcctatgactgctacgtggccatctgcaagcccctgtactacctgatcaccatgaaccggcaggtgtgtggcctgctggtggccatggcctgggtgggcggcttcctgcacgccctgatccagatgctgctgattgtgtggctgcccttctgtggccccaacgtgattgaccacttcatctgtgacctcttccccctgctgaagctgagctgcacagacacccacgtgtttggcctgtttgtggccgccaacagcggcctgatgtgcatgctgatcttcagcatcctgatcaccagctatgtgctgatcctgtgcagccagaggaaggccctgagcacctgtgccttccacatcaccgtggtggtgctcttctttgtgccctgcatcctggtgtacctgcggcccatgatcaccttccccatcgacaaggctgtgtctgtgttctacacagtggtgacccccatgctgaaccccctcatctacaccctgaggaacacagaggtgaagaatgccatgaagcagctgtggagccagatcatctggggcaacaacctgtgtgactag

SEQ ID NO: 36430 - DNA, 930 bp, Artificial Sequence
  Description of Artificial Sequence: Synthetic coding sequence
atggagaaccagaacaacgtgacagagttcatcctgctgggcctgacagagaacctggagctgtggaagatcttctctgctgtgttcctggtgatgtatgtggccaccgtgctggagaacctgctgattgtggtgaccatcatcaccagccagagcctgcggagccccatgtacttcttcctgaccttcctgagcctgctggatgtgatgttcagctctgtggtggcccccaaggtgattgtggacaccctgagcaagagcaccaccatcagcctgaagggctgcctgacccagctgtttgtggagcacttctttggaggagtgggcatcatcctgctgactgtgatggcctatgacagatatgtggccatctgcaagcccctgcactacaccatcatcatgagcccccgggtgtgctgcctgatggtgggcggggcctgggtgggcggcttcatgcacgccatgatccagctgctcttcatgtaccagatccccttctgtggccccaacatcatcgaccacttcatctgtgacctcttccagctgctgaccctggcctgcacagacacccacatcctgggcctgctggtgaccctgaacagcggcatgatgtgtgtggccatcttcctgatcctgattgccagctacaccgtcatcctgtgcagcctgaagagctacagcagcaagggccgccacaaggccctgagcacctgcagcagccacctgactgtggtggtgctcttctttgtgccctgcatcttcctgtacatgaggcctgtggtgacccaccccatcgacaaggccatggctgtgtctgacagcatcatcacccccatgctgaaccccctcatctacaccctgagaaatgctgaggtgaagagcgccatgaagaagctgtggatgaagtgggaggccctggccggcaagtag

SEQ ID NO: 36431 - DNA, 933 bp, Artificial Sequence
  Description of Artificial Sequence: Synthetic coding sequence
atggagccccagaacaccacccaggtgtccatgtttgtgctgctgggcttcagccagacccaggagctgcagaagttcctgttcctgctcttcctgctggtgtatgtgaccaccatcgtgggcaacctgctgatcatggtgacagtgacctttgactgccgcctgcacacccccatgtacttcctgctgaggaacctggccctgattgacctgtgctacagcacagtgaccagccccaagatgctggtggacttcctgcacgagaccaagaccatctcctaccagggctgcatggcccagatcttcttcttccacctgctgggcggcggcaccgtcttcttcctgtctgtgatggcctatgaccgctacatcgccatcagccagcccctgcgctacgtgaccatcatgaacacccagctgtgtgtgggcctggtggtggccgcctgggtgggcggctttgtgcacagcatcgtgcagctggccctgatcctgcccctgcccttctgtggccccaacatcctggacaacttctactgtgatgtgccccaggtgctgcggctggcctgcacagacaccagcctgctggagttcctgatgatcagcaacagcggcctgctggtgatcatctggttcctgctgctgctgatctcctacaccgtcatcctggtgatgctgcggagccacagcggcaaggcccggaggaaggccgccagcacctgcaccacccacatcatcgtggtgtccatgatcttcatcccctgcatctacatctacacctggcccttcacccccttcctgatggacaaggctgtgtccatctcctacacagtgatgacccccatgctgaaccccatgatctacaccctgaggaaccaggacatgaaggccgccatgaggcggctgggcaagtgcctggtgatctgccgggagtag

SEQ ID NO: 36432 - DNA, 936 bp, Artificial Sequence
  Description of Artificial Sequence: Synthetic coding sequence
atggagatggagaactgcaccagggtgaaggagttcatcttcctgggcctgacccagaaccgggaggtgtccctggtgctcttcctgttcctgctgctggtgtatgtgaccaccctgctgggcaacctgctgatcatggtgacagtgacctgtgagagccggctgcacacccccatgtacttcctgctgcacaacctgagcattgctgacatctgcttcagcagcatcaccgtgcccaaggtgctggtggacctgctgtctgagaggaagaccatctccttcaaccactgcttcacccagatgttcctgttccacctgattggaggagtggatgtgttcagcctgtctgtgatggccctggacagatatgtggccatcagcaagcccctgcactacgccaccatcatgagccgggaccactgcatcggcctgactgtggccgcctggctgggcggctttgtgcacagcatcgtgcagatcagcctgctgctgcccctgcccttctgtggccccaacgtgctggacaccttctactgtgatgtgcaccgggtgctgaagctggcccacacagacatcttcatcctggagctgctgatgatcagcaacaacggcctgctgaccaccctgtggttcttcctgctgctggtgtcctacatcgtcatcctgagcctgcccaagagccaggccggggagggccgcaggaaggccatcagcacctgcaccagccacatcaccgtggtgaccctgcactttgtgccctgcatctacgtgtatgcccggcccttcaccgccctgcccatggacaaggccatctctgtgaccttcaccgtcatcagccccctgctgaaccccctcatctacaccctgaggaaccacgagatgaagagcgccatgaggcggctgaagaggcggctggtgcccagcgacaggaagtag

SEQ ID NO: 36433 - DNA, 936 bp, Artificial Sequence
  Description of Artificial Sequence: Synthetic coding sequence
atggagctgggcaatgtgaccagggtgaaggagttcatcttcctgggcctgacccagagccaggaccagagcctggtgctcttcctgttcctgtgcctggtgtacatgaccaccctgctgggcaacctgctgatcatggtgacagtgacctgtgagagccggctgcacacccccatgtacttcctgctgaggaacctggccatcctggacatctgcttcagcagcaccacagcccccaaggtgctgctggacctgctgagcaagaagaagaccatctcctacaccagctgcatgacccagatcttcctgttccacctgctgggcggcgctgacatcttcagcctgtctgtgatggcctttgactgctacatggccatcagcaagcccctgcactacgtgaccatcatgagccggggccagtgcacagccctgatcagcgcctcctggatgggcggctttgtgcacagcatcgtgcagatcagcctgctgctgcccctgcccttctgtggccccaacgtgctggacaccttctactgtgatgtgccccaggtgctgaagctgacctgcacagacacctttgccctggagttcctgatgatcagcaacaacggcctggtgaccaccctgtggttcatcttcctgctggtgtcctacaccgtcatcctgatgaccctgcggagccaggccggcggcggccgcaggaaggccatcagcacctgcaccagccacatcaccgtggtgaccctgcactttgtgccctgcatctacgtgtatgcccggcccttcaccgccctgcccacagagaaggccatctctgtgaccttcaccgtcatcagccccctgctgaaccccctcatctacaccctgaggaaccaggagatgaagagcgccatgaggcggctgaagaggcggctggtgcccagcgagcgggagtag

SEQ ID NO: 36434 - DNA, 924 bp, Artificial Sequence
  Description of Artificial Sequence: Synthetic coding sequence
atggagactggaaacctgacctgggtgtctgactttgtgttcctgggcctgagccagacccgggagctgcagcgcttcctgttcctgatgttcctgtttgtgtacatcaccaccgtgatgggcaacatcctgatcatcatcaccgtgaccagtgacagccagctgcacacccccatgtacttcctgctgaggaacctggccgtgctggacctgtgcttcagctctgtgacagcccccaagatgctggtggacctgctgtctgagaagaagaccatctcctaccagggctgcatgggccagatcttcttcttccacttcctgggcggggccatggtgttcttcctgtctgtgatggcctttgacaggctcatcgccatcagccggcccctgcgctacgtgacagtgatgaacacccagctgtgggtgggcctggtggtggccacctgggtgggcggctttgtgcacagcatcgtgcagctggccctgatgctgcccctgcccttctgtggccccaacatcctggacaacttctactgtgatgtgccccaggtgctgcggctggcctgcacagacaccagcctgctggagttcctgaagatcagcaacagcggcctgctggatgtggtgtggttcttcctgctgctgatgagctacctgttcatcctggtgatgctgcggagccaccctggagaggcccggaggaaggccgccagcacctgcaccacccacatcatcgtggtgtccatgatctttgtgcccagcatctacctgtatgcccggcccttcacccccttccccatggacaagctggtgtccatcggccacacagtgatgacccccatgctgaaccccatgatctacaccctgaggaaccaggacatgcaggccgctgtgcggcggctgggccgccaccggctggtgtag

SEQ ID NO: 36435 - DNA, 957 bp, Artificial Sequence
  Description of Artificial Sequence: Synthetic coding sequence
atgaacccagccaaccacagccaggtggccggctttgtgctgctgggcctgagccaggtgtgggagctgcgctttgtgttcttcaccgtcttctctgctgtgtacttcatgacagtggtgggcaacctgctgattgtggtgattgtgaccagtgacccccacctgcacaccaccatgtacttcctgctgggcaacctgtccttcctggacttctgctacagcagcatcacagcccccaggatgctggtggacctgctgagcggcaaccccaccatcagctttggaggctgcctgacccagctgttcttcttccacttcatcggcggcatcaagatcttcctgctgactgtgatggcctatgaccgctacatcgccatcagccagcccctgcactacaccctcatcatgaaccagacagtgtgtgccctgctgatggccgcctcctgggtgggcggcttcatccacagcatcgtgcagatcgccctgaccatccagctgcccttctgtggccctgacaagctggacaacttctactgtgatgtgccccagctgatcaagctggcctgcacagacacctttgtgctggagctgctgatggtgagcaacaacggcctggtgaccctgatgtgcttcctggtgctgctgggcagctacacagccctgctggtgatgctgcggagccacagccgggagggccgcagcaaggccctgagcacctgtgccagccacatcgctgtggtgaccctcatctttgtgccctgcatctacgtgtacacccggcccttccgcaccttccccatggacaaggctgtgtctgtgctgtacaccatcgtgacccccatgctgaacccagccatctacaccctgaggaacaaggaggtgatcatggccatgaagaagctgtggaggaggaagaaggaccccatcggccccctggagcaccggcccctgcactag

SEQ ID NO: 36436 - DNA, 945 bp, Artificial Sequence
  Description of Artificial Sequence: Synthetic coding sequence
atggaccagatcaaccacaccaacgtgaaggagttcttcttcctggagctgaccaggagccgggagctggagttcttcctgtttgtggtgttctttgctgtgtatgtggccaccgtgctgggcaatgccctgattgtggtgaccatcacctgtgagagccggctgcacacccccatgtacttcctgctgaggaacaagtctgtgctggacatcgtgttcagcagcatcaccgtgcccaagttcctggtggacctgctgagtgacaggaagaccatctcctacaatgactgcatggcccagatcttcttcttccactttgctggaggagctgacatcttcttcctgtctgtgatggcctatgaccgctacctggccatcgccaagcccctgcactacgtgaccatgatgaggaaggaggtgtgggtggccctggtggtggcctcctgggtgtctgggggcctgcacagcatcatccaggtgatcctgatgctgcccttccccttctgtggccccaacaccctggatgccttctactgctacgtgctgcaggtggtgaagctggcctgcacagacacctttgccctggagctgttcatgatcagcaacaacggcctggtgaccctgctgtggttcctgctgctgctgggcagctacaccgtcatcctggtgatgctgcggagccacagcggggagggcaggaacaaggccctgagcacctgcaccagccacatgctggtggtgaccctgcactttgtgccctgtgtgtacatctactgccggcccttcatgaccctgcccatggacaccaccatcagcatcaacaacacagtcatcacccccatgctgaaccccatcatctacagcctgaggaaccaggagatgaagagcgccatgcagaggctgcagaggcggctgggccccagcgagagcaggaagtggggctag

SEQ ID NO: 36437 - DNA, 945 bp, Artificial Sequence
  Description of Artificial Sequence: Synthetic coding sequence
atggaccagaggaactacaccagggtgaaggagttcaccttcctgggcatcacccagagccgggagctgagccaggtgctcttcaccttcctgttcctggtgtacatgaccaccctgatgggcaacttcctgatcatggtgacagtgacctgtgagagccacctgcacacccccatgtacttcctgctgaggaacctgagcatcctggacatctgcttcagcagcatcacagcccccaaggtgctgattgacctgctgtctgagaccaagaccatctccttcagcggctgtgtgacccagatgttcttcttccacctgctgggcggcgcagatgtgttcagcctgtctgtgatggcctttgaccgctacatcgccatcagcaagcccctgcactacatgaccatcatgagccggggccgctgcaccggcctgattgtggcctcctgggtgggcggctttgtgcacagcatcgcccagatcagcctgctgctgcccctgcccttctgtggccccaacgtgctggacaccttctactgtgatgtgccccaggtgctgaagctggcctgcacagacaccttcaccctggagctgctgatgatcagcaacaacggcctggtgtcctggtttgtgttcttcttcctgctgatctcctacaccgtcatcctgatgatgctgcggagccacactggagagggccgcaggaaggccatcagcacctgcaccagccacatcaccgtggtgaccctgcactttgtgccctgcatctacgtgtatgcccggcccttcaccgccctgcccacagacacagccatctctgtgaccttcaccgtcatcagccccctgctgaaccccatcatctacaccctgaggaaccaggagatgaagctggccatgaggaagctgaagaggcggctgggccagagcgagcgcatcctgatccagtag

SEQ ID NO: 36438 - DNA, 942 bp, Artificial Sequence
  Description of Artificial Sequence: Synthetic coding sequence
atggacagcctgaaccagaccagggtgacagaatttgtgttcctgggcctgacagacaacagagtgctggagatgctgttcttcatggccttcagcgccatctacatgctgaccctgagcggcaacatcctgatcatcatcgccaccgtcttcacccccagcctgcacacccccatgtacttcttcctgagcaacctgtccttcatcgacatctgccacagctctgtgacagtgcccaagatgctggagggcctgctgctggagaggaagaccatcagctttgacaactgcatcacccagctgttcttcctgcacctgtttgcctgtgccgagatcttcctgctgatcatcgtggcctatgacagatatgtggccatctgcacccccctgcactaccccaacgtgatgaacatgagggtgtgcatccagctggtgtttgccctgtggctgggcggcaccgtgcacagcctgggccagaccttcctgaccatccggctgccctactgcggccccaacatcatcgacagctacttctgtgatgtgcccctggtgatcaagctggcctgcacagacacctacctgaccggcatcctgattgtgaccaacagcggcaccatcagcctgagctgcttcctggccgtggtgaccagctacatggtgatcctggtgtccctgaggaagcacagcgctgagggccggcagaaggccctgagcacctgcagcgcccacttcatggtggtggccctcttcttcggcccctgcatcttcatctacaccaggccagacaccagcttcagcattgacaaggtggtgtctgtgttctacacagtggtgacccccctgctgaaccccttcatctacaccctgagaaatgaggaggtgaagagcgccatgaagcagctgcggcagaggcaggtgttcttcaccaagagctacacctag

SEQ ID NO: 36439 - DNA, 939 bp, Artificial Sequence
  Description of Artificial Sequence: Synthetic coding sequence
atgaatggcatgaaccacagcgtggtgtctgaatttgtgttcatgggcctgaccaacagccgggagatccagctgctgctgtttgtgttcagcctgctcttctactttgcctccatgatgggcaacctggtgattgtgttcaccgtgaccatggatgcccacctgcacagccccatgtacttcctgctggccaacctgagcatcatcgacatggccttctgcagcatcacagcccccaagatgatctgtgacatcttcaagaagcacaaggccatctccttccggggctgcatcacccagatcttcttcagccacgccctgggcggcacagagatggtgctgctgattgccatggcctttgaccgctacatggccatctgcaagcccctgcactacctgaccatcatgagccccaggatgtgcctgtacttcctggccaccagcagcatcatcggcctcatccacagcctggtgcagctggtgtttgtggtggacctgcccttctgtggccccaacatctttgacagcttctactgtgacctgccccggctgctgcggctggcctgcaccaacacccaggagctggagttcatggtgacagtgaacagcggcctcatctctgtgggcagctttgtgctgctggtgatctcctacatcttcatcctcttcaccgtgtggaagcacagcagcggcggcctggccaaggccctgagcaccctgagcgcccacgtgacagtggtgatcctcttcttcggccccctgatgttcttctacacctggcccagccccaccagccacctggacaagtacctggccatctttgatgccttcatcacccccttcctgaaccctgtgatctacaccttcaggaacaaggacatgaaggtggccatgaggcggctgtgcagccggctggcccacttcaccaagatcctgtag

SEQ ID NO: 36440 - DNA, 939 bp, Artificial Sequence
  Description of Artificial Sequence: Synthetic coding sequence
atggatggagagaaccacagcgtggtgtctgagttcctgttcctgggcctgacccacagctgggagatccagctgctgctgctggtgttcagctctgtgctgtatgtggccagcatcaccggcaacatcctgattgtgttttctgtgaccacagacccccacctgcacagccccatgtacttcctgctggccagcctgtccttcatcgacctgggcgcctgcagcgtgaccagccccaagatgatctatgacctcttcaggaagaggaaggtgatcagctttggaggctgcatcgcccagatcttcttcatccacgtggtgggcggcgtggagatggtgctgctgattgccatggcctttgacagatatgtggccctgtgcaagcccctgcactacctgaccatcatgagccccaggatgtgcctgtccttcctggccgtggcctggaccctgggcgtgagccacagcctcttccagctggccttcctggtgaacctggccttctgtggccccaacgtgctggacagcttctactgtgacctgccccggctgctgcggctggcctgcacagacacctaccgcctgcagttcatggtgacagtgaacagcggcttcatctgtgtgggcaccttcttcatcctgctgatctcctatgtgttcatcctcttcaccgtgtggaagcacagcagcggcggcagcagcaaggccctgagcaccctgagcgcccacagcacagtggtgctgctcttctttggaccacccatgtttgtgtacacccggccccaccccaacagccagatggacaagttcctggccatctttgatgctgtgctgacccccttcctgaaccctgtggtgtacaccttcaggaacaaggagatgaaggccgccatcaagagggtgtgcaagcagctggtgatctacaagaggatctcctag

SEQ ID NO: 36441 - DNA, 918 bp, Artificial Sequence
  Description of Artificial Sequence: Synthetic coding sequence
atggtgacagagttcatcttcctgggcctgagtgacagccagggcctgcagaccttcctgttcatgctgttctttgtgttctacggcggcatcgtgtttggaaacctgctgattgtcatcaccgtggtgtctgacagccacctgcacagccccatgtacttcctgctggccaacctgagcctgattgacctgagcctgagctctgtgacagcccccaagatgatcacagacttcttcagccagaggaaggtgatctccttcaagggctgcctggtgcagatcttcctgctgcacttcttcggcggcagcgagatggtgatcctgattgccatgggctttgaccgctacatcgccatctgcaagcccctgcactacaccaccatcatgtgtggaaatgcctgtgtgggcatcatggctgtggcctggggcatcggcttcctgcacagcgtgtcccagctggcctttgctgtgcacctgcccttctgtggccccaatgaggtggacagcttctactgtgacctgcccagggtcatcaagctggcctgcacagacacctaccgcctggacatcatggtgattgccaacagcggcgtgctgactgtgtgcagctttgtgctgctgatcatctcctacaccatcatcctgatgaccatccagcaccggcccctggacaagagcagcaaggccctgagcaccctgacagcccacatcaccgtggtgctgctcttcttcggcccctgtgtgttcatctatgcctggcccttccccatcaagagcctggacaagttcctggccgtgttctacagcgtcatcacccccctgctgaaccccatcatctacaccctgaggaacaaggacatgaagacagccatccggcagctgaggaagtgggatgcccacagctctgtgaagttctag

SEQ ID NO: 36442 - DNA, 885 bp, Artificial Sequence
  Description of Artificial Sequence: Synthetic coding sequence
agccctggccctgtgttctcctaccccccacccagcctgctcttcatcatccctgtgaagctgggcctggagcacttcttccacatcaaggtgacagctgaggccatctcctggaatgaaagcaccagcgagaccaacaacagcatggtgacagagttcatcttcctgggcctgagtgacagccagggcctgcagaccttcctgttcatgctgttctttgtgttctacggcggcatcgtgtttggaaacctgctgattgtcatcaccgtggtgtctgacagccacctgcacagccccatgtacttcctgctggccaacctgagcctgattgacctgagcctgagctctgtgacagcccccaagatgatcacagacttcttcagccagaggaaggtgatctccttcaagggctgcctggtgcagatcttcctgctgcacttcttcggcggcagcgagatggtgatcctgattgccatgggctttgaccgctacatcgccatctgcaagcccctgcactacaccaccatcatgtgtggaaatgcctgtgtgggcatcatggctgtggcctggggcatcggcttcctgcacagcgtgtcccagctggcctttgctgtgcacctgcccttctgtggccccaatgaggtggacagcttctactgtgacctgcccagggtcatcaagctggcctgcacagacacctaccgcctggacatcatggtgattgccaacagcggcgtgctgactgtgtgcagctttgtgctgctgatcatctcctacaccatcatcctgatgaccatccagcaccggcccctggacaagagcagcaaggccctgagcaccctgacagcccacatcaccgtggtgctgctcttcttcggcccctag

SEQ ID NO: 36443 - DNA, 939 bp, Artificial Sequence
  Description of Artificial Sequence: Synthetic coding sequence
atggatggagagaaccacagcgtggtgtctgagttcctgttcctgggcctgacccacagctgggagatccagctgctgctgctggtgttcagctctgtgctgtatgtggccagcatcaccggcaacatcttcatcgtgttttctgtgaccacagacccccacctgcacagccccatgtacttcctgctggccagcctgtccttcatcgacctgggcgcctgcagcgtgaccagccccaagatgatctatgacctcttcaggaagaggaaggtgatcagctttggaggctgcatcgcccagatcttcttcatccacgtgattggaggagtggagatggtgctgctgattgccatggcctttgacagatatgtggccctgtgcaagcccctgcactacctgaccatcatgagccccaggatgtgcctgtccttcctggccgtggcctggaccctgggcgtgagccacagcctcttccagctggccttcctggtgaacctggccttctgtggccccaacgtgctggacagcttctactgtgacctgccccggctgctgcggctggcctgcacagacacctaccgcctgcagttcatggtgacagtgaacagcggcttcatctgtgtgggcaccttcttcatcctgctgatctcctatgtgttcatcctcttcaccgtgtggaagcacagcagcggcggcagcagcaaggccctgagcaccctgagcgcccacagcacagtggtgctgctcttctttggaccacccatgtttgtgtacacccggccccaccccaacagccagatggacaagttcctggccatctttgatgctgtgctgacccccttcctgaaccctgtggtgtacaccttcaggaacaaggagatgaaggccgccatcaagagggtgtgcaagcagctggtgatctacaagaagatctcctag

SEQ ID NO: 36444 - DNA, 939 bp, Artificial Sequence; identical to SEQ ID NO: 36440
  Description of Artificial Sequence: Synthetic coding sequence

SEQ ID NO: 36445 - DNA, 939 bp, Artificial Sequence; identical to SEQ ID NO: 36440
  Description of Artificial Sequence: Synthetic coding sequence

SEQ ID NO: 36446 - DNA, 918 bp, Artificial Sequence
  Description of Artificial Sequence: Synthetic coding sequence
atggtgacagagttcatcttcctgggcctgagtgacagccaggagctgcagaccttcctgttcatgctgttctttgtgttctacggcggcatcgtgtttggaaacctgctgattgtcatcaccgtggtgtctgacagccacctgcacagccccatgtacttcctgctggccaacctgagcctgattgacctgagcctgagctctgtgacagcccccaagatgatcacagacttcttcagccagaggaaggtgatctccttcaagggctgcctggtgcagatcttcctgctgcacttcttcggcggcagcgagatggtgatcctgattgccatgggctttgaccgctacatcgccatctgcaagcccctgcactacaccaccatcatgtgtggaaatgcctgtgtgggcatcatggctgtggcctggggcatcggcttcctgcacagcgtgtcccagctggcctttgctgtgcacctgcccttctgtggccccaatgaggtggacagcttctactgtgacctgcccagggtcatcaagctggcctgcacagacacctaccgcctggacatcatggtgattgccaacagcggcgtgctgactgtgtgcagctttgtgctgctgatcatctcctacaccatcatcctgatgaccatccagcactgccccctggacaagagcagcaaggccctgagcaccctgacagcccacatcaccgtggtgctgctcttcttcggcccctgtgtgttcatctatgcctggcccttccccatcaagagcctggacaagttcctggccgtgttctacagcgtcatcacccccctgctgaaccccatcatctacaccctgaggaacaaggacatgaagacagccatccggcggctgaggaagtgggatgcccacagctctgtgaagttctag

SEQ ID NO: 36447 - DNA, 918 bp, Artificial Sequence
  Description of Artificial Sequence: Synthetic coding sequence
atggtgacagagttcatcttcctgggcctgagtgacagccaggagctgcagaccttcctgttcatgctgttctttgtgttctacggcggcatcgtgtttggaaacctgctgattgtcatcaccgtggtgtctgacagccacctgcacagccccatgtacttcctgctggccaacctgagcctgattgacctgagcctgagctctgtgacagcccccaagatgatcacagacttcttcagccagaggaaggtgatctccttcaagggctgcctggtgcagatcttcctgctgcacttcttcggcggcagcgagatggtgatcctgattgccatgggctttgaccgctacatcgccatctgcaagcccctgcactacaccaccatcatgtgtggaaatgcctgtgtgggcatcatggctgtgacctggggcatcggcttcctgcacagcgtgtcccagctggcctttgctgtgcacctgctcttctgtggccccaatgaggtggacagcttctactgtgacctgcccagggtcatcaagctggcctgcacagacacctaccgcctggacatcatggtgattgccaacagcggcgtgctgactgtgtgcagctttgtgctgctgatcatctcctacaccatcatcctgatgaccatccagcaccggcccctggacaagagcagcaaggccctgagcaccctgacagcccacatcaccgtggtgctgctcttcttcggcccctgtgtgttcatctatgcctggcccttccccatcaagagcctggacaagttcctggccgtgttctacagcgtcatcacccccctgctgaaccccatcatctacaccctgaggaacaaggacatgaagacagccatccggcagctgaggaagtgggatgcccacagctctgtgaagttctag

SEQ ID NO: 36448 - DNA, 939 bp, Artificial Sequence
  Description of Artificial Sequence: Synthetic coding sequence
atggatgaggccaaccacagcgtggtgtctgaatttgtgttcctgggcctgagtgacagcaggaagatccagctgctgctcttcctgttcttcagcgtcttctacgtgagcagcctgatgggcaacctgctgattgtgctgactgtgaccagtgacccccggctgcagagccccatgtacttcctgctggccaacctgagcatcatcaacctggtgttctgcagcagcacagcccccaagatgatctatgacctcttcaggaagcacaagaccatcagctttggaggctgtgtggtgcagatcttcttcatccatgctgtgggcggcacagagatggtgctgctgattgccatggcctttgacagatatgtggccatctgcaagcccctgcactacctgaccatcatgaacccccagcgctgcatcctcttcctggtgatctcctggatcatcggcatcatccacagcgtcatccagctggcctttgtggtggacctgctcttctgtggccccaatgagctggacagcttcttctgtgacctgccccgcttcatcaagctggcctgcatcgagacctacaccctgggcttcatggtgacagccaacagcggcttcatcagcctggccagcttcctgatcctgatcatctcctacatcttcatcctggtgacagtgcagaagaagagcagcggcggcatcttcaaggccttctccatgctgagcgcccacgtgattgtggtggtgctggtgtttggccccctcatcttcttctacatcttccccttccccaccagccacctggacaagttcctggccatctttgatgctgtgatcacccctgtgctgaaccctgtgatctacaccttcaggaacaaggagatgatggtggccatgagaagacgctgcagccagtttgtgaactacagcaagatcttctag

SEQ ID NO: 36449 - DNA, 936 bp, Artificial Sequence
  Description of Artificial Sequence: Synthetic coding sequence
atggcccacaccaatgaatccatggtgtctgaatttgtgctgctgggcctgagcaacagctggggcctgcagctgttcttctttgccatcttcagcatcgtgtatgtgacctctgtgctgggcaatgtgctgatcatcgtcatcatcagctttgacagccacctgaacagccccatgtacttcctgctgagcaacctgtccttcatcgacatctgccagagcaactttgccacccccaagatgctggtggacttcttcattgaaaggaagaccatcagctttgagggctgcatggcccagatctttgtgctgcacagctttgtgggcagcgagatgatgctgctggtggccatggcctatgaccgcttcatcgccatctgcaagcccctgcactacagcaccatcatgaacagaaggctgtgtgtgatctttgtgtccatctcctgggccgtgggcgtgctgcacagcgtgagccacctggccttcaccgtggacctgcccttctgtggccccaatgaggtggacagcttcttctgtgacctgcccctggtgattgagctggcctgcatggacacctatgagatggagatcatgaccctgaccaacagcggcctcatcagcctgagctgcttcctggccctgatcatctcctacaccatcatcctgattggagtgcgctgccgcagcagcagcggcagcagcaaggccctgagcaccctgacagcccacatcaccgtggtgatcctcttcttcggcccctgcatctacttctacatctggcccttcagccggctgcctgtggacaagttcctgagcgtcttctacacagtgtgcacccccctgctgaaccccatcatctacagcctgagaaatgaagatgtgaaggccgccatgtggaagctgaggaacagacatgtgaacagctggaagaactag

SEQ ID NO: 36450 - DNA, 915 bp, Artificial Sequence
  Description of Artificial Sequence: Synthetic coding sequence
atggagcgggccaaccacagcgtggtgtctgagttcatcctgctgggcctgagcaagagccagaacctgcagatcctcttcttcctgggcttctctgtggtgtttgtgggcatcgtgctgggcaacctgctgatcctggtgacagtgacctttgacagcctgctgcacacccccatgtacttcctgctgagcaacctgagctgcatcgacatgatcctggccagctttgccacccccaagatgattgtggacttcctgcgggagaggaagaccatctcctggtggggctgctacagccagatgttcttcatgcacctgctgggcggcagcgagatgatgctgctggtggccatggccatcgacagatatgtggccatctgcaagcccctgcactacatgaccatcatgagcccccgggtgctgaccggcctgctgctgagcagctatgctgtgggctttgtgcacagcagcagccagatggccttcatgctgaccctgcccttctgtggccccaacgtcatcgacagcttcttctgtgacctgcccctggtgatcaagctggcctgcaaggacacctacatcctgcagctgctggtgattgctgacagcggcctgctgagcctggtgtgcttcctgctgctgctggtgtcctatggagtcatcatcttctctgtgcgctacagagctgccagccgcagcagcaaggccttcagcaccctgagcgcccacatcaccgtggtgaccctcttctttgccccctgtgtgttcatctacgtgtggcccttcagccgctacagcgtggacaagatcctgagcgtcttctacaccatcttcacccccctgctgaaccccatcatctacaccctgaggaaccaggaggtgaaggccgccatcaagaagaggctgtgcatctag

SEQ ID NO: 36451 - DNA, 933 bp, Artificial Sequence
  Description of Artificial Sequence: Synthetic coding sequence
atggacccccagaactacagcctggtgtctgaatttgtgctgcacggcctgtgcaccagccgccacctgcagaacttcttcttcatcttcttcttcggcgtgtatgtggccatcatgctgggcaacctgctgatcctggtgaccgtcatcagtgacccctgcctgcacagcagccccatgtacttcctgctgggcaacctggccttcctggacatgtggctggccagctttgccacccccaagatgatccgggacttcctgagtgaccagaagctgatcagctttggaggctgcatggcccagatcttcttcctgcacttcaccggcggcgctgagatggtgctgctggtgtccatggcctatgaccgctacgtggccatctgcaagcccctgcactacatgaccctgatgtcctggcagacctgcatccggctggtgctggcctcctgggtggtgggctttgtgcacagcatcagccaggtggccttcaccgtgaacctgccctactgcggccccaatgaggtggacagcttcttctgtgacctgcccctggtgatcaagctggcctgcatggacacctacgtgctgggcatcatcatgatcagtgacagcggcctgctgagcctgagctgcttcctgctgctgctgatctcctacaccgtcatcctgctggccatccggcagagagctgctggcagcaccagcaaggccctgagcacctgcagcgcccacatcatggtggtgaccctcttcttcggcccctgcatctttgtgtatgtgcggcccttcagccgcttctctgtggacaagctgctgtctgtgttctacaccatcttcacccccctgctgaaccccatcatctacaccctgagaaatgaggagatgaaggccgccatgaagaagctgcagaacagaagagtgaccttccagtag

SEQ ID NO: 36452 - DNA, 1047 bp, Artificial Sequence
  Description of Artificial Sequence: Synthetic coding sequence
atgctgaccagcctgacagacctgtgcttcagccccatccaggtggccgagatcaagagcctgcccaagtccatgaatgagaccaaccacagccgggtgacagaatttgtgctgctgggcctgagcagcagccgggagctgcagcccttcctgttcctgaccttcagcctgctgtacctggccatcctgctgggcaacttcctgatcatcctgactgtgaccagtgacagccggctgcacacccccatgtacttcctgctggccaacctgtccttcattgatgtgtgtgtggccagctttgccacccccaagatgattgctgacttcctggtggagaggaagaccatcagctttgatgcctgcctggcccagatcttctttgtgcacctgttcaccggcagcgagatggtgctgctggtgtccatggcctatgacagatatgtggccatctgcaagcccctgcactacatgacagtgatgagccggcgggtgtgtgtggtgctggtgctgatctcctggtttgtgggcttcatccacaccaccagccagctggccttcaccgtgaacctgcccttctgtggccccaacaaggtggacagcttcttctgtgacctgcccctggtgaccaagctggcctgcatcgacacctacgtggtgtccctgctgattgtggccgacagcggcttcctgagcctgagcagcttcctgctgctggtggtgtcctacaccgtcatcctggtgacagtgaggaacagaagcagcgcctccatggccaaggcccggagcaccctgacagcccacatcaccgtggtgaccctcttcttcggcccctgcatcttcatctacgtgtggcccttcagcagctacagcgtggacaaggtgctggccgtgttctacaccatcttcaccctcatcctgaaccctgtgatctacaccctgaggaacaaggaggtgaaggccgccatgagcaagctgaagagccgctacctgaagcccagccaggtgtctgtggtgatcagaaatgtgctcttcctggagaccaagtag

SEQ ID NO: 36453 - DNA, 1032 bp, Artificial Sequence
  Description of Artificial Sequence: Synthetic coding sequence
atggccctgtacttcagcctcatcctgcacggcatgtctgacctcttcttcctgagcacaggccacccccgggccagctgcaggatggaggccatgaagctgctgaaccagagccaggtgtctgagttcatcctgctgggcctgaccagcagccaggatgtggagttcctgctgtttgccctcttcagcgtcatctacgtggtgacagtgctgggcaacctgctgatcatcgtgacagtgttcaacacccccaacctgaacacccccatgtacttcctgctgggcaacctgagctttgtggacatgaccctggccagctttgccacccccaaggtgatcctgaacctgctgaagaagcagaaggtgatcagctttgctggctgcttcacccagatcttcctgctgcacctgctgggcggcgtggagatggtgctgctggtgtccatggcctttgaccgctacgtggccatctgcaagcccctgcactacatgaccatcatgaacaagaaggtgtgtgtgctgctggtggtgacctcctggctgctgggcctgctgcacagcggcttccagatcccctttgctgtgaacctgcccttctgtggccccaacgtggtggacagcatcttctgtgacctgcccctggtgaccaagctggcctgcatcgacatctactttgtgcaggtggtgattgtggccaacagcggcatcatcagcctgagctgcttcatcatcctgctgatctcctacagcctcatcctgatcaccatcaagaaccacagccccaccggccagagcaaggcccggagcaccctgacagcccacatcaccgtggtgatcctcttcttcggcccctgcatcttcatctacatctggccctttggaaaccacagcgtggacaagttcctggccgtgttctacaccatcatcacccccatcctgaaccccatcatctacaccctgaggaacaaggagatgaagatctccatgaagaagctgtggagggcctttgtgaacagccgggaggacacctag

SEQ ID NO: 36454 - DNA, 945 bp, Artificial Sequence
  Description of Artificial Sequence: Synthetic coding sequence
atggatgtgggcaacaagagcaccatgtctgaatttgtgctgctgggcctgagcaacagctgggagctgcagatgttcttcttcatggtgttcagcctgctgtatgtggccaccatggtgggcaacagcctgattgtcatcaccgtcatcgtggacccccacctgcacagccccatgtacttcctgctgaccaacctgagcatcatcgacatgagcctggccagctttgccacccccaagatgatcacagactacctgaccggccacaagaccatcagctttgatggctgcctgacccagatcttcttcctgcacctgttcaccggcacagagatcatcctgctgatggccatgagctttgaccgctacatcgccatctgcaagcccctgcactacgccagcgtcatcagcccccaggtgtgtgtggccctggtggtggcctcctggatcatgggcgtgatgcacagcatgagccaggtgatctttgccctgaccctgcccttctgtggcccctatgaggtggacagcttcttctgtgacctgcctgtggtgttccagctggcctgtgtggacacctacgtgctgggcctcttcatgatcagcaccagcggcatcatcgccctgagctgcttcatcgtgctcttcaacagctatgtgattgtgctggtgacagtgaagcaccacagcagccggggcagcagcaaggccctgagcacctgcacagcccacttcatcgtggtgttcctgttcttcggcccctgcatcttcatctacatgtggcccctgagcagcttcctgacagacaagatcctgagcgtcttctacaccatcttcacccccaccctgaaccccatcatctacaccctgaggaaccaggaggtgaagatcgccatgaggaagctgaagaaccgcttcctgaacttcaacaaggccatgcccagctag

SEQ ID NO: 36455 - DNA, 972 bp, Artificial Sequence
  Description of Artificial Sequence: Synthetic coding sequence
atggacaagagcaacagctctgtggtgtctgaatttgtgctgctgggcctgtgcagcagccagaagctgcagctgttctacttctgcttcttctctgtgctgtacaccgtcatcgtgctgggcaacctgctgatcatcctgactgtgaccagtgacaccagcctgcacagccccatgtacttcctgctgggcaacctgagctttgtggacatctgccaggccagctttgccacccccaagatgattgctgacttcctgagcgcccacgagaccatctccttcagcggctgcatcgcccagatcttcttcatccacctgttcaccggcggggagatggtgctgctggtgtccatggcctatgacagatatgtggccatctgcaagcccctgtactacgtggtgatcatgagcaggaggacctgcaccgtgctggtgatgatctcctgggccgtgtccctggtgcacaccctgagccagctgtccttcaccgtgaacctgcccttctgtggccccaacgtggtggacagcttcttctgtgacctgccccgggtgaccaagctggcctgcctggacagctacatcatcgagatcctgattgtggtgaacagcggcatcctgagcctgagcaccttcagcctgctggtgtcctcctacatcatcatcctggtgacagtgtggctgaagagcagcgctgccatggccaaggccttcagcaccctggccagccacatcgctgtggtgatcctcttcttcggcccctgcatcttcatctacgtgtggcccttcaccatcagccccctggacaagttcctggccatcttctacaccgtcttcacccctgtgctgaaccccatcatctacaccctgaggaacagagacatgaaggctgctgtgaggaagatcgtgaaccactacctgcggccccggcgcatcagcgagatgagcctggtggtgaggaccagcttccactag

SEQ ID NO: 36456 - DNA, 939 bp, Artificial Sequence
  Description of Artificial Sequence: Synthetic coding sequence
atggacctgaagaatggcagcctggtgacagagttcatcctgctgggcttcttcggccgctgggagctgcagatcttcttctttgtgaccttcagcctcatctatggagccaccgtgatgggcaacatcctgatcatggtgacagtgacctgccgcagcaccctgcacagccccctgtacttcctgctgggcaacctgtccttcctggacatgtgcctgagcacagccaccacccccaagatgatcatcgacctgctgacagaccacaagaccatctctgtgtggggctgtgtgacccagatgttcttcatgcacttctttggaggagctgagatgaccctgctgatcatcatggcctttgacagatatgtggccatctgcaagcccctgcactaccgcaccatcatgagccacaagctgctgaagggctttgccatcctgtcctggatcatcggcttcctgcacagcatcagccagatcgtgctgaccatgaacctgcccttctgtggccacaacgtcatcaacaacatcttctgtgacctgcccctggtgatcaagctggcctgcatcgagacctacaccctggagctgtttgtgattgctgacagcggcctgctgtccttcacctgcttcatcctgctgctggtgtcctacatcgtcatcctggtgtctgtgcccaagaagagcagccacggcctgagcaaggccctgagcaccctgagcgcccacatcatcgtggtgaccctcttcttcggcccctgcatcttcatctacgtgtggcccttcagcagcctggccagcaacaagaccctggccgtgttctacaccgtcatcacccccctgctgaaccccagcatctacaccctgaggaacaagaagatgcaggaggccatcaggaagctgcgcttccagtatgtgagcagcgcccagaacttctag

SEQ ID NO: 36457 - DNA, 942 bp, Artificial Sequence
  Description of Artificial Sequence: Synthetic coding sequence
atggagacagccaactacaccaaggtgacagaatttgtgctgaccggcctgagccagacccgggaggtgcagctggtgctcttcgtcatcttcctgtccttctacctgttcatcctgcccggcaacatcctgatcatctgcaccatccggctggacccccacctgaccagccccatgtacttcctgctggccaacctggccctgctggacatctggtacagcagcatcacagcccccaagatgctgattgacttctttgtggagaggaagatcatcagctttggaggctgcatcgcccagctgttcttcctgcactttgtgggcgccagcgagatgttcctgctgactgtgatggcctatgacagatatgctgccatctgccggcccctgcactacgccaccatcatgaacagaaggctgtgctgcatcctggtggccctgtcctggatgggcggcttcatccacagcatcatccaggtggccctgattgtgcggctgcccttctgtggccccaatgagctggacagctacttctgtgacatcacccaggtggtgagaattgcctgtgccaacaccttccctgaggagctggtgatgatctgcagcagcggcctcatctctgtggtgtgcttcatcgccctgctgatgtcctatgccttcctgctggccctgctgaagaagcacagcggcagcggggagaacaccaacagagccatgagcacctgctacagccacatcaccatcgtggtgctgatgtttggccccagcatctacatctatgcccggccctttgacagcttcagcctggacaaggtggtgtctgtgttccacacagtcatcttccccctgctgaaccccatcatctacaccctgaggaacaaggaggtgaaggccgccatgaggaaggtggtgaccaagtacatcctgtgtgaggagaagtag

SEQ ID NO: 36458 - DNA, 942 bp, Artificial Sequence
  Description of Artificial Sequence: Synthetic coding sequence
atggagacagccaactacaccaaggtgacagaatttgtgctgaccggcctgagccagaccccagaggtgcagctggtgctcttcgtcatcttcctgtccttctacctgttcatcctgcccggcaacatcctgatcatctgcaccatcagcctggacccccacctgaccagccccatgtacttcctgctggccaacctggccttcctggacatctggtacagcagcatcacagcccctgagatgctgattgacttctttgtggagaggaagatcatcagctttgatggctgcatcgcccagctgttcttcctgcactttgctggggccagcgagatgttcctgctgactgtgatggcctttgacctgtacacagccatctgccggcccctgcactacgccaccatcatgaaccagaggctgtgctgcatcctggtggccctgtcctggaggggcggcttcatccacagcatcatccaggtggccctgattgtgcggctgcccttctgtggccccaatgagctggacagctacttctgtgacatcacccaggtggtgagaattgcctgtgccaacaccttccctgaggagctggtgatgatctgcagcagcggcctcatctctgtggtgtgcctgattgccctgctgatgtcctatgccttcctgctggccctcttcaagaagctgagcggcagcggggagaacaccaacagagccatgagcacctgctacagccacatcaccatcgtggtgctgatgtttggccccagcatctacatctatgcccggccctttgacagcttcagcctggacaaggtggtgtctgtgttcaacaccctcatcttccccctgaggaaccccatcatctacaccctgaggaacaaggaggtgaaggccgccatgaggaagctggtgaccaagtacatcctgtgcaaggagaagtag

SEQ ID NO: 36459 - DNA, 924 bp, Artificial Sequence
  Description of Artificial Sequence: Synthetic coding sequence
atggagagcgagaacagaactgtcatccgggagttcatcctgctgggcctgacccagagccaggacatccagctgctggtgtttgtgctggtgctgatcttctacttcatcatcctgcccggcaacttcctgatcatcttcaccatcaagagtgaccccggcctgacagcccccctgtacttcttcctgggcaacctggccttcctggatgccagctacagcttcatcgtggcccccaggatgctggtggacttcctgagcgccaagaagatcatctcctaccggggctgcatcacccagctgttcttcctgcacttcctgggcggcggggagggcctgctgctggtggtgatggcctttgaccgctacatcgccatctgccggcccctgcactaccccaccgtgatgaaccccaggacctgctacgccatgatgctggccctgtggctgggcggctttgtgcacagcatcatccaggtggtgctgatcctgcggctgcccttctgtggccccaaccagctggacaacttcttctgtgatgtgccccaggtgatcaagctggcctgcacagacacctttgtggtggagctgctgatggtgttcaacagcggcctgatgaccctgctgtgcttcctgggcctgctggccagctatgctgtgatcctgtgccgcatccggggcagcagcagcgaggccaagaacaaggccatgagcacctgcatcacccacatcatcgtcatcttcttcatgtttggacctggcatcttcatctacacccggcccttccgggccttccctgctgacaaggtggtgtccctcttccacacagtcatcttccccctgctgaaccctgtgatctacaccctgaggaaccaggaggtgaaggcctccatgaagaaggtgttcaacaagcacatcgcctag

SEQ ID NO: 36460 - DNA, 66 bp, Artificial Sequence
  Description of Artificial Sequence: Synthetic coding sequence
atggagagcgagaacagaactgtcatccgggagttcatcctgctgggcctgacccagagccagtag

SEQ ID NO: 36461 - DNA, 441 bp, Artificial Sequence
  Description of Artificial Sequence: Synthetic coding sequence
atggagagcgagaacagaactgtcatccgggagttcatcctgctgggcctgacccagagccaggacatccagctgctggtgtttgtgctggtgctgatcttctacttcatcatcctgcccggcaacttcctgatcatcttcaccatcaagagtgaccccggcctgacagcccccctgtacttcttcctgggcaacctggccttcctggatgccagctacagcttcatcgtggcccccaggatgctggtggacttcctgagcgccaagaagatcatctcctaccggggctgcatcacccagctgttcttcctgcacttcctgggcggcggggagggcctgctgctggtggtgatggcctttgaccgctacatcgccatctgccggcccctgcactaccccaccgtgatgaaccccaggacctgctacgccatgatgctgtag

SEQ ID NO: 36462 - DNA, 951 bp, Artificial Sequence
  Description of Artificial Sequence: Synthetic coding sequence
atgaagatcgccaacaacacagtggtgacagagttcatcctgctgggcctgacccagagccaggacatccagctgctggtgtttgtgctgatcctgatcttctacctgatcatcctgcccggcaacttcctgatcatcttcaccatccgcagtgaccccggcctgacagcccccctgtacctgttcctgggcaacctggccttcctggatgccagctacagcttcatcgtggcccccaggatgctggtggacttcctgtctgagaagaaggtgatctcctaccggggctgcatcacccagctgttcttcctgcacttcctgggcggcggggagggcctgctgctggtggtgatggcctttgaccgctacatcgccatctgccggcccctgcactgcagcacagtgatgaacccccgggcctgctacgccatgatgctggccctgtggctgggcggctttgtgcacagcatcatccaggtggtgctgatcctgcggctgcccttctgtggccccaaccagctggacaacttcttctgtgatgtgcggcaggtgatcaagctggcctgcacagacatgtttgtggtggagctgctgatggtgttcaacagcggcctgatgaccctgctgtgcttcctgggcctgctggccagctatgctgtgatcctgtgccacgtgcggcgggccgccagcgagggcaagaacaaggccatgagcacctgcaccaccagggtcatcatcatcctgctgatgtttggacctgccatcttcatctacatgtgccccttccgggccctgcctgctgacaagatggtgtccctcttccacacagtcatcttccccctgatgaaccccatgatctacaccctgaggaaccaggaggtgaagacctccatgaagaggctgctgagcagacatgtggtgtgccaggtggacttcatcatcagaaattag

SEQ ID NO: 36463 - DNA, 927 bp, Artificial Sequence
  Description of Artificial Sequence: Synthetic coding sequence
atggagacccagaacctgactgtggtgacagagttcatcctgctgggcctgacccagagccaggatgcccagctgctggtgtttgtgctggtgctgatcttctacctgatcatcctgcccggcaacttcctgatcatcttcaccatcaagagtgaccccggcctgacagcccccctgtacttcttcctgggcaacctggccctgctggatgccagctacagcttcatcgtggtgcccaggatgctggtggacttcctgtctgagaagaaggtgatctcctaccgcagctgcatcacccagctgttcttcctgcacttcctgggcgctggggagatgttcctgctggtggtgatggcctttgaccgctacatcgccatctgccggcccctgcactacagcaccatcatgaacccccgggcctgctacgccctgagcctggtgctgtggctgggcggcttcatccacagcatcgtgcaggtggccctgatcctgcacctgcccttctgtggccccaaccagctggacaacttcttctgtgatgtgccccaggtgatcaagctggcctgcaccaacacctttgtggtggagctgctgatggtgagcaacagcggcctgctgagcctgctgtgcttcctgggcctgctggccagctatgctgtgatcctgtgccgcatccgggagcacagcagcgagggcaagagcaaggccatcagcacctgcaccacccacatcatcatcatcttcctgatgtttggacctgccatcttcatctacacctgccccttccaggccttccctgctgacaaggtggtgtccctcttccacacagtcatcttccccctgatgaaccctgtgatctacaccctgaggaaccaggaggtgaaggcctccatgaggaagctgctgagccagcacatgttctgctag

SEQ ID NO: 36464 - DNA, 939 bp, Artificial Sequence
  Description of Artificial Sequence: Synthetic coding sequence
atggagaagagcaacaacagcaccctcttcatcctgctgggcttcagccagaacaagaacatcgaggtgctgtgctttgtgctcttcctgttctgctacatcgccatctggatgggcaacctgctgatcatgatcagcatcacctgcacccagctgatccaccagcccatgtacttcttcctgaactacctgagcctgagtgacctgtgctacaccagcacagtgacccccaagctgatggtggacctgctggccgagaggaagaccatctcctacaacaactgcatgatccagctgttcaccacccacttctttggaggcatcgagatcttcatcctgaccggcatggcctatgacagatatgtggccatctgcaagcccctgcactacaccatcatcatgagccggcagaagtgcaacaccatcatcatcgtgtgctgcaccggcggcttcatccacagcgccagccagttcctgctgaccatctttgtgcccttctgtggccccaatgaaattgaccactacttctgtgatgtgtaccccctgctgaagctggcctgcagcaacatccacatgattggcctgctggtgattgccaacagcggcctcatcgccctggtgacctttgtggtgctgctgctgtcctatgtgttcatcctgtacaccatccgggcctacagcgctgagcggcgcagcaaggccctggccacctgcagcagccacgtgattgtggtggtgctcttctttgccccagccctcttcatctacatccggcctgtgaccaccttcagcgaggacaaggtgtttgccctcttctacaccatcatcgcccccatgttcaaccccctcatctacaccctgaggaacacagagatgaagaatgccatgaggaaggtgtggtgctgccagatcctgctgaagaggaaccagctgttctag

SEQ ID NO: 36465 - DNA, 942 bp, Artificial Sequence
  Description of Artificial Sequence: Synthetic coding sequence
atgaagaaggagcaggacagcaatgtgacagaatttgtgctgctgggcctgagcagctcctgggagctgcagctgttcctgttcctgctcttcctgttcttctacatcgccatcgtgctgggcaacctgctgattgtggtgacagtgcaggcccacgcccacctgctgcagagccccatgtactacttcctgggccacctgtccttcatcgacctgtgcctgagctgtgtgacagtgcccaagatgctgggggacttcctgcagcagggcaagagcatctccttcagcggctgcctggcccagatctacttcctgcacttcctgggcgccagcgagatgttcctgctgactgtgatggcctatgaccgctacgtggccatctgcaaccccctgcgctacctgactgtgatgaacccccagctgtgcctgtggctggtgctggcctgctggtgtggcggcttcatccacagcatcatgcaggtgatcctggtgatccagctgcccttctgtggccccaatgagctggacaacttctactgtgatgtgccccaggtgatcaagctggcctgcatggacacctacgtggtggaggtgctggtgattgccaacagcggcctgctgagcctggtgtgcttcctggtgctgctcttctcctatgccatcatcctgatcaccctgcggacccacttctgccagggccagaacaaggtgttcagcacctgtgccagccacctgactgtggtgtccctcatctttgtgccctgtgtgttcatctacctgcggcccttctgcagcttctctgtggacaagatcttcagcctcttctacaccgtcatcacccccatgctgaaccccctcatctacaccctgaggaacacagacatgaagacagccatgaagaagctgcgcatcaagccctgtggcatccccctgccctgctag

SEQ ID NO: 36466 - DNA, 930 bp, Artificial Sequence
  Description of Artificial Sequence: Synthetic coding sequence
atgggcgccaagaacaacgtgacagaatttgtgctgtttggcctgtttgagagccgggagatgcagcacacctgctttgtggtgttcttcctgttccacgtgctgactgtgctgggcaacctgctggtgatcatcaccatcaatgccaggaagaccctgaagagccccatgtacttcttcctgagccagctgagctttgctgacatctgctaccccagcaccaccatccccaagatgattgctgacacctttgtggagcacaagatcatctccttcaacggctgcatgacccagctgttcagcgcccacttctttggaggaacagagatcttcctgctgacagccatggcctatgacagatatgtggccatctgccggcccctgcactacacagccatcatggactgcaggaaatgtggcctgctggccggggcctcctggctggccggcttcctgcacagcatcctgcagaccctgctgactgtgcagctgcccttctgtggccccaatgaaattgacaacttcttctgtgatgtgcaccccctgctgaagctggcctgtgccgacacctacatggtgggcctcatcgtggtggccaacagcggcatgatcagcctggccagcttcttcatcctgatcatctcctatgtgatcatcctgctgaacctgcggagccagagcagtgaagatagaaggaaggctgtgtccacctgtggcagccacgtgatcaccgtgctgctggtgctgatgccacccatgttcatgtacatccggcccagcaccaccctggccgctgacaagctgatcatcctcttcaacatcgtgatgccacccctgctgaaccccctcatctacaccctgaggaacaatgatgtgaagaatgccatgaggaagctgttccgggtgaagaggagcctgggggagaagtag

SEQ ID NO: 36467 - DNA, 936 bp, Artificial Sequence
  Description of Artificial Sequence: Synthetic coding sequence
atggagaagatcaacaacgtgacagagttcatcttctggggcctgagccagagccctgagattgagaaggtgtgctttgtggtgttctccttcttctacatcatcatcctgctgggcaacctgctgatcatgctgactgtgtgcctgagcaacctcttcaagagccccatgtacttcttcctgtccttcctgagctttgtggacatctgctacagctctgtgacagcccccaagatgattgtggacctgctggccaaggacaagaccatctcctatgtgggctgcatgctgcagctgtttggagtgcacttcttcggctgcacagagatcttcatcctgactgtgatggcctatgacagatatgtggccatctgcaagcccctgcactacatgaccatcatgaaccgggagacctgcaacaagatgctgctgggcacctgggtgggcggcttcctgcacagcatcatccaggtggccctggtggtgcagctgcccttctgtggccccaatgaaattgaccactacttctgtgatgtgcaccctgtgctgaagctggcctgcacagagacctacatcgtgggcgtggtggtgacagccaacagcggcaccatcgccctgggcagctttgtgatcctgctgatctcctacagcatcatcctggtgtccctgaggaagcagagcgctgagggccgcaggaaggccctgagcacctgtggcagccacatcgccatggtggtgatcttcttcggcccctgcaccttcatgtacatgaggccagacaccaccttcagcgaggacaagatggtggccgtgttctacaccatcatcacccccatgctgaaccccctcatctacaccctgagaaatgctgaggtgaagaatgccatgaagaagctgtggggcagaaatgtgttcctggaggccaagggcaagtag

SEQ ID NO: 36468 - DNA, 918 bp, Artificial Sequence
  Description of Artificial Sequence: Synthetic coding sequence
atggtggccaccaacaacgtgacagagatcatctttgtgggcttcagccagaactggagcgagcagagggtcatctctgtgatgttcctgctgatgtacacagctgtggtgctgggcaatggcctgattgtggtgaccatcctggccagcaaggtgctgaccagccccatgtacttcttcctgagctacctgagctttgtggagatctgctactgcagcgtgatggcccccaagctgatctttgacagcttcatcaagaggaaggtgatcagcctgaagggctgcctgacccagatgttcagcctgcacttctttggaggaacagaggccttcctgctgatggtgatggcctatgacagatatgtggccatctgcaagcccctgcactacatggccatcatgaaccagaggatgtgtggcctgctggtgagaattgcctggggcggcggcctgctgcacagcgtgggccagaccttcctgatcttccagctgcccttctgtggccccaacatcatggaccactacttctgtgatgtgcaccctgtgctggagctggcctgtgccgacaccttcttcatcagcctgctgatcatcaccaacggcggcagcatctctgtggtgtccttctttgtgctgatggccagctacctgatcatcctgcacttcctgcggagccacaacctggagggccagcacaaggccctgagcacctgtgccagccacgtgacagtggtggacctcttcttcatcccctgcagcctggtgtacatccggccctgtgtgaccctgcctgctgacaagatcgtggccgtgttctacacagtggtgacccccctgctgaaccctgtgatctacagcttcagaaatgctgaggtgaagaatgccatgaggcgcttcatcggcggcaaggtgatctag

SEQ ID NO: 36469 - DNA, 912 bp, Artificial Sequence
  Description of Artificial Sequence: Synthetic coding sequence
atgacagagttcatcttcctggtgctgagccccaaccaggaggtgcagagggtgtgcttcgtcatcttcctgttcctgtacacagccatcgtgctgggcaacttcctgattgtgctgactgtgatgaccagccgcagcctgggcagccccatgtacttcttcctgagctacctgtccttcatggagatctgctacagcagcgccacagcccccaagctgatcagtgacctgctggccgagaggaaggtgatctcctggtggggctgcatggcccagctgttcttcctgcacttctttggaggaacagagatcttcctgctgactgtgatggcctatgaccactacgtggccatctgcaagcccctgagctacaccaccatcatgaactggcaggtgtgcaccgtgctggtgggcatcgcctgggtgggcggcttcatgcacagctttgcccagatcctgctgatcttccacctgctcttctgtggccccaacgtcatcaaccactacttctgtgacctggtgcccctgctgaagctggcctgcagcgacaccttcctgattggcctgctgattgtggccaacggcggcaccctgagcgtcatcagctttggagtgctgctggccagctacatggtgatcctgctgcacctgcggacctggagcagcgagggctggtgcaaggccctgagcacctgtggcagccactttgctgtggtgatcctcttcttcggcccctgtgtgttcaacagcctgcggcccagcaccaccctgcccatcgacaagatggtggccgtgttctacaccgtcatcacagccatcctgaaccctgtgatctacagcctgagaaatgctgagatgaggaaggccatgaagaggctgtggatccgcaccctgcggctgaatgagaagtag

SEQ ID NO: 36470 - DNA, 948 bp, Artificial Sequence
  Description of Artificial Sequence: Synthetic coding sequence
atgagcatcaccaaggcctggaacagcagctctgtgaccatgttcatcctgctgggcttcacagaccaccctgagctgcaggccctgctgtttgtgaccttcctgggcatctacctgaccaccctggcctggaacctggccctgatcttcctgatccggggggacacccacctgcacacccccatgtacttcttcctgagcaacctgtccttcatcgacatctgctacagcagcgctgtggcccccaacatgctgacagacttcttctgggagcagaagaccatcagctttgtgggctgtgccgcccagttcttcttctttgtgggcatgggcctgtctgagtgcctgctgctgacagccatggcctatgacagatatgctgccatcagcagccccctgctgtaccccaccatcatgacccagggcctgtgcaccaggatggtggtgggcgcctacgtgggcggcttcctgagcagcctcatccaggccagcagcatcttccggctgcacttctgtggccccaacatcatcaaccacttcttctgtgacctgccccctgtgctggccctgagctgcagcgacaccttcctgagccaggtggtgaacttcctggtggtggtgacagtgggcggcaccagcttcctgcagctgctgatctcctatggctacatcgtgtctgctgtgctgaagatccccagcgctgagggccgctggaaggcctgcaacacctgtgccagccacctgatggtggtgaccctgctgtttggaacagccctgtttgtgtacctgcggcccagcagcagctacctgctgggccgggacaaggtggtgtctgtgttctacagcctggtgatccccatgctgaaccccctcatctacagcctgaggaacaaggagatcaaggatgccctgtggaaggtgctggagaggaagaaggtgttctcctag

SEQ ID NO: 36471 - DNA, 975 bp, Artificial Sequence
  Description of Artificial Sequence: Synthetic coding sequence
atggctgtgggcaggaacaacaccatcgtgaccaagttcatcctgctgggcctgagtgaccacccccagatgaagatcttcctgttcatgctgttcctgggcctgtacctgctgaccctggcctggaacctgagcctgattgccctgatcaagatggacagccacctgcacatgcccatgtacttcttcctgagcaacctgtccttcctggacatctgctacgtgagcagcacagcccccaagatgctgagtgacatcatcacagagcagaagaccatcagctttgtgggctgtgccacccagtactttgtgttctgtggcatgggcctgacagagtgcttcctgctggccgccatggcctatgacagatatgctgccatctgcaaccccctgctgtacacagtgctgatcagccacaccctgtgcctgaagatggtggtgggcgcctacgtgggcggcttcctgagcagcttcatcgagacctacagcgtgtaccagcacgacttctgtggcccctacatgatcaaccacttcttctgtgacctgccccctgtgctggccctgagctgcagcgacaccttcaccagcgaggtggtgaccttcatcgtgtctgtggtggtgggcatcgtgtctgtgctggtggtgctgatctcctatggctacatcgtggccgctgtggtgaagatcagcagcgccactggaagaaccaaggccttcagcacctgtgccagccacctgacagctgtgaccctcttctacggcagcggcttcttcatgtacatgaggcccagcagcagctacagcctgaacagagacaaggtggtgtccatcttctacgccctggtgattcctgtggtgaaccccatcatctacagcttcaggaacaaggagatcaagaatgccatgaggaaggccatggagcgggaccccggcatcagccacggcggccccttcatcttcatgaccctgggctag

SEQ ID NO: 36472 - DNA, 930 bp, Artificial Sequence
  Description of Artificial Sequence: Synthetic coding sequence
atggacatcagcgagggcaacaagaccctggtgacagaatttgtgctgaccggcctgacagaccggccctggctgcacgtgctcttctttgtggtgttcctggtggtgtacctgatcaccatggtgggcaacctgggcctcatcgtgctgatctggaatgacccccacctgcacatgcccatgtacctgttcctgggcggcctggccttcagtgatgcctgcaccagcaccagcatcacccccaggatgctggtgaacttcctggacaagacagccatgatcagcctggccgagtgcatcacccagttctacttctttgccagcagcgccaccacagagtgcttcctgctggtgatgatggcctatgacagatatgtggccatctgcaaccccctgctgtaccctgtgatgatgagcaacaagctgagcgcccagctgctgagcatctcctatgtgattggcttcctgcaccccctggtgcacgtgtccctgctgctgcggctgaccttctgccgcttcaacatcatccactacttctactgtgagatcctgcagctgttcaagatcagctgcaatggccccagcatcaatgccctgatgatcttcatctttggagccttcatccagatccccaccctgatgaccatcatcatctcctacaccagggtgctgtttgacatcctgaagaagaagtctgagaagggccgcagcaaggccttcagcacctgtggggcccacctgctgtctgtgtccctgtactacggcaccctcatcttcatgtatgtgcggcctgccagcggcctggccgaggaccaggacaaggtgtacagcctcttctacaccatcatcatccccctgctgaaccccttcatctacagcctgaggaacaagaaggtgatgcacgccctgcggcgggtcatcaggaagtag

SEQ ID NO: 36473 - DNA, 930 bp, Artificial Sequence
  Description of Artificial Sequence: Synthetic coding sequence
atgaccctgggcaacagcacagaggtgacagagttctacctgctgggctttggagcccagcacgagttctggtgcatcctcttcatcgtgttcctgctgatctacgtgaccagcatcatgggcaacagcggcatcatcctgctgatcaacacagacagccgcttccagaccctgacctacttcttcctgcagcacctggcctttgtggacatctgctacaccagcgccatcacccccaagatgctgcagagcttcacagaggagaagaacctgatgctgttccagggctgtgtgatccagttcctggtgtatgccacctttgccaccagtgactgctacctgctggccatgatggctgtggacccctacgtggccatctgcaagcccctgcactacaccgtcatcatgagcaggacagtgtgcatccggctggtggccggcagctacatcatgggcagcatcaatgcctctgtgcagacaggcttcacctgcagcctgtccttctgcaagagcaacagcatcaaccacttcttctgtgatgtgccccccatcctggccctgagctgcagcaatgtggacatcaacatcatgctgctggtggtgtttgtgggcagcaacctgatcttcaccggcctggtggtgatcttctcctacatctacatcatggccaccatcctgaagatgagcagcagcgctggcaggaagaagagcttcagcacctgtgccagccacctgacagctgtgaccatcttctacggcaccctgagctacatgtacctgcagagccacagcaacaacagccaggagaacatgaaggtggccttcatcttctacggcaccgtcatccccatgctgaaccccctcatctacagcctgaggaacaaggaggtgaaggaggccctgaaggtgattggcaagaagctgttctag

SEQ ID NO: 36474 - DNA, 936 bp, Artificial Sequence
  Description of Artificial Sequence: Synthetic coding sequence
atgactggaggcggcaacatcacagagatcacctacttcatcctgctgggcttcagtgacttcccccgcatcatcaaggtgctcttcaccatcttcctggtgatctacatcaccagcctggcctggaacctgagcctgattgtgctgatccgcatggacagccacctgcacacccccatgtacttcttcctgagcaacctgtccttcattgatgtgtgctacatcagcagcacagtgcccaagatgctgagcaacctgctgcaggagcagcagaccatcacctttgtgggctgcatcatccagtacttcatcttcagcaccatgggcctgtctgagagctgcctgatgacagccatggcctatgacagatatgctgccatctgcaaccccctgctgtacagcagcatcatgagccccaccctgtgtgtgtggatggtgctgggcgcctacatgacaggcctgacagccagcctcttccagattggagccctgctgcagctgcacttctgtggcagcaatgtcatccgccacttcttctgtgacatgccccagctgctgatcctgagctgcacagacaccttctttgtgcaggtgatgacagccatcctgaccatgttctttggaattgccagcgccctggtgatcatgatctcctatggctacatcggcatcagcatcatgaagatcaccagcgccaagggccgcagcaaggccttcaacacctgtgccagccacctgacagctgtgtccctcttctacaccagcggcatctttgtgtacctgagcagcagcagcggcggcagcagcagctttgacagatttgccagcgtcttctacacagtggtgatccccatgctgaaccccctcatctacagcctgaggaacaaggagatcaaggatgccctgaagaggctgcagaagaggaagtgctgctag

SEQ ID NO: 36475 - DNA, 951 bp, Artificial Sequence
  Description of Artificial Sequence: Synthetic coding sequence
atgaggctgatgaaggaggtgcggggcaggaaccagacagaggtgacagagttcctgctgctgggcctgagtgacaacccagacctgcagggcgtgctgtttgccctcttcctgctgatctacatggccaacatggtgggcaacctgggcatgattgtgctgatcaagattgacctgtgcctgcacacccccatgtacttcttcctgagcagcctgagctttgtggatgccagctacagcagctctgtgacccccaagatgctggtgaacctgatggccgagaacaaggccatctccttccacggctgtgccgcccagttctacttcttcggcagcttcctgggcacagagtgcttcctgctggccatgatggcctatgacagatatgctgccatctggaaccccctgctgtaccctgtgctggtgtctggccgcatctgcttcctgctgattgccaccagcttcctggccggctgtggaaatgctgccatccacacaggcatgaccttccggctgtccttctgtggcagcaaccgcatcaaccacttctactgtgacaccccacccctgctgaagctgagctgcagcgacacccacttcaatggaattgtcatcatggccttcagcagcttcatcgtcatcagctgtgtgatgattgtgctgatctcctacctgtgcatcttcatcgctgtgctgaagatgcccagcctggagggccgccacaaggccttcagcacctgtgccagctacctgatggctgtgaccatcttcttcggcaccatcctcttcatgtacctgcggcccaccagcagctacagcatggagcaggacaaggtggtgtctgtgttctacaccgtcatcatccctgtgctgaaccccctcatctacagcctgaagaacaaggatgtgaagaaggccctgaagaagatcctgtggaagcacatcctgtag

SEQ ID NO: 36476 - DNA, 954 bp, Artificial Sequence
  Description of Artificial Sequence: Synthetic coding sequence
atgatgaggctgatgaaggaggtgcggggcaggaaccagacagaggtgacagagttcctgctgctgggcctgagtgacaacccagacctgcagggcgtgctgtttgccctcttcctgctgatctacatggccaacatggtgggcaacctgggcatgattgtgctgatcaagattgacctgtgcctgcacacccccatgtacttcttcctgagcagcctgagctttgtggatgccagctacagcagctctgtgacccccaagatgctggtgaacctgatggccgagaacaaggccatctccttccacggctgtgccgcccagttctacttcttcggcagcttcctgggcacagagtgcttcctgctggccatgatggcctatgacagatatgctgccatctggaaccccctgctgtaccctgtgctggtgtctggccgcatctgcttcctgctgattgccaccagcttcctggccggctgtggaaatgctgccatccacacaggcatgaccttccggctgtccttctgtggcagcaaccgcatcaaccacttctactgtgacaccccacccctgctgaagctgagctgcagcgacacccacttcaacggcatcgtcatcatggccttcagcagcttcatcgtcatcagctgtgtgatgattgtgctgatctcctacctgtgcatcttcatcgctgtgctgaagatgcccagcctggagggccgccacaaggccttcagcacctgtgccagctacctgatggctgtgaccatcttcttcggcaccatcctcttcatgtacctgcggcccaccagcagctacagcatggagcaggacaaggtggtgtctgtgttctacaccgtcatcatccctgtgctgaaccccctcatctacagcctgaagaacaaggatgtgaagaaggccctgaagaagatcctgtggaagcacatcctgtag

SEQ ID NO: 36477 - DNA, 933 bp, Artificial Sequence
  Description of Artificial Sequence: Synthetic coding sequence
atggacaaggagaacagctccatggtgacagagttcatcttcatgggcatcacccaggacccccagatggagatcatcttctttgtggtgttcctgattgtgtacctggtgaatgtggtgggcaacatcggcatgatcatcctgatcaccacagacacccagctgcacacccccatgtacttcttcctgtgcaacctgagctttgtggacctgggctacagcagcgccatcgcccccaggatgctggccgacttcctgaccaaccacaaggtgatctccttcagcagctgtgccacccagtttgccttctttgtgggctttgtggatgctgaatgttatgtgctggccgccatggcctacggccgctttgtggccatctgccggcccctgcactacagcaccttcatgagcaagcaggtgtgcctggccctgatgctgggcagctacctggccggcctggtgtccctggtggcccacaccaccctgaccttcagcctgagctactgcggcagcaacatcatcaaccacttcttctgtgagatcccccccctgctggccctgagctgcagcgacacctacatcagcgagatcctgctcttcagcctgtgtggcttcatcgagttcagcaccatcctgatcatcttcatctcctacaccttcatcctggtggccatcatccgcatgaggtctgctgagggccgcctgaaggccttcagcacctgtggcagccacctgaccggcatcaccctcttctacggcaccgtgatgttcatgtacctgcggcccaccagcagctacagcctggaccaggacaagtgggcctctgtgttctacaccgtcatcatccccatgctgaaccccctcatctacagcctgaggaacaaggatgtgaaggccgccttcaagaagctgattggcaagaagagccagtag

SEQ ID NO: 36478 - DNA, 975 bp, Artificial Sequence
  Description of Artificial Sequence: Synthetic coding sequence
atgctggagagcaactacaccatgcccacagagttcctgtttgtgggcttcacagactacctgcccctgcgggtgaccctcttcctggtgttcctgctggtgtacaccctgaccatggtgggcaacatcctgctgatcatcctggtgaacatcaacagcagcctgcagatccccatgtactacttcctgagcaacctgtccttcctggacatcagctgcagcacagccatcacccccaagatgctggccaacttcctggccagcaggaagagcatcagcccctacggctgtgccctgcagatgttcttctttgccagctttgctgatgctgaatgtctcatcctggccgccatggcctatgacagatatgctgccatctgcaaccccctgctgtacaccaccctgatgagccggcgggtgtgtgtgtgcttcatcgtgctggcctacttcagcggcagcaccaccagcctggtgcacgtgtgcctgaccttccggctgtccttctgtggcagcaacatcgtgaaccacttcttctgtgacatcccccccctgctggccctgagctgcacagacacccagatcaaccagctgctgctgtttgccctgtgcagcttcatccagaccagcacctttgtggtgatcttcatctcctacttctgcatcctgatcaccgtgctgagcatcaagagcagcggcggccgcagcaagaccttcagcacctgtgccagccacctgattgctgtgaccctcttctacggggccctgctcttcatgtacctgcagcccaccaccagctacagcctggacacagacaaggtggtggccgtgttctacacagtggtgttccccatgttcaaccccatcatctacagcttcaggaacaaggatgtgaagaatgccctgaagaagctgctggagcgcatcggctacagcaatgagtggtacctgaaccggctgagaattgtgaacatctag

SEQ ID NO: 36479 - DNA, 1089 bp, Artificial Sequence
  Description of Artificial Sequence: Synthetic coding sequence
atgacagagttccacctgcagagccagatgcccagcatccgcctcatcttccggcggctgagcctgggccgcatcaagcccagccagagcccccgctgcagcaccagcttcatggtggtgcccagcttcagcattgctgagcactggaggaggatgaagggggccaacctgagccagggcatggagtttgagctgctgggcctgaccacagacccccagctgcagaggctgctgtttgtggtgttcctgggcatgtacacagccaccctgctgggcaacctggtgatgttcctgctgattcatgtgtctgccaccctgcacacccccatgtacagcctgctgaagagcctgtccttcctggacttctgctacagcagcacagtggtgccccagaccctggtgaacttcctggccaagaggaaggtgatctcctacttcggctgcatgacccagatgttcttctacgccggctttgccaccagcgagtgctacctgattgctgccatggcctatgacagatatgctgccatctgcaaccccctgctgtacagcaccatcatgagccctgaggtgtgtgccagcctcatcgtgggcagctacagcgctggcttcctgaacagcctcatccacacaggctgcatcttcagcctgaagttctgtggggcccacgtggtgacccacttcttctgtgatggcccccccatcctgagcctgagctgtgtggacaccagcctgtgtgagatcctgctcttcatctttgctggcttcaacctgctgagctgcaccctgaccatcctgatctcctacttcctgatcctgaacaccatcctgaagatgagcagcgcccagggccgcttcaaggccttcagcacctgtgccagccacctgacagccatctgcctcttcttcggcaccaccctcttcatgtacctgcggcccaggagcagctacagcctgacccaggacagaacagtggccgtcatctacacagtggtgattcctgtgctgaaccccctgatgtacagcctgaggaacaaggatgtgaagaaggccctgatcaaggtgtggggcaggaagaccatggagtag

SEQ ID NO: 36480 - DNA, 945 bp, Artificial Sequence
  Description of Artificial Sequence: Synthetic coding sequence
atggagaacaacacagaggtgacagagttcatcctggtgggcctgacagatgatcctgagctgcagatccccctcttcatcgtgttcctgttcatctacctgatcaccctggtgggcaacctgggcatgattgagctgatcctgctggacagctgcctgcacacccccatgtacttcttcctgagcaacctgagcctggtggactttggctacagcagcgctgtgacccccaaggtgatggtgggcttcctgactggagacaagttcatcctgtacaatgcctgtgccacccagttcttcttctttgtggccttcatcacagctgagagcttcctgctggcctccatggcctatgacagatatgctgccctgtgcaagcccctgcactacaccaccaccatgaccaccaacgtgtgtgcctgcctggccatcggcagctacatctgtggcttcctgaatgccagcatccacacaggcaacaccttccggctgtccttctgccgcagcaatgtggtggagcacttcttctgtgatgccccacccctgctgaccctgagctgcagcgacaactacatcagcgagatggtgatcttctttgtggtgggcttcaatgacctcttcagcatcctggtgatcctgatctcctacctgttcatcttcatcaccatcatgaagatgaggagccctgagggccggcagaaggccttcagcacctgtgccagccacctgacagctgtgtccatcttctacggcaccggcatcttcatgtacctgcggcccaacagcagccacttcatgggcacagacaagatggcctctgtgttctacgccatcgtcatccccatgctgaaccccctggtgtacagcctgaggaacaaggaggtgaagagcgccttcaagaagacagtgggcaaggccaaggccagcatcggcttcatcttctag

SEQ ID NO: 36481 - DNA, 945 bp, Artificial Sequence
  Description of Artificial Sequence: Synthetic coding sequence
atggagaacaacacagaggtgtctgagttcatcctgctgggcctgaccaatgcccctgagctgcaggtgcccctcttcatcatgttcaccctcatctacctgatcaccctgaccggcaacctgggcatgatcatcctgatcctgctggacagccacctgcacacccccatgtacttcttcctgagcaacctgagcctggccggcatcggctacagcagcgctgtgacccccaaggtgctgaccggcctgctgattgaggacaaggccatctcctacagcgcctgtgccgcccagatgttcttctgtgctgtgtttgccaccgtggagaactacctgctgagctccatggcctatgacagatatgctgctgtgtgcaaccccctgcactacaccaccaccatgaccaccagggtgtgtgcctgcctggccatcggctgctacgtgattggcttcctgaatgccagcatccagatcggggacaccttccggctgtccttctgcatgagcaatgtcatccaccacttcttctgtgacaagccagctgtgatcaccctgacctgcagcgagaagcacatcagcgagctgatcctggtgctgatcagcagcttcaacgtgttctttgccctgctggtgaccctcatctcctacctgttcatcctgatcaccatcctgaagaggcacacaggcaagggctaccagaagcccctgagcacctgtggcagccacctgattgccatcttcctgttctacatcaccgtcatcatcatgtacatccggcccagcagcagccacagcatggacacagacaagatcgcctctgtgttctacaccatgatcatccccatgctgagccccatcgtgtacaccctgaggaacaaggatgtgaagaatgccttcatgaaggtggtggagaaggccaagtacagcctggacagcgtcttctag

SEQ ID NO: 36482 - DNA, 930 bp, Artificial Sequence
  Description of Artificial Sequence: Synthetic coding sequence
atggagaactgcacagaggtgaccaagttcatcctgctgggcctgacctctgtgcctgagctgcagatccccctcttcatcctcttcaccttcatctacctgctgaccctgtgtggcaacctgggcatgatgctgctgatcctgatggacagctgcctgcacacccccatgtacttcttcctgagcaacctgagcctggtggactttggctacagcagcgctgtgacccccaaggtgatggccggcttcctgcggggggacaaggtgatctcctacaatgcctgtgctgtgcagatgttcttctttgtggccctggccaccgtggagaactacctgctggcctccatggcctatgacagatatgctgctgtgtgcaagcccctgcactacaccaccaccatgacagcctctgtgggcgcctgcctggccctgggcagctatgtgtgtggcttcctgaatgccagcttccacatcggcggcatcttcagcctgtccttctgcaagagcaacctggtgcaccacttcttctgtgatgtgcctgctgtgatggccctgagctgcagcgacaagcacaccagcgaggtgatcctggtgttcatgagcagcttcaacatcttctttgtgctgctggtgatcttcatctcctacctgttcatcttcatcaccatcctgaagatgcacagcgccaagggccaccagaaggccctgagcacctgtgccagccacttcaccgctgtgtctgtgttctacggcaccgtcatcttcatctacctgcagcccagcagcagccacagcatggacacagacaagatggcctctgtgttctacgccatgatcatccccatgctgaaccctgtggtgtacagcctgaggaaccgggaggtgcagaatgccttcaagaaggtgctgcggcggcagaagttcctgtag

SEQ ID NO: 36483 - DNA, 945 bp, Artificial Sequence
  Description of Artificial Sequence: Synthetic coding sequence
atggagaacaagacagaggtgacccagttcatcctgctgggcctgaccaatgattctgagctgcaggtgcccctcttcatcaccttccccttcatctacatcatcaccctggtgggcaacctgggcatcatcgtgctgatcttctgggacagctgcctgcacaaccccatgtacttcttcctgagcaacctgagcctggtggacttctgctacagcagcgctgtgacccccatcgtgatggccggcttcctgattgaggacaaggtgatctcctacaatgcctgtgccgcccagatgtacatctttgtggcctttgccaccgtggagaactacctgctggcctccatggcctatgacagatatgctgctgtgtgcaagcccctgcactacaccaccaccatgaccaccaccgtgtgtgcccggctggccatcggcagctacctgtgtggcttcctgaatgccagcatccacactggagacaccttcagcctgtccttctgcaagagcaatgaggtgcaccacttcttctgtgacatcccagctgtgatggtgctgagctgcagcgacagacacatcagcgagctggtgctgatctacgtggtgtccttcaacatcttcatcgccctgctggtgatcctgatctcctacaccttcatcttcatcaccatcctgaagatgcacagcgcctctgtgtaccagaagcccctgagcacctgtgccagccacttcatcgctgtgggcatcttctacggcaccatcatcttcatgtacctgcagcccagcagcagccacagcatggacacagacaagatggcccctgtgttctacaccatggtgatccccatgctgaaccccctggtgtacagcctgaggaacaaggaggtgaagagcgccttcaagaaggtggtggagaaggccaagctgtctgtgggctggagcgtgtag

SEQ ID NO: 36484 - DNA, 963 bp, Artificial Sequence
  Description of Artificial Sequence: Synthetic coding sequence
atgaacagcgagaacctgaccagggctgctgtggccccagctgagtttgtgctgctgggcatcaccaaccgctgggacctgcgggtggccctcttcctgacctgcctgcctgtgtacctggtgtccctgctgggcaacatgggcatggccctgctgatccgcatggatgcccggctgcacacccccatgtacttcttcctggccaacctgagcctgctggatgcctgctacagcagcgccatcggccccaagatgctggtggacctgctgctgccccgggccaccatcccctacacagcctgtgccctgcagatgtttgtgtttgctggcctggccgacacagagtgctgcctgctggccgccatggcctatgacagatatgtggccatccggaaccccctgctgtacaccacagccatgagccagaggctgtgcctggccctgctgggcgccagcggcctgggcggcgctgtgtctgcctttgtgcacaccaccctgaccttccggctgtccttctgccgcagcaggaagatcaacagcttcttctgtgacatcccccccctgctggccatcagctgcagcgacaccagcctgaatgagctgctgctgtttgccatctgtggcttcatccagacagccaccgtgctggccatcaccgtgtcctatggcttcatcgccggggccgtcatccacatgaggtctgtggagggcagcagaagagctgccagcactggaggcagccacctgacagctgtggccatgatgtatggcaccctcatcttcatgtacctgcggcccagcagcagctatgccctggacacagacaagatggcctctgtgttctacaccctggtgatccccagcctgaaccccctcatctacagcctgaggaacaaggaggtgaaggaggccctgcggcagacctggagccgcttccactgccccggccagggcagccagtag

SEQ ID NO: 36485 - DNA, 945 bp, Artificial Sequence
  Description of Artificial Sequence: Synthetic coding sequence
atgatggccagcgagaggaaccagagcagcacccccaccttcatcctgctgggcttcagcgagtacccagagatccaggtgcccctcttcctggtgttcctgtttgtgtacacagtgacagtggtgggcaacctgggcatgatcatcatcatccggctgaacagcaagctgcacaccatcatgtgcttcttcctgagccacctgagcctgacagacttctgcttcagcacagtggtgacccccaagctgctggagaacctggtggtggagtaccgcaccatctccttcagcggctgcatcatgcagttctgctttgcctgcatctttggagtgacagagaccttcatgctggccgccatggcctatgacagatttgtggccgtgtgcaagcccctgctgtacaccaccatcatgagccagaagctgtgtgccctgctggtggccggcagctacacctggggcatcgtgtgcagcctcatcctgacctacttcctgctggacctgtccttctgtgagagcaccttcatcaacaacttcatctgtgaccacagcgtcatcgtgtctgccagctacagcgacccctacatcagccagaggctgtgcttcatcatcgccatcttcaatgaggtgagcagcctcatcatcatcctgaccagctacatgctgatcttcaccaccatcatgaagatgaggtctgccagcggccggcagaagaccttcagcacctgtgccagccacctgacagccatcaccatcttccacggcaccatcctcttcctgtactgtgtgcccaaccccaagaccagcagcctcatcgtgacagtggcctctgtgttctacacagtggccatccccatgctgaaccccctcatctacagcctgaggaacaaggacatcaacaacatgtttgagaagctggtggtgaccaagctgatctaccactag

SEQ ID NO: 36486 - DNA, 945 bp, Artificial Sequence
  Description of Artificial Sequence: Synthetic coding sequence
atgatgatggtgctgaggaacctgtccatggagcccacctttgccctgctgggcttcacagactaccccaagctgcagatccccctcttcctggtgttcctgctgatgtatgtgatcaccgtggtgggcaacctgggcatgatcatcatcatcaagatcaaccccaagttccacacccccatgtacttcttcctgagccacctgagctttgtggacttctgctacagcagcatcgtgacccccaagctgctggagaacctggtgatggctgacaagagcatcttctacttcagctgcatgatgcagtacttcctgagctgcacagctgtggtgacagagagcttcctgctggccgtgatggcctatgacagatttgtggccatctgcaaccccctgctgtacacagtggccatgagccagaggctgtgtgccctgctggtggccggcagctacctgtggggcatgtttggccccctggtgctgctgtgctacgccctgcggctgaacttcagcggccccaacgtcatcaaccacttcttctgtgagtacacagccctgatctctgtgtctggcagtgacatcctgatcccccacctgctgctcttctcctttgccaccttcaatgagatgtgcaccctgctgatcatcctgaccagctatgtgttcatctttgtgacagtgctgaagatccgctctgtgtctggccgccacaaggccttcagcacctgggccagccacctgaccagcatcaccatcttccacggcaccatcctcttcctgtactgtgtgcccaacagcaagaacagccggcagacagtgaaggtggcctctgtgttctacacagtggtgaaccccatgctgaaccccctcatctacagcctgaggaacaaggatgtgaaggatgccttctggaagctgatccacacccaggtgcccttccactag

SEQ ID NO: 36487 - DNA, 987 bp, Artificial Sequence
  Description of Artificial Sequence: Synthetic coding sequence
atgttcctgacagagaggaacaccaccagcgaggccaccttcaccctgctgggcttcagtgactacctggagctgcagatccccctcttctttgtgttcctggccgtgtatggcttctctgtggtgggcaacctgggcatgatcgtcatcatcaagatcaaccccaagctgcacacccccatgtacttcttcctgaaccacctgagctttgtggacttctgctacagcagcatcatcgcccccatgatgctggtgaacctggtggtggaggacaggaccatctccttcagcggctgcctggtgcagttcttcttcttctgcacctttgtggtgacagagctgatcctgtttgctgtgatggcctatgaccactttgtggccatctgcaaccccctgctgtacacagtggccatcagccagaagctgtgtgccatgctggtggtggtgctgtatgcctggggcgtggcctgcagcctgaccctggcctgcagcgccctgaagctgtccttccacggcttcaacaccatcaaccacttcttctgtgagctgagcagcctcatcagcctgagctacccagacagctacctgagccagctgctgctcttcaccgtggccaccttcaatgagatcagcaccctgctgatcatcctgaccagctatgccttcatcatcgtgaccaccctgaagatgcccagcgccagcggccacaggaaggtgttcagcacctgtgccagccacctgacagccatcaccatcttccacggcaccatcctcttcctgtactgtgtgcccaacagcaagaacagccgccacacagtgaaggtggcctctgtgttctacacagtggtgatccccctgctgaaccccctcatctacagcctgaggaacaaggatgtgaaggatgccatcaggaagatcatcaacaccaagtacttccacatcaagcaccgccactggtaccccttcaacttcgtcatcgagcagtag

SEQ ID NO: 36488 - DNA, 942 bp, Artificial Sequence
  Description of Artificial Sequence: Synthetic coding sequence
atgctgctgacagacaggaacaccagcggcaccaccttcaccctgctgggcttcagtgactacccagagctgcaggtgcccctcttcctggtgttcctggccatctacaacgtgacagtgctgggcaacatcggcctgattgtcatcatcaagatcaaccccaagctgcacacccccatgtacttcttcctgagccagctgagctttgtggacttctgctacagcagcatcatcgcccccaagatgctggtgaacctggtggtgaaggacaggaccatctccttcctgggctgtgtggtgcagttcttcttcttctgcacctttgtggtgacagagagcttcctgctggccgtgatggcctatgacagatttgtggccatctgcaaccccctgctgtacacagtgaacatgagccagaagctgtgtgtgctgctggtggtgggcagctatgcctggggcgtgtcctgcagcctggagctgacctgcagcgccctgaagctgtgcttccacggcttcaacaccatcaaccacttcttctgtgagttcagcagcctgctgagcctgagctgcagcgacacctacatcaaccagtggctgctcttcttcctggccaccttcaatgagatcagcaccctgctgattgtgctgaccagctatgccttcatcgtggtgaccatcctgaagatgaggtctgtgtctggaagaaggaaggccttcagcacctgtgccagccacctgacagccatcaccatcttccacggcaccatcctcttcctgtactgtgtgcccaacagcaagaacagccgccacacagtgaaggtggccagcgtcttctacacagtggtgatccccatgctgaaccccctcatctacagcctgaggaacaaggatgtgaaggacacagtgacagagatcctggacaccaaggtgttctcctactag

SEQ ID NO: 36489 - DNA, 945 bp, Artificial Sequence
  Description of Artificial Sequence: Synthetic coding sequence
atgaccaggaagaactacaccagcctgacagaatttgtgctgctgggcctggccgacaccctggagctgcagatcatcctcttcctgttcttcctggtgatctacaccctgactgtgctgggcaacctgggcatgatcctgctgatcagaattgacagccagctgcacacccccatgtacttcttcctggccaacctgagctttgtggatgtgtgcaacagcaccaccatcacccccaagatgctggccgacctgctgtctgagaagaagaccatcagctttgctggctgcttcctgcagatgtacttcttcatcagcctggccaccacagagtgcatcctgtttggcctgatggcctatgacagatatgctgccatctgccggcccctgctgtacagcctcatcatgagcaggacagtgtacctgaagatggccgccggggcctttgctgctggcctgctgaacttcatggtgaacaccagccacgtgagcagcctgtccttctgtgacagcaatgtcatccaccacttcttctgtgacagccccccactcttcaagctgagctgcagcgacaccatcctgaaggagagcatcagcagcatcctggccggcgtgaacatcgtgggcaccctgctggtgatcctgagcagctacagctatgtgctcttcagcatcttctccatgcacagcggggagggccgccaccgggccttcagcacctgtgccagccacctgacagccatcatcctcttctacgccacctgcatctacacctacctgcggcccagcagcagctacagcctgaaccaggacaaggtggcctctgtgttctacacagtggtgatccccatgctgaaccccctcatctacagcctgcggagcaaggaggtgaagaaggccctggccaacgtcatcagcaggaagaggaccagcagcttcctgtag

SEQ ID NO: 36490 - DNA, 933 bp, Artificial Sequence
  Description of Artificial Sequence: Synthetic coding sequence
atggaggaggagaatgccaccctgctgacagaatttgtgctgaccggcttcctgtaccagccccagtggaagatccccctcttcctggccttcctggtgatctacctgatcaccatcatgggcaacctgggcctgattgctgtgatctggaaggacccccacctgcacatccccatgtacctgctgctgggcaacctggcctttgtggatgccctgctgagcagctctgtgaccctgaagatgctgatcaacttcctggccaagagcaagatgatcagcctgtctgagtgcaagatccagctgttctcctttgccatctctgtgaccacagagtgcttcctgctggccaccatggcctatgacagatatgtggccatctgcaagcccctgctgtacccagccatcatgaccaacggcctgtgcatccggctgctgatcctgtcctatgtgggcggcctgctgcacgccctgattcatgagggcttcctgttccggctgaccttctgcaacagcaacatcatccagcacttctactgtgacatcatccccctgctgaagatctcctacacagacagcagcatcaacttcctgatggtgttcatctttgctggcagcatccaggtgttcaccatcggcaccgtgctgatctcctacatctttgtgctgtacaccatcctgaagaagaagtctgtgaagggcatgaggaaggccttcagcacctgtggggcccacctgctgtctgtgtccctgtactacggccccctggccttcatgtacatgggcagcgccagcccccaggctgatgaccaggacatgatggagagcctcttctacacagtgattgtgcccctgctgaaccccatgatctacagcctgaggaacaagcaggtgattgccagcttcaccaagatgttcaagagaaatgatgtgtag

SEQ ID NO: 36491 - DNA, 945 bp, Artificial Sequence
  Description of Artificial Sequence: Synthetic coding sequence
atgagcaatgaagacatggagcaggacaacaccaccctgctgacagaatttgtgctgaccggcctgacctaccagcctgagtggaagatgcccctcttcctggtgttcctggtgatctacctgatcaccatcgtgtggaacctgggcctgattgccctgatctggaatgacccccagctgcacatccccatgtacttcttcctgggcagcctggcctttgtggatgcctggatcagcagcacagtgacccccaagatgctggtgaacttcctggccaagaacaggatgatcagcctgtctgagtgcatgatccagttcttctcctttgcctttggaggcaccacagagtgcttcctgctggccaccatggcctatgaccgctacgtggccatctgcaagcccctgctgtaccctgtgatcatgaacaacagcctgtgcatccggctgctggccttctccttcctgggcggcttcctgcacgccctgatccacgaggtgctgatcttccggctgaccttctgcaacagcaacatcatccaccacttctactgtgacatcatccccctcttcatgatcagctgcacagaccccagcatcaacttcctgatggtgttcatcctgagcggcagcatccaggtgttcaccatcgtgacagtgctgaacagctacacctttgccctcttcaccatcctgaagaagaagtctgtgcggggcgtgaggaaggccttcagcacctgtggggcccacctgctgtctgtgtccctgtactacggccccctcatcttcatgtacctgcggcctgccagcccccaggctgatgaccaggacatgattgacagcgtcttctacaccatcatcatccccctgctgaaccccatcatctacagcctgaggaacaagcaggtgattgacagcttcaccaagatggtgaagagaaatgtgtag

SEQ ID NO: 36492 - DNA, 945 bp, Artificial Sequence
  Description of Artificial Sequence: Synthetic coding sequence
atggagttcacagacaggaactacaccctggtgacagagttcatcctgctgggcttccccaccaggcctgagctgcagatcgtgctcttcctgatgttcctgaccctgtatgccatcatcctgattggcaacatcggcctgatgctgctgatcagaattgacccccacctgcagacccccatgtacttcttcctgagcaacctgagctttgtggacctgtgctacttcagtgacatcgtgcccaagatgctggtgaacttcctgtctgagaacaagagcatctcctactacggctgtgccctgcagttctacttcttctgcacctttgctgacacagagagcttcatcctggccgccatggcctatgacagatatgtggccatctgcaaccccctgctgtacacagtggtgatgagccggggcatctgcatgaggctgattgtgctgagctacctgggcggcaacatgagcagcctggtgcacaccagctttgccttcatcctgaagtactgtgacaagaatgtcatcaaccacttcttctgtgacctgccccccctgctgaagctgagctgcacagacaccaccatcaatgagtggctgctgagcacctacggcagctctgtggagatcatctgcttcatcatcatcatcatctcctacttcttcatcctgctgtctgtgctgaagatccgctccttcagcggcaggaagaagaccttcagcacctgtgccagccacctgacctctgtgaccatctaccagggcaccctgctcttcatctacagccggcccagctacctgtacagccccaacacagacaagatcatctctgtgttctacaccatcttcatccctgtgctgaaccccctcatctacagcctgaggaacaaggatgtgaaggatgctgctgagaaggtgctgcggagcaaggtggacagcagctag

SEQ ID NO: 36493 - DNA, 939 bp, Artificial Sequence
  Description of Artificial Sequence: Synthetic coding sequence
atggctgatgacaacttcaccgtggtgacagagttcatcctgctgggcctgacagaccatgctgagctgaaggctgtgctgtttgtggtgttcctggtgatctatgccatcaccctgctgaggaacctgggcatgatcctgctgatccagatcaccagcaagctgcacacccccatgtacttcctgctgagctgcctgagctttgtggatgcctgctacagcagcgccatcgcccccaagatgctggtgaacctgctggtggtgaaggccaccatctccttcagcgcctgcatggtgcagcacctgtgcttcggggtcttcatcaccacagagggcttcctgctgtctgtgatggcctatgacagatatgtggccatcgtgagccccctgctgtacacagtggccatgtctgacagaaaatgtgtggagctggtgacaggctcctggattggaggcatcgtgaacaccctcatccacaccatcagcctgcggcggctgtccttctgccgcctgaatgctgtgagccacttcttctgtgacatccccagcctgctgaagctgagctgcagcgacacctccatgaatgagctgctgctgctgaccttctctggagtcatcgccatggccaccttcctgaccgtcatcatctcctacatcttcatcgcctttgccagcctgcgcatccacagcgccagcggccggcagcaggccttcagcacctgtgccagccacctgacagctgtgaccatcttctacggcaccctcatcttctcctacatccagcccagcagccagtactttgtggagcaggagaaggtggtgtccatgttctacaccctgggcatccccatgctgaacctgctgatccacagcctgaggaacaaggatgtgaaggaggccgtgaagagggccatcgagatgaagcacttcctgtgctag

SEQ ID NO: 36494 - DNA, 927 bp, Artificial Sequence
  Description of Artificial Sequence: Synthetic coding sequence
atggccgaggagaaccacaccatgaagaatgagttcatcctgaccggcttcacagaccaccctgagctgaagaccctgctgtttgtggtgttctttgccatctacctgatcaccgtggtgggcaacatcagcctggtggccctgatcttcacccaccggcggctgcacacccccatgtacatcttcctgggcaacctggccctggtggacagctgctgtgcctgtgccatcacccccaagatgctggagaacttcttcagcgagaacaagaggatcagcctgtatgaatgtgctgtgcagttctacttcctgtgcaccgtggagacagctgactgcttcctgctggccgccatggcctatgacagatatgtggccatctgcaaccccctgcagtaccacatcatgatgagcaagaagctgtgcatccagatgaccaccggggccttcatcgccggcaacctgcacagcatgattcatgtgggcctggtgttccggctggtgttctgtggcagcaaccacatcaaccacttctactgtgacatcctgcccctgtaccgcctgagctgtgtggacccctacatcaatgagctggtgctcttcatcttcagcggctctgtgcaggtgttcaccatcggctctgtgctgatctcctacctgtacatcctgctgaccatcttcaagatgaagagcaaggagggccgggccaaggccttcagcacctgtgccagccacttcctgtctgtgtccctcttctacggcagcctcttcttcatgtatgtgcggcccaacctgctggaggagggggacaaggacatcccagctgccatcctcttcaccatcgtggtgcccctgctgaaccccttcatctacagcctgaggaaccgggaggtgatctctgtgctgaggaagatcctgatgaagaagtag

SEQ ID NO: 36495 - DNA, 951 bp, Artificial Sequence
  Description of Artificial Sequence: Synthetic coding sequence
atggtggaggagaaccacaccatgaagaatgagttcatcctgaccggcttcacagaccaccctgagctgaagaccctgctgtttgtggtgttctttgccatctacctgatcaccgtggtgggcaacatcagcctggtggccctgatcttcacccactgccgcctgcacacccccatgtacatcttcctgggcaacctggccctggtggacagctgctgtgcctgtgccatcacccccaagatgctggagaacttcttcagcgagggcaagaggatcagcctgtatgaatgtgctgtgcagttctacttcctgtgcaccgtggagacagctgactgcttcctgctggccgctgtggcctatgacagatatgtggccatctgcaaccccctgcagtaccacatcatgatgagcaagaagctgtgcatccagatgaccaccggggccttcatcgccggcaacctgcacagcatgattcatgtgggcctggtgttccggctggtgttctgtggcctgaaccacatcaaccacttctactgtgacaccctgcccctgtaccgcctgagctgtgtggaccccttcatcaatgagctggtgctcttcatcttcagcggctctgtgcaggtgttcaccatcggctctgtgctgatctcctacctgtacatcctgctgaccatcttcaggatgaagagcaaggagggccgggccaaggccttcagcacctgtgccagccacttcagctctgtgtccctcttctacggcagcatcttcttcctgtacatccggcccaacctgctggaggagggcggcaatgacatcccagctgccatcctcttcaccatcgtggtgcccctgctgaaccccttcatctacagcctgaggaacaaggaggtgatctctgtgctgaggaagatcctgctgaagatcaagagccagggctctgtgaacaagtag

SEQ ID NO: 36496 - DNA, 966 bp, Artificial Sequence
  Description of Artificial Sequence: Synthetic coding sequence
atggcccgggagaaccacagcctggccgctgagttcatcctgattggcttcaccaactacccagagctgaagaccctgctgtttgtggtgttcagcgccatctacctggtgaccatggtgggcaacctgggcctggtggccctgatctacgtggagcggcggctgctgacccccatgtacatcttcctgggcaacctggccctgatggacagctgctgcagctgtgctgtgacccccaagatgctggagaacttcttcagcgaggaccgcatcatcagcctgtatgagtgcatggcccagttctacttcctgtgcctggccgagaccacagactgcttcctgctggccaccatggcctatgacagatatgtggccatctgccaccccctgcagtaccacaccatgatgagcaagaccctgtgcatccgcatgaccaccggggccttcaaggccggcaacctgcacagcatgattcatgtgggcctgctgctgcggctgaccttctgccgcagcaacaagatccaccacttcttctgtgacatcctgcccctgtaccgcctgagctgcacagaccccagcatcaatgagctgatgatctacatcttcagcatccccatccagatcttcaccatcgccaccgtgctgatctcctacctgtgcatcctgctgaccgtcttcaagatgaagagcaaggagggccggggcaaggccttcagcacctgtgccagccacttcctgtctgtgtccatcttctacatctgcctgctgatgtacatcggccccagcgaggagggggacaaggacacccctgtggccatcttctacgccatcgtcatccccctgctgaaccccttcatctacagcctgaggaacaaggaggtgatcaacgtgctgaagaagatcatgaggaactacaacatcctgaagcagacctgcagcatcgccaacctcttcctgatctactag

SEQ ID NO: 36497 - DNA, 936 bp, Artificial Sequence
  Description of Artificial Sequence: Synthetic coding sequence
atgggcaaggagaactgcaccaccgtggccgagttcatcctgctgggcctgagtgatgtgcctgagctgcgggtgtgcctcttcctgctcttcctgctgatctatggagtgaccctgctggccaacctgggcatgattgccctgatccaggtgagcagccggctgcacacccccatgtacttcttcctgagccacctgagctctgtggacttctgctacagcagcatcatcgtgcccaagatgctggccaacatcttcaacaaggacaaggccatctccttcctgggctgcatggtgcagttctacctgttctgcacctgtgtggtgacagaggtgttcctgctggccgtgatggcctatgacagatttgtggccatctgcaaccccctgctgtacacagtgaccatgtcctggaaggtgcgggtggagctggccagctgctgctacttctgtggcaccgtgtgcagcctcatccacctgtgcctggccctgcgcatccccttctaccgcagcaatgtcatcaaccacttcttctgtgacctgccccctgtgctgagcctggcctgcagcgacatcaccgtgaatgagaccctgctcttcctggtggccaccctgaatgaatctgtgaccatcatgatcatcctgaccagctacctgctgatcctgaccaccatcctgaagatgggcagcgctgagggccgccacaaggccttcagcacctgtgccagccacctgacagccatcaccgtcttccacggcaccgtgctgagcatctactgccggcccagcagcggcaacagcggagatgctgacaaggtggccaccgtcttctacacagtggtgatccccatgctgaacagcgtcatctacagcctgaggaacaaggatgtgaaggaggccctgaggaaggtgatgggcagcaagatccacagctag

SEQ ID NO: 36498 - DNA, 936 bp, Artificial Sequence
  Description of Artificial Sequence: Synthetic coding sequence
atgggcaaggagaactgcaccaccgtggccgagttcatcctgctgggcctgagtgatgtgcctgagctgcgggtgtgcctcttcctgctcttcctgctgatctatggagtgaccctgctggccaacctgggcatgacagccctgatccaggtgagcagccggctgcacacccctgtgtacttcttcctgagccacctgagctttgtggacttctgctacagcagcatcatcgtgcccaagatgctggccaacatcttcaacaaggacaaggccatctccttcctgggctgcatggtgcagttctacctgttctgcacctgtggggtgacagaggtgttcctgctggccgtgatggcctatgacagatttgtggccatctgcaaccccctgctgtacatggtgaccatgagccagaagctgcgggtggagctgaccagctgctgctacttctgtggcaccgtgtgcagcctcatccacagcagcctggccctgcgcatcctcttctaccgcagcaatgtcatcaaccacttcttctgtgacctgccccccctgctgagcctggcctgcagtgatgtgacagtgaatgagaccctgctcttcctggtggccaccctgaatgaatctgtgaccatcatgatcatcctgaccagctacctgctgatcctgaccaccatcctgaagatccacagcgctgagagccgccacaaggccttcagcacctgtgccagccacctgacagccatcaccgtgagccacggcaccatcctgtacatctactgccggcccagcagcggcaacagcggagatgtggacaaggtggccaccgtcttctacacagtggtgatccccatgctgaaccccctcatctacagcctgaggaacaaggatgtgaacaaggccctgaggaaggtgatgggcagcaagatccacagctag

SEQ ID NO: 36499 - DNA, 948 bp, Artificial Sequence
  Description of Artificial Sequence: Synthetic coding sequence
atgttcagccccaaccacaccatcgtgacagagttcatcctgctgggcctgacagatgatcctgtgctggagaagatcctgtttggagtcttcctggccatctacctgatcaccctggccggcaacctgtgcatgatcctgctgatccgcaccaacagccacctgcagacccccatgtacttcttcctgggccacctgagctttgtggacatctgctacagcagcaatgtgacccccaacatgctgcacaacttcctgtctgagcagaagaccatctcctatgccggctgcttcacccagtgcctgctcttcatcgccctggtgatcacagagttctacatcctggcctccatggccctggacagatatgtggccatctgcagccccctgcactacagcagcaggatgagcaagaacatctgtgtgtgcctggtgaccatcccctacatgtatggcttcctgagcggcttcagccagagcctgctgaccttccacctgtccttctgtggcagcctggagatcaaccacttctactgtgccgaccccccactcatcatgctggcctgcagcgacaccagggtgaagaagatggccatgtttgtggtggccggcttcaacctgagcagcagcctcttcatcatcctgctgagctacctgttcatctttgctgccatcttccgcatccgctctgctgagggccgccacaaggccttcagcacctgtgccagccacctgaccatcgtgaccctcttctacggcaccctcttctgcatgtatgtgcggccccccagcgagaagtctgtggaggagagcaagatcacagctgtgttctacaccttcctgagccccatgctgaaccccctcatctacagcctgaggaacacagatgtgatcctggccatgcagcagatgatccggggcaagagcttccacaagattgctgtgtag

SEQ ID NO: 36500 - DNA, 948 bp, Artificial Sequence
  Description of Artificial Sequence: Synthetic coding sequence
atgctgagccccaaccacaccatcgtgacagagttcatcctgctgggcctgacagatgatcctgtgctggagaagatcctgtttggagtcttcctggccatctacctgatcaccctggccggcaacctgtgcatgatcctgctgatccgcaccaacagccagctgcagacccccatgtacttcttcctgggccacctgagctttgtggacatctgctacagcagcaatgtgacccccaacatgctgcacaacttcctgtctgagcagaagaccatctcctatgccggctgcttcacccagtgcctgctcttcatcgccctggtgatcacagagttctacttcctggcctccatggccctggacagatatgtggccatctgcagccccctgcactacagcagcaggatgagcaagaacatctgcatcagcctggtgacagtgccctacatgtatggcttcctgaatggcctgagccagaccctgctgaccttccacctgtccttctgtggcagcctggagatcaaccacttctactgtgccgaccccccactcatcatgctggcctgcagcgacaccagggtgaagaagatggccatgtttgtggtggccggcttcaccctgagcagcagcctcttcatcatcctgctgagctacctgttcatctttgctgccatcttccgcatccgctctgctgagggccgccacaaggccttcagcacctgtgccagccacctgaccatcgtgaccctcttctacggcaccctcttctgcatgtatgtgcggccccccagcgagaagtctgtggaggagagcaagatcatcgctgtgttctacaccttcctgagccccatgctgaaccccctcatctacagcctgaggaacagagatgtgatcctggccatccagcagatgatccggggcaagagcttctgcaagattgctgtgtag

SEQ ID NO: 36501 - DNA, 918 bp, Artificial Sequence
  Description of Artificial Sequence: Synthetic coding sequence
atgagcaacaccaatggaagtgccatcacagagttcatcctgctgggcctgacagactgcccagagctgcagagcctgctgtttgtgctcttcctggtggtgtacctggtgaccctgctgggcaacctgggcatgatcatgctgatgaggctggacagccggctgcacacccccatgtacttcttcctgaccaacctggcctttgtggacctgtgctacaccagcaatgccaccccccagatgagcaccaacatcgtgtctgagaagaccatcagctttgctggctgcttcacccagtgctacatcttcatcgccctgctgctgacagagttctacatgctggccgccatggcctatgaccgctacgtggccatctatgaccccctgcgctacagcgtgaagaccagcagaagagtgtgcatctgcctggccaccttcccctacgtgtatggcttcagtgatggcctcttccaggccatcctgaccttccggctgaccttctgccgcagcagcgtcatcaaccacttctactgtgccgaccccccactcatcaagctgagctgcagcgacacctacgtgaaggagcacgccatgttcatctctgctggcttcaacctgagcagcagcctgaccatcgtgctggtgtcctatgccttcatcctggccgccatcctgcgcatcaagtctgctgagggccgccacaaggccttcagcacctgtggcagccacatgatggctgtgaccctcttctacggcaccctcttctgcatgtacatccggcccccaacagacaagacagtggaggagagcaagatcatcgctgtgttctacacctttgtgtcccctgtgctgaaccccctcatctacagcctgaggaacaaggatgtgaagcaggccctgaagaatgtgctgaggtag

SEQ ID NO: 36502 - DNA, 924 bp, Artificial Sequence
  Description of Artificial Sequence: Synthetic coding sequence
atgctgaacttcacagatgtgacagagttcatcctgctgggcctgaccagccggcgggagtggcaggtgctcttcttcatcatcttcctggtggtgtacatcatcaccatggtgggcaacatcggcatgatggtgctgatcaaggtgagcccccagctgaacaaccccatgtacttcttcctgagccacctgagctttgtggatgtgtggttcagcagcaatgtgacccccaagatgctggagaacctgctgagtgacaagaagaccatcacctacgccggctgcctggtgcagtgcttcttcttcatcgccctggtgcacgtggagatcttcatcctggccgccatggcctttgaccgctacatggccatcggcaaccccctgctgtatggcagcaagatgagccgggtggtgtgcatccgcctcatcaccttcccctacatctacggcttcctgaccagcctggccgccaccctgtggacctacggcctgtacttctgtgggaagattgagatcaaccacttctactgtgccgaccccccactcatcaagatggcctgtgccggcacctttgtgaaggagtacaccatgatcatcctggccggcatcaacttcacctacagcctgaccgtcatcatcatctcctacctgttcatcctgattgccatcctgaggatgaggtctgctgagggccggcagaaggccttcagcacctgtggcagccacctgacagctgtgatcatcttctacggcaccctcatcttcatgtacctgcggcggcccacagaggagagcgtggagcagggcaagatggtggccgtgttctacaccaccgtcatccccatgctgaaccccatgatctacagcctgaggaacaaggatgtgaagaaggccatgatgaaggtgatcagccgcagctgctag

SEQ ID NO: 36503 - DNA, 936 bp, Artificial Sequence
  Description of Artificial Sequence: Synthetic coding sequence
atgagaagaaactgcaccctggtgacagagttcatcctgctgggcctgaccagcagaagagagctgcagatcctgctcttcaccctcttcctggccatctacatggtgacagtggccggcaacctgggcatgattgtgctgatccaggccaatgcctggctgcacatgcccatgtacttcttcctgagccacctgagctttgtggacctgtgcttcagcagcaatgtgacccccaagatgctggagatcttcctgtctgagaagaagagcatctcctacccagcctgcctggtgcagtgctacctgttcatcgccctggtgcacgtggagatctacatcctggccgtgatggcctttgaccgctacatggccatctgcaaccccctgctgtatggcagcaggatgagcaagtctgtgtgcagcttcctgatcaccgtgccctacgtgtatggagccctgaccggcctgatggagaccatgtggacctacaacctggccttctgtggccccaatgagatcaaccacttctactgtgccgaccccccactcatcaagctggcctgcagcgacacctacaacaaggagctgtccatgttcatcgtggccggctggaacctgtccttcagcctcttcatcatctgcatctcctacctgtacatcttccctgccatcctgaagatccgcagcacagagggccggcagaaggccttcagcacctgtggcagccacctgacagctgtgaccatcttctacgccaccctcttcttcatgtacctgcggccccccagcaaggagagcgtggagcagggcaagatggtggccgtgttctacaccaccgtcatccccatgctgaacctgatcatctacagcctgaggaacaagaatgtgaaggaggccctgatcaaggagctgtccatgaagatctacttctcctag

SEQ ID NO: 36504 - DNA, 933 bp, Artificial Sequence
  Description of Artificial Sequence: Synthetic coding sequence
atgcccaacttcacagatgtgacagagttcaccctgctgggcctgacctgccggcaggagctgcaggtgctcttctttgtggtgttcctggccgtgtacatgatcaccctgctgggcaacatcggcatgatcatcctgatcagcatcagcccccagctgcagagccccatgtacttcttcctgagccacctgagctttgctgatgtgtgcttcagcagcaatgtgacccccaagatgctggagaacctgctgtctgagaccaagaccatctcctatgtgggctgcctggtgcagtgctacttcttcatcgctgtggtgcacgtggaggtgtacatcctggccgtgatggcctttgaccgctacatggccggctgcaaccccctgctgtatggcagcaagatgagcaggacagtgtgtgtgcggctcatctctgtgccctacgtgtatggcttctctgtgtccctcatctgcaccctgtggacctacggcctgtacttctgtggcaactttgagatcaaccacttctactgtgccgaccccccactcatccagatcgcctgtggccgggtgcacatcaaggagatcaccatgattgtgattgctggcatcaacttcacctacagcctgtctgtggtgctgatctcctacaccctgattgtggtggccgtgctgaggatgaggtctgcagatggccgcaggaaggccttcagcacctgtggcagccacctgacagctgtgtccatgttctacggcacccccatcttcatgtacctgcggcggcccacagaggagagcgtggagcagggcaagatggtggccgtgttctacaccaccgtcatccccatgctgaaccccatgatctacagcctgaggaacaaggatgtgaaggaggccgtgaacaaggccatcaccaagacctacgtgcggcagtag

SEQ ID NO: 36505 - DNA, 969 bp, Artificial Sequence
  Description of Artificial Sequence: Synthetic coding sequence
atgaacagcctgaaggatggcaaccacacagccctgaccggcttcatcctgctgggcctgacagatgaccccatcctgcgggtcatcctcttcatgatcatcctgagcggcaacctgagcatcatcatcctgatccgcatcagcagccagctgcaccaccccatgtacttcttcctgagccacctggcctttgctgacatggcctacagcagctctgtgacccccaacatgctggtgaacttcctggtggagaggaacacagtgtcctacctgggctgtgccatccagctgggcagcgctgccttctttgccaccgtggagtgtgtgctgctggccgccatggcctatgacagatttgtggccatctgcagccccctgctgtacagcaccaagatgagcacccaggtgtctgtgcagctgctgctggtggtgtacatcgccggcttcctgattgctgtgtcctacaccaccagcttctacttcctgctcttctgtggccccaaccaggtgaaccacttcttctgtgactttgcccccctgctggagctgagctgcagcgacatctctgtgtccacagtggtgctgtccttcagcagcggcagcatcatcgtggtgacagtgtgtgtgattgctgtgtgctacatctacatcctgatcaccatcctgaagatgaggagcacagagggccaccacaaggccttcagcacctgcaccagccacctgactgtggtgaccctcttctacggcaccatcaccttcatctacgtgatgcccaacttctcctacagcacagaccagaacaaggtggtgtctgtgctgtacacagtggtgatccccatgctgaaccccctcatctacagcctgaggaacaaggagatcaagggggccctgaagcgggagctggtgaggaagatcctgagccatgatgcctgctacttcagcaggaccagcaacaatgacatcacctag

SEQ ID NO: 36506 - DNA, 936 bp, Artificial Sequence
  Description of Artificial Sequence: Synthetic coding sequence
atgggcactggaaatgacaccaccgtggtggagttcaccctgctgggcctgtctgaggacaccaccgtgtgtgccatcctcttcctggtgttcctgggcatctacgtggtgaccctgatgggcaacatcagcatcatcgtgctgatccgccgcagccaccacctgcacacccccatgtacatcttcctgtgccacctggcctttgtggacatcggctacagcagctctgtgacccctgtgatgctgatgtccttcctgaggaaggagaccagcctgcctgtggccggctgtgtggcccagctgtgcagcgtggtgacctttggaacagctgagtgcttcctgctggccgccatggcctatgacagatatgtggccatctgcagccccctgctgtacagcacctgcatgagccctggggtgtgcatcatcctggtgggcatgagctacctgggcggctgtgtgaatgcctggaccttcatcggctgcctgctgcggctgtccttctgtggccccaacaaggtgaaccacttcttctgtgactacagccccctgctgaagctggcctgcagccatgacttcacctttgagatcatcccagccatcagcagcggcagcatcatcgtggccaccgtgtgtgtgattgccatctcctacatctacatcctgatcaccatcctgaagatgcacagcaccaagggccgccacaaggccttcagcacctgcaccagccacctgacagctgtgaccctcttctacggcaccatcaccttcatctacgtgatgcccaagagcagctacagcacagaccagaacaaggtggtgtctgtgttctacacagtggtgatccccatgctgaaccccctcatctacagcctgaggaacaaggagatcaagggggccctgaagcgggagctgcgcatcaagatcttctcctag

SEQ ID NO: 36507 - DNA, 975 bp, Artificial Sequence
  Description of Artificial Sequence: Synthetic coding sequence
atggccgaggtgaacatcatctacgtgaccgtcttcatcctgaagggcatcaccaacagacctgagctgcaggccccctgcttcggggtcttcctggtgatctacctggtgacagtgctgggcaacctgggcctcatcaccctcatcaagattgacacccggctgcacacccccatgtactacttcctgagccacctggcctttgtggacctgtgctacagcagcgccatcacccccaagatgatggtgaactttgtggtggagaggaacaccatccccttccacgcctgtgccacccagctgggctgcttcctgaccttcatgatcacagagtgcttcctgctggcctccatggcctatgactgctacgtggccatctgcagccccctgcactacagcaccctgatgagccggcgggtgtgcatccagctggtggccgtgccctacatctacagcttcctggtggccctcttccacacagtcatcaccttccggctgacctactgcggccccaacctgatcaaccacttctactgtgatgacctgcccttcctggccctgagctgcagcgacacccacatgaaggagatcctgatctttgcctttgctggctttgacatgatcagcagcagcagcatcgtgctgaccagctacatcttcatcatcgccgccatcctgcgcatccgcagcacccagggccagcacaaggccatcagcacctgtggcagccacatggtgacagtgaccatcttctacggcaccctcatcttcatgtacctgcagcccaagagcaaccacagcctggacacagacaagatggcctctgtgttctacacagtggtgatccccatgctgaaccccctcatctacagcctgaggaacaaggaggtgaaggatgccagcaagaaggccctggacaagggctgtgagaacctgcagatcctgaccttcctgaagatcaggaagctgtactag

SEQ ID NO: 36508 - DNA, 981 bp, Artificial Sequence
  Description of Artificial Sequence: Synthetic coding sequence
atgagcggcctgcccagcgacatggacctgtacaagctgcagctgaacaacttcacagaggtgaccatgttcatcctgatctccttcacagaggagtttgatgtgcaggtgttcctgttcctgctcttcctggccatctacctgttcaccctcatcggcaacctgggcctggtggtgcccatcatcggggacttctggctgcacagccccatgtactacttcctgggcgtgctgtccttcctggatgtgtgctacagcacagtggtgacccccaagatgctggtgaacttcctggccaagaacaagagcatctccttcctgggctgtgccacccagatgttcctggcctgcaccttcggcaccacagagtgcttcctgctggccgccatggcctatgacagatatgtggccatctacaaccccctgctgtacagcgtgtccatgagcccccgggtgtatgtgcccctcatcacagccagctatgtggccagcatcctgcacgccaccatccacacagtggccaccttcagcctgtccttctgtggcagcaatgagatccgccacgtgttctgcaacatgccacccctgctggccatcagctgcagcgacacccacgtgatccagctgctcttcttctactttgtgggcagcattgagatcgtgaccatcctgattgtgctgatctcctatggcttcatcctgctggccatcctgaagatgcagagcgctgagggccgcaggaaggtgttcagcacctgtggggcccacctgactggagtgaccatctaccacggcaccatcctcttcatgtatgtgcggcccagcagcagctacaccagtgacaatgacatgattgtgtccatcttctacaccatcgtcatccccatgctgaaccccatcatctacagcctgaggaacaaggatgtgaaggaggccatcaagaggctgctggtgaggaactggttcatcaacaagctgtag

SEQ ID NO: 36509 - DNA, 1080 bp, Artificial Sequence
  Description of Artificial Sequence: Synthetic coding sequence
atgagctacagcatctacaagagcacagtgaacatccccctgagccacggcgtggtgcacagcttctgccacaacatgaactgcaacttcatgcacatcttcaagtttgtgctggacttcaacatgaagaatgtgacagaggtgaccctgtttgtgctgaagggcttcacagacaacctggagctgcagaccatcttcttcttcctgttcctggccatctacctgttcaccctgatgggcaacctgggcctcatcctggtggtgatccgggacagccagctgcacaagcccatgtactacttcctgtccatgctgagctctgtggatgcctgctacagcagcgtcatcacccccaacatgctggtggacttcaccaccaagaacaaggtgatctccttcctgggctgtgtggcccaggtgttcctggcctgcagctttggcaccacagagtgcttcctgctggccgccatggcctatgaccgctacgtggccatctacaaccccctgctgtacagcgtgtccatgagcccccgggtgtacatgcccctcatcaatgccagctatgtggccggcatcctgcacgccaccatccacacagtggccaccttcagcctgtccttctgtggggccaatgagatccggcgggtcttctgtgacatcccccccctgctggccatctcctacagcgacacccacaccaaccagctgctgctcttctactttgtgggcagcattgagctggtgaccatcctgattgtgctgatctcctatggcctcatcctgctggccatcctgaagatgtacagcgctgagggccgcaggaaggtgttcagcacctgtggggcccacctgactggagtgtccatctactacggcaccatcctcttcatgtatgtgcggcccagcagcagctatgccagtgaccatgacatgattgtgtccatcttctacaccatcgtcatccccctgctgaaccctgtgatctacagcctgaggaacaaggatgtgaaggacagcatgaagaagatgtttgggaagaaccaggtgatcaacaaggtgtacttccacaccaagaagtag

SEQ ID NO: 36510 - DNA, 1023 bp, Artificial Sequence
  Description of Artificial Sequence: Synthetic coding sequence
atggacagcaccttcaccggctacaacctgtacaacctgcaggtgaagacagagatggacaagctgagcagcggcctggacatctacagaaaccccctgaagaacaagacagaggtgaccatgttcatcctgaccggcttcacagatgactttgagctgcaggtgttcctgttcctgctcttctttgccatctacctgttcaccctcatcggcaacctgggcctggtggtgctggtgattgaagattcctggctgcacaaccccatgtactacttcctgtctgtgctgtccttcctggatgcctgctacagcacagtggtgacccccaagatgctggtgaacttcctggccaagaacaagagcatctccttcatcggctgtgccacccagatgctgctgtttgtgaccttcggcaccacagagtgcttcctgctggccgccatggcctatgaccactacgtggccatctacaaccccctgctgtacagcgtgtccatgagcccccgggtgtatgtgcccctcatcacagccagctatgtggccggcatcctgcacgccaccatccacatcgtggccaccttcagcctgtccttctgtggcagcaatgagatccgccacgtgttctgtgacatgccacccctgctggccatcagctgcagcgacacccacaccaaccagctgctgctcttctactttgtgggcagcattgagatcgtgaccatcctgattgtgctgatcagctgtgacttcatcctgctgagcatcctgaagatgcacagcgccaagggccggcagaaggccttcagcacctgtggcagccacctgactggagtgaccatctaccacggcaccatcctggtgtcctacatgaggcccagcagcagctatgccagtgaccatgacatcatcgtgtccatcttctacaccatcgtcatccccaagctgaaccccatcatctacagcctgaggaacaaggaggtgaagaaggctgtgaagaagatgctgaagctggtgtacaagtag

SEQ ID NO: 36511 - DNA, 966 bp, Artificial Sequence
  Description of Artificial Sequence: Synthetic coding sequence
atggagaggaagaaccagacagccatcacagagttcatcatcctgggcttcagcaacctgaatgagctgcagttcctgctcttcaccatcttcttcctgacctacttctgcaccctgggcggcaacatcctgatcatcctgaccaccgtgacagacccccacctgcacacccccatgtactacttcctgggcaacctggccttcatcgacatctgctacaccaccagcaatgtgccccagatgatggtgcacctgctgagcaagaagaagagcatctcctatgtgggctgtgtggtgcagctgtttgcctttgtgttctttgtgggctctgaatgtctgctgctggccgccatggcctatgaccgctacatcgccatctgcaaccccctgcgctacagcgtcatcctgagcaaggtgctgtgcaaccagctggccgccagctgctgggccgccggcttcctgaacagcgtggtgcacacagtgctgaccttctgcctgcccttctgtggcaacaaccagatcaactacttcttctgtgacatcccccccctgctgatcctgagctgtggcaacacctctgtgaatgagctggccctgctgagcactggagtcttcatcggctggacccccttcctgtgcatcgtgctgagctacatctgcatcatcagcaccatcctgcgcatccagagcagcgagggccgcaggaaggccttcagcacctgtgccagccacctggccatcgtgttcctgttctacggcagcgccatcttcacctacgtgcggcccatcagcacctacagcctgaagaaggaccggctggtgtctgtgctgtacagcgtggtgacccccatgctgaaccccatcatctacaccctgaggaacaaggacatcaaggaggccgtgaagaccatcggcagcaagtggcagccccccatcagcagcctggacagcaagctgacctactag

SEQ ID NO: 36512 - DNA, 966 bp, Artificial Sequence; identical to SEQ ID NO: 36511
  Description of Artificial Sequence: Synthetic coding sequence

SEQ ID NO: 36513 - DNA, 966 bp, Artificial Sequence; identical to SEQ ID NO: 36511
  Description of Artificial Sequence: Synthetic coding sequence

SEQ ID NO: 36514 - DNA, 966 bp, Artificial Sequence; identical to SEQ ID NO: 36511
  Description of Artificial Sequence: Synthetic coding sequence

SEQ ID NO: 36515 - DNA, 966 bp, Artificial Sequence; identical to SEQ ID NO: 36511
  Description of Artificial Sequence: Synthetic coding sequence

SEQ ID NO: 36516 - DNA, 966 bp, Artificial Sequence; identical to SEQ ID NO: 36511
  Description of Artificial Sequence: Synthetic coding sequence

SEQ ID NO: 36517 - DNA, 966 bp, Artificial Sequence; identical to SEQ ID NO: 36511
  Description of Artificial Sequence: Synthetic coding sequence

SEQ ID NO: 36518 - DNA, 966 bp, Artificial Sequence; identical to SEQ ID NO: 36511
  Description of Artificial Sequence: Synthetic coding sequence

SEQ ID NO: 36519 - DNA, 966 bp, Artificial Sequence; identical to SEQ ID NO: 36511
  Description of Artificial Sequence: Synthetic coding sequence

SEQ ID NO: 36520 - DNA, 933 bp, Artificial Sequence
  Description of Artificial Sequence: Synthetic coding sequence
atggactgggagaactgcagcagcctgacagacttcttcctgctgggcatcaccaacaaccctgagatgaaggtgaccctgtttgctgtgttcctggccgtgtacatcatcaacttcagcgccaacctgggcatgattgtgctgatccgcatggactaccagctgcacacccccatgtacttcttcctgagccacctgtccttctgtgacctgtgctacagcacagccaccggccccaagatgctggtggacctgctggccaagaacaagagcatccccttctacggctgtgccctgcagttcctggtgttctgcatctttgctgacagtgaatgtctgctgctgtctgtgatggcctttgaccgctacaaggccatcatcaaccccctgctgtacacagtgaacatgagcagccgggtgtgctacctgctgctgactggagtgtacctggtgggcattgctgatgccctgatccacatgaccctggccttccggctgtgcttctgtggcagcaatgagatcaaccacttcttctgtgacatcccccccctgctgctgctgagcagaagtgacacccaggtgaatgagctggtgctcttcaccgtgtttggcttcatcgagctgagcaccatcagcggggtcttcatctcctactgctacatcatcctgtctgtgctggagatccacagcgctgagggccgcttcaaggccctgagcacctgcaccagccacctgtctgctgtggccatcttccagggcaccctgctcttcatgtacttccggcccagcagcagctacagcctggaccaggacaagatgaccagcctcttctacaccctggtggtgcccatgctgaaccccctcatctacagcctgaggaacaaggatgtgaaggaggccctgaagaagctgaagaacaagatcctcttctag

SEQ ID NO: 36521 - DNA, 942 bp, Artificial Sequence
  Description of Artificial Sequence: Synthetic coding sequence
atgagcatcatcaacaccagctatgtggagatcaccaccttcttcctggtgggcatgcctggcctggagtatgcccacatctggatcagcatccccatctgcagcatgtacctgattgccatcctgggcaatggcaccatcctcttcatcatcaagacagagcccagcctgcacggccccatgtactacttcctgtccatgctggccatgtctgacctgggcctgagcctgagcagcctgcccaccgtgctgagcatcttcctgttcaatgcccctgagaccagcagcagcgcctgctttgcccaggagttcttcatccacggcttctctgtgctggagagctctgtgctgctgatcatgagctttgaccgcttcctggccatccacaaccccctgcgctacaccagcatcctgaccaccgtgcgggtggcccagatcggcatcgtgttctccttcaagtccatgctgctggtgctgcccttccccttcaccctgcggagcctgcgctactgcaagaagaaccagctgagccacagctactgcctgcaccaggatgtgatgaagctggcctgcagcgacaacagaattgatgtgatctacggcttctttggagccctgtgcctgatggtggacttcatcctgattgctgtgtcctacaccctcatcctgaagacagtgcccggcatcgccagcaagaaggaggagctgaaggccctgaacacctgtgtgagccacatctgtgccgtcatcatcttctacctgcccatcatcaacctggccgtggtgcacagatttgctggccacgtgagccccctcatcaacgtgctgatggccaacgtgctgctgctggtgccccccctgatgaagcccatcgtgtactgtgtgaagaccaagcagatccgggtgcgggtggtggccaagctgtgccagtggaagatctag

SEQ ID NO: 36522 - DNA, 942 bp, Artificial Sequence
  Description of Artificial Sequence: Synthetic coding sequence
atgagcatcatcaacaccagctatgtggagatcaccaccttcttcctggtgggcatgcctggcctggagtatgcccacatctggatcagcatccccatctgcagcatgtacctgattgccatcctgggcaatggcaccatcctcttcatcatcaagacagagcccagcctgcacgagcccatgtactacttcctgtccatgctggccatgtctgacctgggcctgagcctgagcagcctgcccaccgtgctgagcatcttcctgttcaatgcccctgagatcagcagcaatgcctgctttgcccaggagttcttcatccacggcttctctgtgctggagagctctgtgctgctgatcatgagctttgaccgcttcctggccatccacaaccccctgcgctacaccagcatcctgaccaccgtgcgggtggcccagatcggcatcgtgttctccttcaagtccatgctgctggtgctgcccttccccttcaccctgaggaacctgcgctactgcaagaagaaccagctgagccacagctactgcctgcaccaggatgtgatgaagctggcctgcagcgacaacagaattgatgtgatctacggcttctttggagccctgtgcctgatggtggacttcatcctgattgctgtgtcctacaccctcatcctgaagacagtgctgggcatcgccagcaagaaggagcagctgaaggccctgaacacctgtgtgagccacatctgtgccgtcatcatcttctacctgcccatcatcaacctggccgtggtgcacagatttgcccggcacgtgagccccctcatcaacgtgctgatggccaacgtgctgctgctggtgccccccctgaccaaccccatcgtgtactgtgtgaagaccaagcagatccgggtgcgggtggtggccaagctgtgccagaggaagatctag

SEQ ID NO: 36523 - DNA, 939 bp, Artificial Sequence
  Description of Artificial Sequence: Synthetic coding sequence
atgtctgtgctgaacaacagcgaggtgaagctgttcctgctgattggcatccctggcctggagcacgcccacatctggttcagcatccccatctgcctgatgtacctgctggccatcatgggcaactgcaccatcctcttcatcatcaagacagagcccagcctgcacgagcccatgtactacttcctggccatgctggccgtgtctgacatgggcctgagcctgagcagcctgcccaccatgctgcgggtcttcctgttcaatgccatgggcatcagccccaatgcctgctttgcccaggagttcttcatccacggcttcaccgtgatggagagctctgtgctgctgatcatgagcctggaccgcttcctggccatccacaaccccctgcgctacagcagcatcctgaccagcaacagagtggccaagatgggcctcatcctggccatccgcagcatcctgctggtgatccccttccccttcaccctgcggcggctgaagtactgccagaagaacctgctgagccacagctactgcctgcaccaggacaccatgaagctggcctgcagcgacaacaagaccaacgtcatctacggcttcttcatcgccctgtgcaccatgctggacctggccctgattgtgctgtcctatgtgctgatcctgaagaccatcctgagcatcgccagcctggccgagcggctgaaggccctgaacacctgtgtgagccacatctgtgctgtgctgaccttctacgtgcccatcatcaccctggccgccatgcaccactttgccaagcacaagagccccctggtggtgatcctgattgctgacatgttcctgctggtgccccccctgatgaaccccatcgtgtactgtgtgaagacccggcagatctgggagaagatcctgggcaagctgctgaatgtgtgtggccgctag

SEQ ID NO: 36524 - DNA, 894 bp, Artificial Sequence
  Description of Artificial Sequence: Synthetic coding sequence
ttcctgctgattggcatccctggcctggagcacgcccacatctggttcagcatccccatctgcctgatgtacctgctggccatcatgggcaactgcaccatcctcttcatcatcaagacagagcccagcctgcacgagcccatgtactacttcctggccatgctggccgtgtctgacatgggcctgagcctgagcagcctgcccaccatgctgcgggtcttcctgttcaatgccatgggcatcagccccaatgcctgctttgcccaggagttcttcatccacggcttcaccgtgatggagagctctgtgctgctgatcatgagcctggaccgcttcctggccatccacaaccccctgcgctacagcagcatcctgaccagcaacagagtggccaagatgggcctcatcctggccatccgcagcatcctgctggtgatccccttccccttcaccctgcggcggctgaagtactgccagaagaacctgctgagccacagctactgcctgcaccaggacaccatgaagctggcctgcagcgacaacaagaccaacgtcatctacggcttcttcatcgccctgtgcaccatgctggacctggccctgattgtgctgtcctatgtgctgatcctgaagaccatcctgagcatcgccagcctggccgagcggctgaaggccctgaacacctgtgtgagccacatctgtgctgtgctgaccttctacgtgcccatcatcaccctggccgccatgcaccactttgccaagcacaagagccccctggtggtgatcctgattgctgacatgttcctgctggtgccccccctgatgaaccccatcgtgtactgtgtgaagacccggcagatctgggagaagatcctgggcatctactgccactag

SEQ ID NO: 36525 - DNA, 957 bp, Artificial Sequence
  Description of Artificial Sequence: Synthetic coding sequence
atgtctgtgctgaacaacagcgaggtgaagctgttcctgctgattggcatccctggcctggagcacgcccacatctggttcagcatccccatctgcctgatgtacctgctggccatcatgggcaactgcaccatcctcttcatcatcaagacagagcccagcctgcacgagcccatgtactacttcctggccatgctggccgtgtctgacatgggcctgagcctgagcagcctgcccaccatgctgcgggtcttcctgttcaatgccatgggcatcagccccaatgcctgctttgcccaggagttcttcatccacggcttcaccgtgatggagagctctgtgctgctgatcatgagcctggaccgcttcctggccatccacaaccccctgcgctacagcagcatcctgaccagcaacagagtggccaagatgggcctcatcctggccatccgcagcatcctgctggtgatccccttccccttcaccctgcggcggctgaagtactgccagaagaacctgctgagccacagctactgcctgcaccaggacaccatgaagctggcctgcagcgacaacaagaccaacgtcatctacggcttcttcatcgccctgtgcaccatgctggacctggccctgattgtgctgtcctatgtgctgatcctgaagaccatcctgagcatcgccagcctggccgagcggctgaaggccctgaacacctgtgtgagccacatctgtgctgtgctgaccttctacgtgcccatcatcaccctggccgccatgcaccactttgccaagcacaagagccccctggtggtgatcctgattgctgacatgttcctgctggtgccccccctgatgaaccccatcgtgtactgtgtgaagacccggcagatctgggagaagatcctggtgaccttccgcttcatcaagacagtgaagaagttctggaagaggtag

SEQ ID NO: 36526 - DNA, 939 bp, Artificial Sequence
  Description of Artificial Sequence: Synthetic coding sequence
atgtggcccaacatcacagctgcccccttcctgctgaccggcttccctggcctggaggccgcccaccactggatcagcatccccttctttgctgtgtatgtgtgcatcctgctgggcaatggcatgctgctgtacctgatcaagcatgaccacagcctgcacgagcccatgtactacttcctgaccatgctggccggcacagacctgatggtgaccctgaccaccatgcccaccgtgatgggcatcctgtgggtgaaccaccgggagatcagctctgtgggctgcttcctgcaggcctacttcatccacagcctgtctgtggtggagagcggcagcctgctggccatggcctatgactgcttcatcgccatccggaaccccctgcgctatgccagcatcctgaccaacaccagggtcatcgccctgggcgtgggcgtcttcctgcggggctttgtgtccatcctgcccgtcatcctgcggctcttctccttctcctactgcaagagccacgtgatcacccgggccttctgcctgcaccaggagatcatgaggctggcctgtgccgacatcaccttcaacagactctaccctgtgatcctgatcagcctgaccatcttcctggactgcctgatcatcctcttctcctacatcctgatcctgaacacagtcatcggcatcgccagcggggaggagcgggccaaggccctgaacacctgcatcagccacatcagctgtgtgctgatcttctacgtgacagtgatgggcctgaccttcatctacagatttgggaagaatgtgcctgaggtggtgcacatcatcatgagctacatctacttcctgttcccccccctgatgaaccctgtgatctacagcatcaagaccaagcagatccagtatggcatcatccggctgctgagcaagcaccgcttcagcagctag

SEQ ID NO: 36527 - DNA, 933 bp, Artificial Sequence
  Description of Artificial Sequence: Synthetic coding sequence
atgtggtacaacaacagcgctggccccttcctgctgaccggcttcctgggcagcgaggccgtgcactaccgcatctccatgtccttcttcgtcatctacttctctgtgctgtttggaaatggcaccctgctggtgctgatctggaatgaccacagcctgcacgagcccatgtactacttcctggccatgctggccgacacagacctgggcatgaccttcaccaccatgcccaccgtgctgggcgtgctgctgctggaccagcgggagatcgcccatgctgcctgcttcacccagagcttcatccacagcctggccatcgtggagagcggcatcctgctggtgctggcctatgactgcttcatcgccatccgcacccccctgcgctacaactgcatcctgaccaacagccgggtgatgaacatcggcctgggcgtgctgatgaggggcttcatgagcatcctgcccatcatcctgagcctgtactgctacccctactgcggcagccgggccctgctgcacaccttctgcctgcaccaggacgtcatcaagctggcctgtgccgacatcaccttcaaccacatctaccccatcatccagaccagcctgactgtgttcctggatgccctgatcatcatcttctcctacatcctgatcctgaagacagtgatgggcatcgccagcggccaggaggaggccaagagcctgaacacctgtgtgagccacatcagctgtgtgctggtgttccacatcaccgtgatgggcctgtccttcatccacagatttgggaagcacgcccctcatgtggtgcccatcaccatgtcctatgtgcacttcctgtttcctccatttgtgaaccccatcatctacagcatcaagaccaagcagatccagaggagcatcatccgcctcttcagcggccagagccgggcctag

SEQ ID NO: 36528 - DNA, 939 bp, Artificial Sequence
  Description of Artificial Sequence: Synthetic coding sequence
atgagcagcagcggcagcagccaccccttcctgctgaccggcttccctggcctggaggaggcccaccactggatcagcgtcttcttcctgttcatgtacatcagcatcctgtttggaaatggcaccctgctgctgctgatcaaggaggaccacaacctgcacgagcccatgtacttcttcctggccatgctggccgccacagacctgggcctggccctgaccaccatgcccaccgtgctgggcgtgctgtggctggaccaccgggagatcggcagcgctgcctgcttcagccaggcctacttcatccacagcctgtccttcctggagagcggcatcctgctggccatggcctatgaccgcttcatcgccatctgcaaccccctgcgctacacctctgtgctgaccaacaccagggtggtgaagattggcctgggcgtgctgatgaggggctttgtgtctgtggtgccccccatccggcccctgtacttcttcctgtactgccacagccacgtgctgagccacgccttctgcctgcaccaggatgtgatcaagctggcctgtgccgacaccaccttcaacagactctacccagctgtgctggtggtgttcatctttgtgctggactacctgatcatcttcatctcctatgtgctgatcctgaagacagtgctgagcatcgccagccgggaggagcgggccaaggccctgatcacctgtgtgagccacatctgctgcgtgctggtgttctacgtgaccgtcatcggcctgagcctcatccacagatttgggaagcaggtgccccacatcgtgcacctgatcatgtcctatgcctacttcctgttcccccccctgatgaaccccatcacctacagcgtgaagaccaagcagatccagaatgccatcctgcacctgttcaccacccaccgcatcggcacctag

SEQ ID NO: 36529 - DNA, 939 bp, Artificial Sequence
  Description of Artificial Sequence: Synthetic coding sequence
atgggcctgaacaagagcgccagcaccttccagctgaccggcttccctggcatggagaaggcccaccactggatcttcatccccctgctggccgcctacatcagcatcctgctgggcaatggcaccctgctcttcctgatcagaaatgaccacaacctgcacgagcccatgtactacttcctggccatgctggccgccacagacctgggcgtgaccctgaccaccatgcccaccgtgctgggcgtgctgtggctggaccaccgggagatcggccacggggcctgcttcagccaggcctacttcatccacaccctgtctgtgatggagagcggcgtgctgctggccatggcctatgactgcttcatcaccatccgcagccccctgcgctacaccagcatcctgaccaacacccaggtgatgaagattggagtgcgggtgctgacccgggccggcctgagcatcatgcccatcgtggtgcggctgcactggttcccctactgccgcagccacgtgctgagccacgccttctgcctgcaccaggatgtgatcaagctggcctgtgccgacatcaccttcaacagactctaccctgtggtggtgctgtttgccatggtgctgctggacttcctgatcatcttcttctcctacatcctgatcctgaagacagtgatgggcatcggcagcggcggggagcgggccaaggccctgaacacctgtgtgagccacatctgctgcatcctggtgttctacgtgacagtggtgtgcctgaccttcatccacagatttgggaagcacgtgccccacgtggtgcacatcaccatgagctacatccacttcctgttcccccccttcatgaaccccttcatctacagcatcaagaccaagcagatccagagcggcatcctgcggctcttcagcctgccccacagccgggcctag

SEQ ID NO: 36530 - DNA, 918 bp, Artificial Sequence
  Description of Artificial Sequence: Synthetic coding sequence
gtgtccaccagccagagccatgacttcctgctgaccggcttccctggcatggagaaggcccaccactggatcttcatccccctgctggccgcctacatcagcatcctgctgggcaatggcaccctgctcttcctgatcagaaatgaccacaacctgcacgagcccatgtactacttcctggccatgctggccgccacagacctgggcgtgaccctgaccaccatgcccaccgtgctgggcgtgctgtggctggaccaccgggagattggacatggagcctgcttcagccaggcctacttcatccacaccctgtctgtgatggagagcggcgtgctgctggccatggcctatgactgcttcatcaccatccgcagccccctgcgctacaccagcatcctgaccaacacccaggtgatgaagattggagtgcgggtgctgaccagggctggcctgagcatcatgcccatcgtggtgcggctgcactggttcccctactgccgcagccacgtgctgagccacgccttctgcctgcaccaggacgtcatcaagctggcctgtgccgacatcaccttcaaccggctgtaccctgtggtggtgctgtttgccatggtgctgctggacttcctgatcatcttcttctcctacatcctgatcctgaagacagtgatgggcatcggcagcggcggggagcgggccaaggccctgaacacctgtgtgagccacatctgctgcatcctggtgttctacgtgacagtggtgtgcctgaccttcatccacagatttgggaagcacgtgccccacgtggtgcacatcaccatgagctacatccacttcctgtttcctcccttcatgaaccccttcatctacagcatcaagaccaagcagatccagagcggcatcctgcggctcttctcctag

SEQ ID NO: 36531 - DNA, 939 bp, Artificial Sequence
  Description of Artificial Sequence: Synthetic coding sequence
atgaccaacaacatcaccagcaccagcatcatcttcctgctgactggagtgcccggcctggaggccttccacacctggatcagcatccccttctgcttcctgtctgtgacagccctgctgggcaacagcctcatcctgtttgccaccatcacccagcccagcctgcacgagcccatgtactacttcctgtccatgctgagcgccacagacctgggcctgagcatcagcaccctggtgaccatgctgagcatcttctggttcaacgtgcgggagatctccttcaatgcctgcctgagccacatgttcttcatcaagttcttcaccgtgatggagagctctgtgctgctggccatggcctttgacagatttgtggccgtgagcaaccccctgcgctatgccatgatcctgacagacagcagaattgcccagatcggcgtggccagcgtcatccggggcctgctgatgctgacccccatggtggccctgctgatccggctgagctactgccacagccaggtgctgcaccacagctactgctaccacccagatgtgatgaagctgagctgcacagacacccgcatcaacagcgctgtgggcctgacagccatgttcagcacagtgggcgtggacctgctgctgatcctgctgtcctatgtgctgatcatcagaacagtgctgtctgtggccagccctgaggagaggaaggagaccttcagcacctgtgtgagccacatcgtggcctttgccatctactacatccccctcatcagcctgagcatcgtgcacagatttgggaagcaggccccagcctacgtgcacaccatgattgccaacacctacctgctgatcagccccctgatgaaccctgtgatctacagcgtgaagaccaagcagatccggcgggccgtcatcaagatcctgcacagcaaggagacctag

SEQ ID NO: 36532 - DNA, 975 bp, Artificial Sequence
  Description of Artificial Sequence: Synthetic coding sequence
atgcagaagccccagctgctggtgcccatcatcgccaccagcaatggaaacctggtgcatgctgcctacttcctgctggtgggcatccctggcctgggccccaccatccacttctggctggccttccccctgtgcttcatgtatgccctggccaccctgggcaacctgaccatcgtgctgatcatccgggtggagcggcggctgcacgagcccatgtacctgttcctggccatgctgagcaccatcgacctggtgctgagcagcatcaccatgcccaagatggccagcctcttcctgatgggcatccaggagattgagttcaacatctgcctggcccagatgttcctgatccacgccctgtctgctgtggagagcgctgtgctgctggccatggcctttgacagatttgtggccatctgccaccccctgcggcatgcctctgtgctgaccggctgcaccgtggccaagattggcctgagcgccctgacccggggctttgtgttcttcttccccctgcccttcatcctgaagtggctgagctactgccagacccacacagtgacccacagcttctgcctgcaccaggacatcatgaagctgagctgcacagacaccagggtgaatgtggtgtatggcctcttcatcatcctgtctgtgatgggcgtggacagcctcttcatcggcttctcctacatcctgatcctgtgggccgtgctggagctgagcagccggcgggccgccctgaaggccttcaacacctgcatcagccacctgtgtgctgtgctggtgttctacgtgcccctgattggcctgtctgtggtgcaccggctgggcggccccaccagcctgctgcacgtggtgatggccaacacctacctgctgctgccccctgtggtgaaccccctggtgtatggagccaagaccaaggagatctgcagccgggtgctgtgcatgttcagccagggcggcaagtag

SEQ ID NO: 36533 - DNA, 957 bp, Artificial Sequence
  Description of Artificial Sequence: Synthetic coding sequence
atgatggtggaccccaatggaaatgaatcttctgccacctacttcatcctgattggcctgcccggcctggaggaggcccagttctggctggccttccccctgtgcagcctgtacctgattgctgtgctgggcaacctgaccatcatctacatcgtgaggacagagcacagcctgcacgagcccatgtacatcttcctgtgcatgctgagcggcatcgacatcctgatcagcaccagctccatgcccaagatgctggccatcttctggttcaacagcaccaccatccagtttgatgcctgcctgctgcagatgtttgccatccacagcctgagcggcatggagagcacagtgctgctggccatggcctttgaccgctacgtggccatctgccaccccctgcggcatgccaccgtgctgaccctgccccgggtgaccaagattggagtggccgctgtggtgcggggggccgccctgatggcccccctgcctgtgttcatcaagcagctgcccttctgccgcagcaacatcctgagccacagctactgcctgcaccaggatgtgatgaagctggcctgtgatgacatccgggtgaatgtggtgtatggcctcatcgtcatcatcagcgccatcggcctggacagcctgctgatctccttctcctacctgctgatcctgaagacagtgctgggcctgacccgggaggcccaggccaaggccttcggcacctgtgtgagccacgtgtgtgctgtgttcatcttctacgtgcccttcatcggcctgtccatggtgcaccgcttcagcaagagaagagacagccccctgcctgtgatcctggccaacatctacctgctggtgccccctgtgctgaaccccatcgtgtatggagtgaagaccaaggagatccggcagaggatcctgcggctcttccacgtggccacccacgccagcgagccctag

SEQ ID NO: 36534 - DNA, 963 bp, Artificial Sequence
  Description of Artificial Sequence: Synthetic coding sequence
atgagcagctgcaacttcacccacgccacctttgtgctgattggcatccctggcctggagaaggcccacttctgggtgggcttccccctgctgtccatgtatgtggtggccatgtttggaaactgcatcgtggtgttcatcgtgaggacagagaggagcctgcacgcccccatgtacctgttcctgtgcatgctggccgccatcgacctggccctgagcaccagcaccatgcccaagatcctggccctcttctggtttgacagccgggagatcagctttgaggcctgcctgacccagatgttcttcatccacgccctgagcgccatcgagagcaccatcctgctggccatggcctttgaccgctacgtggccatctgccaccccctgcggcatgctgctgtgctgaacaacacagtgacagcccagattggaattgtggccgtggtgcggggcagcctcttcttcttccccctgcccctgctgatcaagaggctggccttctgccacagcaatgtgctgagccacagctactgtgtgcaccaggatgtgatgaagctggcctatgctgacaccctgcccaacgtggtgtatggcctgacagccatcctgctggtgatgggcgtggatgtgatgttcatcagcctgagctacttcctgatcatcagaacagtgctgcagctgcccagcaagtctgagcgggccaaggccttcggcacctgtgtgagccacatcggcgtggtgctggccttctacgtgcccctgattggcctgtctgtggtgcacagatttggaaacagcctgcaccccatcgtgcgggtggtgatgggagacatctacctgctgctgccccctgtgatcaaccccatcatctatggagccaagaccaagcagatccgcaccagggtgctggccatgttcaagatcagctgtgacaaggacctgcaggccgtgggcggcaagtag

SEQ ID NO: 36535 - DNA, 252 bp, Artificial Sequence
  Description of Artificial Sequence: Synthetic coding sequence
atgagcagctgcaacttcacccacgccacctttgtgctgattggcatccctggcctggagaaggcccacttctgggtgggcttccccctgctgtccatgtatgtggtggccatgtttggaaactgcatcgtggtgttcatcgtgaggacagagaggagcctgcacgcccccatgtacctgttcctgtgcatgctggccgccatcgacctggccctgagcaccagcaccatgcccaagatcctggccctgtag

SEQ ID NO: 36536 - DNA, 1029 bp, Artificial Sequence
  Description of Artificial Sequence: Synthetic coding sequence
atgacagagaccagcctgagcagccagtgcttccccatgtctgtgctgaacaacaccatcgccgagcccctcatcttcctgctgatgggcatccctggcctgaaggccacccagtactggatcagcatccccttctgcctgctgtatgtggtggccgtgtctggcaacagcatgatcctgtttgtggtgctgtgtgagaggagcctgcacaagcccatgtactacttcctgtccatgctgagcgccacagacctgagcctgagcctgtgcaccctgagcaccaccctgggcgtcttctggtttgaggcccgggagatcaacctgaatgcctgcatcgcccagatgttcttcctgcacggcttcaccttcatggagagcggcgtgctgctggccatggcctttgacagatttgtggccatctgctaccccctgcgctacaccaccatcctgaccaatgccagaattgccaagattggcatgtccatgctgatcagaaatgtggccgtgatgctgcctgtgatgctgtttgtgaagaggctgtccttctgcagctccatggtgctgagccacagctactgctaccacgtggacctgatccagctgagctgcacagacaaccgcatcaacagcatcctgggcctgtttgccctgctgagcaccactggatttgactgcccctgcatcctgctgagctacatcctgatcatccgctctgtgctgagcatcgccagcagcgaggagaggaggaaggccttcaacacctgcaccagccacatctctgctgtgtccatcttctacctgcccctcatcagcctgagcctggtgcacagatatggccacagcgcccccccatttgtgcacatcatcatggccaacgtgttcctgctgatcccccctgtgctgaaccccatcatctacagcgtgaagatcaagcagatccagaaggccatcatcaaggtgctgatccagaagcacagcaagagcaaccaccagctgttcctgatccgggacaaggccatctatgaatag

SEQ ID NO: 36537 - DNA, 966 bp, Artificial Sequence
  Description of Artificial Sequence: Synthetic coding sequence
atgaccatcctgctgaacagcagcctgcagagggccaccttcttcctgaccggcttccagggcctggagggcctgcacggctggatcagcatccccttctgcttcatctacctgaccgtcatcctgggcaacctgaccatcctgcacgtgatctgcacagatgccaccctgcacggccccatgtactacttcctgggcatgctggccgtgacagacctgggcctgtgcctgagcaccctgcccaccgtgctgggcatcttctggtttgacacccgggagatcggcatcccagcctgcttcacccagctgttcttcatccacaccctgagctccatggagagctctgtgctgctgtccatgagcattgacagatatgtggccgtgtgcaaccccctgcatgacagcacagtgctgaccccagcctgcatcgtgaagatgggcctgagctctgtgctgcggagcgccctgctgatcctgcccctgcccttcctgctgaagcgcttccagtactgccacagccacgtgctggcccacgcctactgcctgcacctggagatcatgaagctggcctgcagcagcatcatcgtgaaccacatctacggcctgtttgtggtggcctgcaccgtgggcgtggacagcctgctgatcttcctgtcctatgccctgatcctgaggacagtgctgagcatcgccagccaccaggagcggctgcgggccctgaacacctgtgtgagccacatctgtgctgtgctgctcttctacatccccatgattggcctgagcctggtgcacagatttggagagcacctgccccgggtggtgcacctgttcatgtcctatgtgtacctgctggtgccccccctgatgaaccccatcatctacagcatcaagaccaagcagatccggcagaggatcatcaagaagttccagttcatcaagagcctgcgctgcttctggaaggactag

SEQ ID NO: 36538 - DNA, 945 bp, Artificial Sequence
  Description of Artificial Sequence: Synthetic coding sequence
atgaccctgggcagcctgggcaacagcagcagctctgtgtctgccaccttcctgctgagcggcatccctggcctggagaggatgcacatctggatcagcatccccctgtgcttcatgtacctggtgtccatccctggcaactgcaccatcctcttcatcatcaagacagagaggagcctgcacgagcccatgtacctgttcctgtccatgctggccctgattgacctgggcctgagcctgtgcaccctgcccaccgtgctgggcatcttctgggtgggcgcccgggagatcagccatgatgcctgctttgcccagctgttcttcatccactgcttctccttcctggagagctctgtgctgctgtccatggcctttgacagatttgtggccatctgccaccccctgcactacgtgtccatcctgaccaacacagtcatcggcagaattggcctggtgtccctgggccgctctgtggccctgatcttccccctgcccttcatgctgaagcgcttcccctactgcggcagccctgtgctgagccacagctactgcctgcaccaggaggtgatgaagctggcctgtgccgacatgaaggccaacagcatctacggcatgtttgtgattgtgtccacagtgggcatcgacagcctgctgatcctcttctcctatgccctgatcctgaggacagtgctgagcatcgccagcagagctgagcgcttcaaggccctgaacacctgtgtgagccacatctgtgctgtgctgctcttctacacccccatgattggcctgagcgtcatccacagatttgggaagcaggccccccacctggtgcaggtggtgatgggcttcatgtacctgctcttcccccctgtgatgaaccccatcgtgtacagcgtgaagaccaagcagatccgggacagagtgacccacgccttctgctactag

SEQ ID NO: 36539 - DNA, 909 bp, Artificial Sequence
  Description of Artificial Sequence: Synthetic coding sequence
atgaccaacctgaatgccagccaggccaaccacaggaacttcatcctgaccggcatccctggcaccccagacaagaacccctggctggccttccccctgggcttcctgtacaccctgaccctgctgggcaatggcaccatcctggccgtcatcaaggtggagcccagcctgcacgagcccacctactacttcctgagcatcctggccctgacagatgtgtccctgtccatgagcaccctgcccagcatgctgagcatctactggttcaatgccccccagatcgtgtttgatgcctgcatcatgcagatgttcttcatccacgtgtttggaattgtggagagcggcgtgctggtgtccatggcctttgacagatttgtggccatccggaaccccctgcactacgtgtccatcctgacccatgatgtgatcaggaagacaggaattgctgtgctgaccagggctgtgtgtgtggtgtttcctgtgcccttcctgatcaagtgcctgcccttctgccacagcaatgtgctgagccacagctactgcctgcaccagaacatgatgaggctggcctgtgccagcacccgcatcaacagcctgtatggcctgattgtggtgatcttcaccctgggcctggatgtgctgctgaccctgctgtcctatgtgctgaccctgaagacagtgctgggcatcgtgtccagaggagagcggctgaagaccctgagcacctgcctgagccacatgagcacagtgctgctcttctacgtgcccttcatgggcgccgcctccatgatccaccgcttctgggagcacctgagccctgtggtgcacatggtgatggctgacatctacctgctgctgccccctgtgctgaaccccatcgtgtacagcgtgaagaccaagcagatctag

SEQ ID NO: 36540 - DNA, 894 bp, Artificial Sequence
  Description of Artificial Sequence: Synthetic coding sequence
ctgaccggcatccctggcatccagacaggcctgacctgggtggccctgatcttctgcatcctgtacatgatcagcatcgtgggcaacctgagcatcctgaccctggtgttctgggagcccgccctgcaccagcccatgtactacttcctgtccatgctggccctgaatgacctgggcgtgtccttcagcaccctgcccaccgtcatcagcaccttctgcttcaactacaaccacgtggccttcaatgcctgcctggtgcagatgttcttcatccacaccttctccttcatggagagcggcatcctgctggccatgagcctggacagatttgtggccatctgctaccccctgcgctacgtgacagtgctgacccacaaccgcatcctggccatgggcctgggcatcctgaccaagagcttcaccaccctcttccccttcccctttgtggtgaagaggctgcccttctgcaagggaaatgtgctgcaccacagctactgcctgcacccagacctgatgaagctgccctgtgccgacaccaagctgaacagcatcctgggcctggccatcgtgctggccaactttggcctggacagcctgctgattgtggtgtcctatgtgctgatcctgtacacagtgatgggcatcgccagcggggagggccgctggaaggccctgaacacctgtgtgagccacatctgtgctgtgctgatctactacgtgcccatgattggagtgtctgtgatgcacagagctgccaagcacgccagccccatcgtgcacaccctgatgagcagcatctgcctgctggtgccccctgtgctgaaccccatcatctacagcgtgaagacccagaccatccggcagggcatcctgaccctcttcagctgcaagtag

SEQ ID NO: 36541 - DNA, 936 bp, Artificial Sequence
  Description of Artificial Sequence: Synthetic coding sequence
ggcctgcggcacagcacccacccagccaccctgcagctgaccggcatccctggcatccagacaggcctgacctgggtggccctgatcttctgcatcctgtacatgatcagcatcgtgggcaacctgagcatcctgaccctggtgttctgggagcccgccctgcaccagcccatgtactacttcctgtccatgctggccctgaatgacctgggcgtgtccttcagcaccctgcccaccgtcatcagcaccttctgcttcaactacaaccacgtggccttcaatgcctgcctggtgcagatgttcttcatccacaccttctccttcatggagagcggcatcctgctggccatgagcctggacagatttgtggccatctgctaccccctgcgctacgtgacagtgctgacccacaaccgcatcctggccatgggcctgggcatcctgaccaagagcttcaccaccctcttccccttcccctttgtggtgaagaggctgcccttctgcaagggaaatgtgctgcaccacagctactgcctgcacccagacctgatgaaggtggcctgtggggacatccacgtgaacaacatctacggcctgctggtgatcatcttcacctacggcatggacagcaccttcatcctgctgtcctatgccctgatcctgcgggccatgctggtgatcatcagccaggagcagaggctgaaggccctgaacacctgcatgagccacatctgtgctgtgctggccttctacgtgcccatcatcgctgtgtccatgatccaccgcttctggaagagcgcccctcctgtggtgcacgtgatgatgagcaatgtgtacctgtttgtgccccccatgctgaaccccatcatctacagcgtgaagaccaaggagatcaggaagggcatcctgaagttcttccacaagagccaggcctag

SEQ ID NO: 36542 - DNA, 945 bp, Artificial Sequence
  Description of Artificial Sequence: Synthetic coding sequence
atgctgggcctgaatggcacccccttccagcctgccaccctgcagctgaccggcatccctggcatccagacaggcctgacctgggtggccctgatcttctgcatcctgtacatgatcagcatcgtgggcaacctgagcatcctgaccctggtgttctgggagcccgccctgcaccagcccatgtactacttcctgtccatgctggccctgaatgacctgggcgtgtccttcagcaccctgcccaccgtcatcagcaccttctgcttcaactacaaccacgtggccttcaatgcctgcctggtgcagatgttcttcatccacaccttctccttcatggagagcggcatcctgctggccatgagcctggacagatttgtggccatctgctaccccctgcgctacgtgacagtgctgacccacaaccgcatcctggccatgggcctgggcatcctgaccaagagcttcaccaccctcttccccttcccctttgtggtgaagaggctgcccttctgcaagggaaatgtgctgcaccacagctactgcctgcacccagacctgatgaaggtggcctgtggggacatccacgtgaacaacatctacggcctgctggtgatcatcttcacctacggcatggacagcaccttcatcctgctgtcctatgccctgatcctgcgggccatgctggtgatcatcagccaggagcagaggctgaaggccctgaacacctgcatgagccacatctgtgctgtgctggccttctacgtgcccatcatcgctgtgtccatgatccaccgcttctggaagagcgcccctcctgtggtgcacgtgatgatgagcaatgtgtacctgtttgtgccccccatgctgaaccccatcatctacagcgtgaagaccaaggagatcaggaagggcatcctgaagttcttccacaagagccaggcctag

SEQ ID NO: 36543 - DNA, 939 bp, Artificial Sequence
  Description of Artificial Sequence: Synthetic coding sequence
atgggcctcttcaacgtgacccacccagccttcttcctgctgaccggcatccctggcctggagagcagccacagctggctgagcggccccctgtgtgtgatgtatgctgtggccctgggcggcaacacagtcatcctgcaggccgtgcgggtggagcccagcctgcacgagcccatgtactacttcctgtccatgctgtccttcagtgatgtggccatctccatggccaccctgcccaccgtgctgcggaccttctgcctgaatgccaggaacatcacctttgatgcctgcctgatccagatgttcctgatccacttcttctccatgatggagagcggcatcctgctggccatgagctttgacagatatgtggccatctgtgaccccctgcgctatgccaccgtgctgaccacagaggtgattgctgccatgggcctgggcgctgctgcccggagcttcatcaccctcttccccctgcccttcctgatcaagaggctgcccatctgccgcagcaatgtgctgagccacagctactgcctgcacccagacatgatgaggctggcctgtgccgacatcagcatcaacagcatctacggcctgtttgtgctggtgtccaccttcggcatggacctcttcttcatcttcctgtcctatgtgctgatcctgcggtctgtgatggccacagccagccgggaggagcggctgaaggccctgaacacctgtgtgagccacatcctggccgtgctggccttctacgtgcccatgattggagtgtccacagtgcacagatttgggaagcacgtgccctgctacatccacgtgctgatgagcaatgtgtacctgtttgtgccccctgtgctgaaccccctcatctacagcgccaagaccaaggagatccggcgggccatcttcaggatgttccaccacatcaagatctag

SEQ ID NO: 36544 - DNA, 951 bp, Artificial Sequence
  Description of Artificial Sequence: Synthetic coding sequence
atgaagatcagcaacaacagcctgggcttcctgcccaccaccttcatcctggtgggcatccctggcctggagagcgagcacctgtggatctctgtgcccttcagcctcatctacatcatcatcttcctgggcaatggcatcatcctgcacgtgatcagaacagacatcgccctgcaccagcccatgtacctgttcctggccatgctggccctggccgaggtgcgggtgtctgccagcaccctgcccaccgtgctgggcatcttcctgtttggaaacacagagatcagcctggaggcctgcctcttcccagatgtgctgcaccccttcttcatccatgatggagccagctgtgccgccggccacgtgtttggccccctgtacagccacctgcagcccacagagctgcacagctacccagacacagcccagggcctgtggcacaggagctactacagaacagagaagcactacgcccacggctctgtggcccacagcctgatggccagcgccctgctgtggccccagtgccccctgaccttcctgctgagcgccccccagagctacctgagctgtggcaacatctctgtgaacaacatctacggcatcttcatcgtgaccagcaccttcggcctggacagcctgctgattgtcatctcctatggcctcatcctgcacacagtgctgggcatcgccaccggggagggcaggaagaaggccctgaacacctgtggcagccacgtgtgtgctgtgctggcctactacgtgcccatgattggcctgagcatcgtgcaccggctgggccaccgggtgagccccctgctgcaggccatgatggccaatgcctacctgttcttcccccctgtggtgaaccccatcgtgtacagcatcaagaccaaggagatccacggggccatcgtgaggatgctgctggagaagagaagaagagtgtag

SEQ ID NO: 36545 - DNA, 948 bp, Artificial Sequence
  Description of Artificial Sequence: Synthetic coding sequence
atgggagactggaacaacagtgatgctgtggagcccatcttcatcctgcggggcttccctggcctggagtatgtgcacagctggctgagcatcctcttctgcctggcctacctggtggccttcatgggaaatgtgaccatcctgagcgtcatctggattgagagcagcctgcaccagcccatgtactacttcatcagcatcctggccgtgaatgacctgggcatgagcctgagcaccctgcccaccatgctggccgtgctgtggctggatgcccctgagatccaggccagcgcctgctacgcccagctgttcttcatccacaccttcaccttcctggagagctctgtgctgctggccatggcctttgacagatttgtggccatctgccaccccctgcactaccccaccatcctgaccaacagcgtgattggcaagattggcctggcctgcctgctgcggagcctgggcgtggtgctgcccacccccctgctgctgcggcactaccactactgccacggcaatgccctgagccacgccttctgcctgcaccaggatgtgctgcggctgagctgcacagatgcccggaccaacagcatctacggcctgtgtgtggtgattgccaccctgggcgtggacagcatcttcatcctgctgtcctatgtgctgatcctgaacacagtgctggacatcgccagccgggaggagcagctgaaggccctgaacacctgtgtgagccacatctgtgtggtgctgatcttctttgtgcctgtgattggagtgtccatggtgcacagatttgggaagcacctgagccccatcgtgcacatcctgatggctgacatctacctgctgctgccccctgtgctgaaccccatcgtgtacagcgtgaggaccaagcagatccggctgggcatcctgcacaagtttgtgctgcggcggcgcttctag

SEQ ID NO: 36546 - DNA, 954 bp, Artificial Sequence
  Description of Artificial Sequence: Synthetic coding sequence
atgagccaggtgaccaacaccacccaggagggcatctacttcatcctgacagacatccctggctttgaggccagccacatctggatcagcatccctgtgtgctgcctgtacaccatcagcatcatgggcaacaccaccatcctgaccgtcatcagaacagagcccagcgtgcaccagaggatgtacctgttcctgtccatgctggccctgacagacctgggcctgaccctgaccaccctgcccaccgtgatgcagctgctgtggttcaacgtgcggcgcatcagcagcgaggcctgctttgcccagttcttcttcctgcacggcttctccttcatggagagctctgtgctgctggccatgtctgtggactgctacgtggccatctgctgccccctgcactacgccagcatcctgaccaatgaggtgattggaagaacaggcctggccatcatctgctgctgcgtgctggccgtgctgcccagcctcttcctgctgaagaggctgcccttctgccacagccacctgctgagccgcagctactgcctgcaccaggacatgatccggctggtgtgtgccgacatccggctgaacagctggtacggctttgccctggccctgctgatcatcatcgtggaccccctgctgattgtcatctcctacaccctcatcctgaagaacatcctgggcacagccacctgggccgagcggctgcgggccctgaacaactgcctgagccacatcctggccgtgctggtgctgtacatccccatggtgggcgtgtccatgacccacagatttgccaagcacgccagccccctggtgcacgtgatcatggccaacatctacctgctggcccctcctgtgatgaaccccatcatctacagcgtgaagaacaagcagatccagtggggcatgctgaacttcctgagcctgaagaacatgcacagcaggtag

SEQ ID NO: 36547 - DNA, 972 bp, Artificial Sequence
  Description of Artificial Sequence: Synthetic coding sequence
atgagcaccctgcccacccagatcgcccccaacagcagcacctccatggcccccaccttcctgctggtgggcatgcctggcctgagcggggcccccagctggtggaccctgcccctgattgctgtgtacctgctgagcgccctgggcaatggcaccatcctgtggatcatcgccctgcagcctgccctgcaccggcccatgcacttcttcctgttcctgctgtctgtgtctgacatcggcctggtgacagccctgatgcccaccctgctgggcatcgccctggccggggcccacacagtgcctgccagcgcctgcctgctgcagatggtgttcatccacgtgttttctgtgatggagagctctgtgctgctggccatgagcattgaccgggccctggccatctgccggcccctgcactacccagccctgctgaccaacggggtcatcagcaagatcagcctggccatctccttccgctgcctgggcctgcacctgcccctgcccttcctgctggcctacatgccctactgcctgccccaggtgctgacccacagctactgcctgcacccagatgtggcccggctggcctgcccagaggcctggggcgccgcctacagcctgtttgtggtgctgagcgccatgggcctggaccccctgctgatcttcttctcctatggcctcatcggcaaggtgctgcagggcgtggagagcagagaagatcgctggaaggccggccagacctgtgccgcccacctgtctgctgtgctgctcttctacatccccatgatcctgctggccctgatcaaccaccctgagctgcccatcacccagcacacccacaccctgctgtcctatgtgcacttcctgctgcccccactcatcaaccccatcctgtacagcgtgaagatgaaggagatcaggaagaggatcctgaaccggctgcagcccaggaaggtgggcggggcccagtag

SEQ ID NO: 36548 - DNA, 984 bp, Artificial Sequence
  Description of Artificial Sequence: Synthetic coding sequence
atggccatcttcaacaacaccaccagcagcagcagcaacttcctgctgacagccttccctggcctggagtgtgcccacgtgtggatcagcatccctgtgtgctgcctgtacaccatcgccctgctgggcaacagcatgatcttcctggtgatcatcaccaagaggcggctgcacaagcccatgtactacttcctgtccatgctggccgctgtggacctgtgcctgaccatcaccaccctgcccaccgtgctgggcgtgctgtggttccacgcccgggagatctccttcaaggcctgcttcatccagatgttctttgtgcacgccttcagcctgctggagagctctgtgctggtggccatggcctttgacagatttgtggccatctgcaaccccctgaactatgccaccatcctgacagacaggatggtgctggtgattggcctggtgatctgcatccggcctgctgtgttcctgctgcccctgctggtggccatcaacacagtgtccttccatggaggccacgagctgagccaccccttctgctaccaccctgaggtgatcaagtacacctacagcaagccctggatcagcagcttctggggcctcttcctgcagctgtacctgaatggaacagatgtgctcttcatcctcttctcctatgtgctgatcctgaggacagtgctgggcatcgtggccaggaagaagcagcagaaggccctgagcacctgtgtgtgccacatctgtgctgtgaccatcttctacgtgcccctcatcagcctgagcctggcccacaggctcttccacagcaccccccgggtgctgtgcagcaccctggccaacatctacctgctgctgccccctgtgctgaaccccatcatctacagcctgaagaccaagaccatccggcaggccatgttccagctgctgcagagcaagggctcctggggcttcaacgtgcggggcctgcggggccgctgggactag

SEQ ID NO: 36549 - DNA, 1065 bp, Artificial Sequence
  Description of Artificial Sequence: Synthetic coding sequence
atgaccaacaagatgtatgccatctacatcaagaacctgaactacttctccttcctgattgtgcagtgcctgcagcccaccatggccatcttcaacaacaccaccagcagcagcagcaacttcctgctgacagccttccctggcctggagtgtgcccacgtgtggatcagcatccctgtgtgctgcctgtacaccatcgccctgctgggcaacagcatgatcttcctggtgatcatcaccaagaggcggctgcacaagcccatgtactacttcctgtccatgctggccgctgtggacctgtgcctgaccatcaccaccctgcccaccgtgctgggcgtgctgtggttccacgcccgggagatctccttcaaggcctgcttcatccagatgttctttgtgcacgccttcagcctgctggagagctctgtgctggtggccatggcctttgacagatttgtggccatctgcaaccccctgaactatgccaccatcctgacagacaggatggtgctggtgattggcctggtgatctgcatccggcctgctgtgttcctgctgcccctgctggtggccatcaacacagtgtccttccacggcggccacgagctgagccaccccttctgctaccaccctgaggtgatcaagtacacctacagcaagccctggatcagcagcttctggggcctcttcctgcagctgtacctgaatggaacagatgtgctcttcatcctcttctcctatgtgctgatcctgaggacagtgctgggcatcgtggccaggaagaagcagcagaaggccctgagcacctgtgtgtgccacatctgtgctgtgaccatcttctacgtgcccctcatcagcctgagcctggcccacaggctcttccacagcaccccccgggtgctgtgcagcaccctggccaacatctacctgctgctgccccctgtgctgaaccccatcatctacagcctgaagaccaagaccatccggcaggccatgttccagctgctgcagagcaagggctcctggggcttcaacgtgcggggcctgcggggccgctgggactag

SEQ ID NO: 36550 - DNA, 966 bp, Artificial Sequence
  Description of Artificial Sequence: Synthetic coding sequence
atgttcctgagcagcaggatgatcacctctgtgagccccagcaccagcaccaacagcagcttcctgctgaccggcttcagcggcatggagcagcagtacccctggctgagcatccccttcagcagcatctatgccatggtgctgctgggcaactgcatggtgctgcacgtgatctggacagagcccagcctgcaccagcccatgttctacttcctgtccatgctggccctgacagacctgtgcatgggcctgagcacagtgtacacagtgctgggcatcctgtggggcatcatccgggagatcagcctggacagctgcatcgcccagagctacttcatccacggcctgtccttcatggagagctctgtgctgctgaccatggcctttgaccgctacatcgccatctgcaaccccctgcgctacagcagcatcctgaccaacagccgcatcatcaagattggcctgaccatcatcggccgctccttcttcttcatcaccccacccatcatctgcctgaagttcttcaactactgccacttccacatcctgagccacagcttctgcctgcaccaggacctgctgcggctggcctgcagcgacatccgcttcaacagctactatgccctgatgctggtgatctgcatcctgctgctggatgccatcctgatcctcttctcctacatcctgatcctgaagtctgtgctggccgtggccagccaggaggagcggcacaagctgttccagacctgcatcagccacatctgtgctgtgctggtgttctacatccccatcatcagcctgaccatggtgcacagatttgggaagcacctgagccctgtggcccacgtgctgattggcaacatctacatcctcttcccccccctgatgaaccccatcatctacagcgtgaagacccagcagatccacaccaggatgctgcggctcttcagcctgaagcgctactag

SEQ ID NO: 36551 - DNA, 939 bp, Artificial Sequence
  Description of Artificial Sequence: Synthetic coding sequence
atgagcatcagcaacatcaccgtgtacatgcccagcgtgctgaccctggtgggcatccctggcctggagagcgtgcagtgctggattggcatccccttctgtgccatctacctgattgccatgattggcaacagcctgctgctgagcatcatcaagtctgagaggagcctgcacgagcccctgtacatcttcctgggcatgctgggcgccacagacatcgccctggccagcagcatcatgcccaagatgctgggcatcttctggttcaacgtgcctgagatctactttgacagctgcctgctgcagatgtggttcatccacaccctgcagggcatcgagagcggcatcctggtggccatggccctggacagatatgtggccatctgctaccccctgcggcatgccaacatcttcacccaccagctggtgatccagatcggcaccatggtggtgctgcgggccgccatcctggtggccccctgcctggtgctgatcaagtgccgcttccagttctaccacaccaccgtcatcagccacagctactgtgagcacatggccatcgtgaagctggccgccgccaacgtgcaggtgaacaagatctacggcctgtttgtggccttcaccgtggccggctttgacctgaccttcatcaccctgagctacatccagatcttcatcaccgtcttccggctgccccagaaggaggcccgcttcaaggccttcaacacctgcatcgcccacatctgtgtgttcctgcagttctacctgctggccttcttctccttcttcacccacagatttggcagccacatcagcccctacatccacatcctcttcagcagcatctacctgctggtgccccccttcctgaaccccctggtgtatggagccaagaccacccagatccgcatccacgtggtgaagatgttctgcagctag

SEQ ID NO: 36552 - DNA, 939 bp, Artificial Sequence; identical to SEQ ID NO: 36551
  Description of Artificial Sequence: Synthetic coding sequence

SEQ ID NO: 36553 - DNA, 951 bp, Artificial Sequence
  Description of Artificial Sequence: Synthetic coding sequence
atgcccaccttcaatggatctgtgttcatgcccagcgccttcatcctgattggcatccctggcctggagagcgtgcagtgctggattggcatccccttcagcgccatgtacctgattggagtcatcggcaacagcctcatcctggtgatcatcaagtatgagaacagcctgcacatccccatgtacatcttcctggccatgctggccgccacagacatcgccctgaacacctgcatcctgcccaagatgctgggcatcttctggttccacctgcctgagatcagctttgatgcctgcctcttccagatgtggctgatccacagcttccaggccatcgagagcggcatcctgctggccatggccctggacagatatgtggccatctgcatccccctgcggcatgccaccatcttcagccagcagttcctgacccacatcggcctgggcgtgaccctgcgggccgccatcctgatcatccccagcctgggcctcatcaagtgctgcctgaagcactaccgcaccaccgtcatcagccacagctactgtgagcacatggccatcgtgaagctggccacagaggacatccgggtgaacaagatctacggcctgtttgtggcctttgccatcctgggctttgacatcatcttcatcaccctgtcctatgtgcagatcttcatcaccgtcttccagctgccccagaaggaggcccgcttcaaggccttcaacacctgcatcgcccacatctgtgtgttcctgcagttctacctgctggccttcttctccttcttcacccacagatttggcagccacatccccccctacatccacatcctgctgagcaacctgtacctgctggtgccccccttcctgaaccccatcgtgtatggagtgaagaccaagcagatccgggaccacatcgtgaaggtgttcttcttcaagaaggtgacctag

SEQ ID NO: 36554 - DNA, 972 bp, Artificial Sequence
  Description of Artificial Sequence: Synthetic coding sequence
atgagccacaccaacgtgaccatcttccaccctgctgtgtttgtgctgcccggcatccctggcctggaggcctaccacatctggctgagcatccccctgtgcctgatctacatcacagctgtgctgggcaacagcatcctgattgtggtgattgtgatggagaggaacctgcacgtgcccatgtacttcttcctgtccatgctggccgtgatggacatcctgctgagcaccaccaccgtgcccaaggccctggccatcttctggctgcaggcccacaacatcgcctttgatgcctgtgtgacccagggcttctttgtgcacatgatgtttgtgggggagagcgccatcctgctggccatggcctttgacagatttgtggccatctgtgcccccctgcgctacaccaccgtgctgacctggcctgtggtgggccgcatcgccctggccgtcatcaccaggagcttctgcatcatcttccctgtgatcttcctgctgaagaggctgcccttctgcctgaccaacatcgtgccccacagctactgtgagcacatcggcgtggcccggctggcctgtgccgacatcaccgtgaacatctggtacggcttctctgtgcccatcgtgatggtgatcctggatgtgatcctgattgctgtgtcctacagcctcatcctgcgggctgtgttccggctgcccagccaggatgcccggcacaaggccctgagcacctgtggcagccacctgtgtgtgatcctgatgttctacgtgcccagcttcttcaccctgctgacccaccacttcggcaggaacatcccccagcacgtgcacatcctgctggccaacctgtatgtggccgtgccccccatgctgaaccccatcgtgtatggagtgaagaccaagcagatccgggagggcgtggcccaccgcttctttgacatcaagacctggtgctgcaccagccccctgggcagctag

SEQ ID NO: 36555 - DNA, 945 bp, Artificial Sequence
  Description of Artificial Sequence: Synthetic coding sequence
atgcccaccgtgaaccacagcggcaccagccacacagtgttccacctgctgggcatccctggcctgcaggaccagcacatgtggatcagcatccccttcttcatctcctatgtgacagccctgctgggcaacagcctgctgatcttcatcatcctgaccaagaggagcctgcacgagcccatgtacctgttcctgtgcatgctggccggggctgacatcgtgctgagcacctgcaccatcccccaggccctggccatcttctggttccgggccggggacatcagcctggaccgctgcatcacccagctgttcttcatccacagcaccttcatcagcgagagcggcatcctgctggtgatggcctttgaccactacatcgccatctgctaccccctgcgctacaccaccatcctgaccaatgccctgatcaagaagatctgtgtgacagtgtccctgcggagctatggcaccatcttccccatcatcttcctgctgaagaggctgaccttctgccagaacaacatcatcccccacaccttctgtgagcacatcggcctggccaagtatgcctgcaatgacatccgcatcaacatctggtacggcttcagcatcctgatgagcacagtggtgctggatgtggtgctgatcttcatctcctacatgctgatcctgcatgctgtgttccacatgcccagcccagatgcctgccacaaggccctgaacaccttcggcagccacgtgtgcatcatcatcctcttctacggcagcggcatcttcaccatcctgacccagcgcttcggccgccacatccccccctgcatccacatccccctggccaacgtgtgcatcctggccccacccatgctgaaccccatcatctacggcatcaagaccaagcagatccaggagcaggtggtgcagttcctgttcatcaagcagaagtag

SEQ ID NO: 36556 - DNA, 1008 bp, Artificial Sequence
  Description of Artificial Sequence: Synthetic coding sequence
atggcccaggtgcgggccctgcacaagatcatggccctcttcagcgccaacagcattggagccatgaacaacagcgacaccagaattgctggctgcttcctgaccggcatccctggcctggagcagctgcacatctggctgagcatccccttctgcatcatgtacatcacagccctggagggcaatggcatcctgatctgtgtgatcctgagccaggccatcctgcacgagcccatgtacatcttcctgtccatgctggccagcgcagatgtgctgctgagcaccaccaccatgcccaaggccctggccaacctgtggctgggctacagcctcatcagctttgatggctgcctgacccagatgttcttcatccacttcctgttcatccacagcgctgtgctgctggccatggcctttgaccgctacgtggccatctgcagccccctgcgctacgtgaccatcctgaccagcaaggtgattggcaagatcgtgacagctgccctgagccacagcttcatcatcatgttccccagcatcttcctgctggagcacctgcactactgccagatcaacatcatcgcccacaccttctgtgagcacatgggcatcgcccacctgagctgcagcgacatcagcatcaacgtgtggtacggcctggccgccgccctgctgagcacaggcctggacatcatgctgatcaccgtgtcctacatccacatcctgcaggccgtgttccggctgctgagccaggatgcccggagcaaggccctgagcacctgtggcagccacatctgtgtgatcctgctcttctacgtgcctgccctcttctctgtgtttgcctacagatttggaggccgctctgtgccctgctacgtgcacatcctgctggccagcctgtatgtggtgatcccccccatgctgaaccctgtgatctacggcgtgaggaccaagcccatcctggagggcgccaagcagatgttcagcaacctggccaagggcagcaagtag

SEQ ID NO: 36557 - DNA, 957 bp, Artificial Sequence
  Description of Artificial Sequence: Synthetic coding sequence
atgtctgacagcaacctgagtgacaaccacctgcctgacaccttcttcctgaccggcatccctggcctggaggccgcccacttctggatcgccatccccttctgtgccatgtacctggtggccctggtgggcaatgctgccctgatcctggtgattgccatggacaatgccctgcacgcccccatgtacctgttcctgtgcctgctgagcctgacagacctggccctgagcagcaccaccgtgcccaagatgctggccatcctgtggctgcacgccggggagatcagctttggaggctgcctggcccagatgttctgtgtgcacagcatctatgccctggagagcagcatcctgctggccatggcctttgaccgctacgtggccatctgcaaccccctgcgctacaccaccatcctgaaccacgccgtcatcggcagaattggatttgtgggcctcttccgctctgtggccatcgtgagccccttcatcttcctgctgcggcggctgccctactgcggccaccgggtgatgacccacacctactgtgagcacatgggcatcgcccggctggcctgtgccaacatcaccgtgaacatcgtgtatggcctgactgtggccctgctggccatgggcctggacagcatcctgattgccatctcctatggcttcatcctgcatgctgtgttccacctgcccagccatgatgcccagcacaaggccctgagcacctgtggcagccacatcggcatcatcctggtgttctacatcccagccttcttctccttcctgacccacagatttggccaccacgaggtgcccaagcacgtgcacatcttcctggccaacctgtatgtgctggtgccccctgtgctgaaccccatcctgtatggagcccggaccaaggagatccgcagccggctgctgaagctgctgcacctgggcaagaccagcatctag

SEQ ID NO: 36558 - DNA, 978 bp, Artificial Sequence
  Description of Artificial Sequence: Synthetic coding sequence
atgttcctgcccaatgacacccagttccaccccagcagcttcctgctgctgggcatccctggcctggagaccctgcacatctggattggcttccccttctgtgctgtgtacatgattgccctgattggcaacttcaccatcctgctggtgatcaagacagacagcagcctgcaccagcccatgttctacttcctggccatgctggccaccacagatgtgggcctgagcacagccaccatccccaagatgctgggcatcttctggatcaacctgcggggcatcatctttgaggcctgcctgacccagatgttcttcatccacaacttcaccctgatggagagcgctgtgctggtggccatggcctatgacagctatgtggccatctgcaaccccctgcagtacagcgccatcctgaccaacaaggtggtgtctgtcatcggcctgggcgtgtttgtgcgggccctgatctttgtgatccccagcatcctgctgatcctgcggctgcccttctgtggcaaccacgtgatcccccacacctactgtgagcacatgggcctggcccacctgagctgtgccagcatcaagatcaacatcatctacggcctgtgtgccatctgcaacctggtgtttgacatcaccgtgattgccctgtcctatgtgcacatcctgtgtgctgtgttccggctgcccacccatgaggcccggctgaagagcctgagcacctgtggcagccacgtgtgtgtgatcctggccttctacaccccagccctcttctccttcatgacccacagatttggaagaaatgtgccccgctacatccacatcctgctggccaacctgtatgtggtggtgccccccatgctgaaccctgtgatctatggagtgaggaccaagcagatctacaagtgtgtgaagaagatcctgctgcaggagcagggcatggagaaggaggagtacctgatccacacccgcttctag

SEQ ID NO: 36559 - DNA, 939 bp, Artificial Sequence
  Description of Artificial Sequence: Synthetic coding sequence
atgcccagcatcaatgacacccacttctacccacccttcttcctgctgctgggcatccctggcctggacaccctgcacatctggatctccttccccttctgcatcgtgtacctgattgccatcgtgggcaacatgaccatcctgtttgtgatcaagacagagcacagcctgcaccagcccatgttctacttcctggccatgctgtccatgattgacctgggcctgagcaccagcaccatccccaagatgctgggcatcttctggttcaacctgcaggagatcagctttggaggctgcctgctgcagatgttcttcatccacatgttcaccggcatggagaccgtgctgctggtggtgatggcctatgacagatttgtggccatctgcaaccccctgcagtacaccatgatcctgaccaacaagaccatcagcatcctggcctctgtggtggtgggcaggaacctggtgctggtgaccccatttgtgttcctgatcctgcggctgcccttctgtggccacaacatcgtgccccacacctactgtgagcaccggggcctggccggcctggcctgtgcccccatcaagatcaacatcatctacggcctgatggtgatctcctacatcatcgtggatgtgatcctgattgccagcagctatgtgctgatcctgcgggctgtgttccggctgcccagccaggatgtgcggctgaaggccttcaacacctgtggcagccacgtgtgtgtgatgctgtgcttctacaccccagccttcttctccttcatgacccacagatttggccagaacatcccccactacatccacatcctgctggccaacctgtatgtggtggtgcccccagccctgaaccctgtgatctatggagtgaggaccaagcagatccgggagcagatcgtgaagatctttgtgcagaaggagtag

SEQ ID NO: 36560 - DNA, 942 bp, Artificial Sequence
  Description of Artificial Sequence: Synthetic coding sequence
atgcccatcgccaatgacacccagttccacaccagcagcttcctgctgctgggcatccctggcctggaggatgtgcacatctggattggcttccccttcttctctgtgtacctgattgccctgctgggcaatgctgccatcttctttgtgatccagacagagcagagcctgcacgagcccatgtactactgcctggccatgctggacagcattgacctgagcctgagcacagccaccatccccaagatgctgggcatcttctggttcaacatcaaggagatcagctttggaggctacctgagccagatgttcttcatccacttcttcaccgtgatggagagcatcgtgctggtggccatggcctttgaccgctacatcgccatctgcaagcccctgtggtacaccatgatcctgaccagcaagatcatcagcctgattgctggcattgctgtgctgcggagcctgtacatggtgatccccctggtgttcctgctgctgcggctgcccttctgtggccaccgcatcatcccccacacctactgtgagcacatgggcatcgcccggctggcctgtgccagcatcaaggtgaacatcatgtttggcctgggcagcatcagcctgctgctgctggatgtgctgctgatcatcctgagccacatccgcatcctgtatgctgtgttctgcctgcccagctgggaggcccggctgaaggccctgaacacctgtggcagccacatcggggtcatcctggccttcagcaccccagccttcttctccttcttcacccactgctttggacatgacatcccccagtacatccacatcttcctggccaacctgtatgtggtggtgccccccaccctgaaccctgtgatctatggagtgaggaccaagcacatccgggagaccgtgctgcgcatcttcttcaagacagaccactag

SEQ ID NO: 36561 - DNA, 954 bp, Artificial Sequence
  Description of Artificial Sequence: Synthetic coding sequence
atggagaagaggatgcccatcgccaatgacacccagttccacaccagcagcttcctgctgctgggcatccctggcctggaggatgtgcacatctggattggcttccccttcttctctgtgtacctgattgccctgctgggcaatgctgccatcttctttgtgatccagacagagcagagcctgcacgagcccatgtactactgcctggccatgctggacagcattgacctgagcctgagcacagccaccatccccaagatgctgggcatcttctggttcaacatcaaggagatcagctttggaggctacctgagccagatgttcttcatccacttcttcaccgtgatggagagcatcgtgctggtggccatggcctttgaccgctacatcgccatctgcaagcccctgtggtacaccatgatcctgaccagcaagatcatcagcctgattgctggcattgctgtgctgcggagcctgtacatggtgatccccctggtgttcctgctgctgcggctgcccttctgtggccaccgcatcatcccccacacctactgtgagcacatgggcatcgcccggctggcctgtgccagcatcaaggtgaacatcatgtttggcctgggcagcatcagcctgctgctgctggatgtgctgctgatcatcctgagccacatccgcatcctgtatgctgtgttctgcctgcccagctgggaggcccggctgaaggccctgaacacctgtggcagccacatcggggtcatcctggccttcagcaccccagccttcttctccttcttcacccactgctttggacatgacatcccccagtacatccacatcttcctggccaacctgtatgtggtggtgccccccaccctgaaccctgtgatctatggagtgaggaccaagcacatccgggagaccgtgctgcgcatcttcttcaagacagaccactag

SEQ ID NO: 36562 - DNA, 954 bp, Artificial Sequence
  Description of Artificial Sequence: Synthetic coding sequence
atggccggccgcatgagcaccagcaaccacacccagttccaccccagcagcttcctgctgctgggcatccctggcctggaggatgtgcacatctggattggagtgcccttcttctttgtgtacctggtggccctgctgggcaacacagccctgctgtttgtgatccagacagagcagagcctgcacgagcccatgtactacttcctggccatgctggacagcattgacctgggcctgagcacagccaccatccccaagatgctgggcatcttctggttcaacaccaaggagatcagctttggaggctgcctgagccacatgttcttcatccacttcttcaccgccatggagagcatcgtgctggtggccatggcctttgaccgctacatcgccatctgcaagcccctgcgctacaccatgatcctgaccagcaagatcatcagcctgattgctggcattgctgtgctgcggagcctgtacatggtggtgcccctggtgttcctgctgctgcggctgcccttctgtggccaccgcatcatcccccacacctactgtgagcacatgggcatcgcccggctggcctgtgccagcatcaaggtgaacatccgcttcggcctgggcaacatcagcctgctgctgctggatgtgatcctgatcatcctgtcctatgtgcgcatcctgtatgctgtgttctgcctgcccagctgggaggcccggctgaaggccctgaacacctgtggcagccacatcggggtcatcctggccttcttcaccccagccttcttctccttcctgacccacagatttggccacaacatcccccagtacatccacatcatcctggccaacctgtatgtggtggtgcccccagccctgaaccctgtgatctatggagtgaggaccaagcagatccgggagcgggtgctgcgcatcttcctgaagaccaaccactag

SEQ ID NO: 36563 - DNA, 963 bp, Artificial Sequence
  Description of Artificial Sequence: Synthetic coding sequence
atgcccagcgccagcgccatgatcatcttcaacctgagcagctacaaccctggccccttcatcctggtgggcatccctggcctggagcagttccacgtgtggattggcatccccttctgcatcatctacatcgtggccgtggtgggcaactgcatcctgctgtacctgattgtggtggagcacagcctgcacgagcccatgttcttcttcctgtccatgctggccatgacagacctgatcctgagcacagctggggtgcccaaggccctgagcatcttctggctgggcgcccgggagatcaccttccctggctgcctgacccagatgttcttcctgcactacaactttgtgctggacagcgccatcctgatggccatggcctttgaccactacgtggccatctgcagccccctgcgctacaccaccatcctgacccccaagaccatcatcaagagcgccatgggcatctccttccgctccttctgcatcatcctgcctgatgtgttcctgctgacctgcctgcccttctgcaggacccgcatcatcccccacacctactgtgagcacatcggcgtggcccagctggcctgtgccgacatcagcatcaacttctggtacggcttctgtgtgcccatcatgaccgtcatcagtgatgtgatcctgattgctgtgtcctatgcccacatcctgtgtgctgtgtttggcctgcccagccaggatgcctgccagaaggccctgggcacctgtggcagccacgtgtgtgtgatcctgatgttctacaccccagccttcttcagcatcctggcccaccgcttcggccacaacgtgtccaggaccttccacatcatgtttgccaacctgtacatcgtcatccccccagccctgaaccccatggtgtatggagtgaagaccaagcagatccgggacaaggtgatcctgctcttcagcaaaggaactggatag

SEQ ID NO: 36564 - DNA, 1047 bp, Artificial Sequence
  Description of Artificial Sequence: Synthetic coding sequence
acccaggtgcccaaggactgcaccatcctgctgcaccacctgtacatcaaccggcaggaggtgtcccctgtgatgctgggccctgcctacaaccacaccatggagaccccagccagcttcctgctggtgggcatccctggcctgcagagcagccacctgtggctggccatcagcctgagcgccatgtacatcacagccctgctgggcaacaccctgattgtgacagccatctggatggacagcaccaggcatgagcccatgtactgcttcctgtgtgtgctggccgctgtggacatcgtgatggccagctctgtggtgcccaagatggtgtccatcttctgcagcggggacagcagcatctccttcagcgcctgcttcacccagatgttctttgtgcacctggccacagctgtggagaccggcctgctgctgaccatggcctttgacagatatgtggccatctgcaagcccctgcactacaagaggatcctgaccccccaggtgatgctgggcatgtccatggctgtgaccatccgggctgtgaccttcatgacccccctgtcctggatgatgaaccacctgcccttctgtggcagcaatgtggtggtgcacagctactgcaagcacatcgccctggcccggctggcctgtgccgaccctgtgcccagcagcctgtacagcctgattggcagcagcctgatggtgggcagtgatgtggccttcatcgccgccagctacatcctgatcctgcgggctgtgtttgacctgagcagcaagacagcccagctgaaggccctgagcacctgtggcagccacgtgggcgtgatggccctgtactacctgcccggcatggccagcatctatgctgcctggctgggccaggacatcgtgcccctgcacacccaggtgctgctggccgacctgtatgtgatcatcccagccaccctgaaccccatcatctacggcatgaggaccaagcagctgctggagggcatctggagctacctgatgcacttcctgtttgaccacagcaacctgggcagctag

SEQ ID NO: 36565 - DNA, 975 bp, Artificial Sequence
  Description of Artificial Sequence: Synthetic coding sequence
atgctgggccctgcctacaaccacaccatggagaccccagccagcttcctgctggtgggcatccctggcctgcagagcagccacctgtggctggccatcagcctgagcgccatgtacatcacagccctgctgggcaacaccctgattgtgacagccatctggatggacagcaccaggcatgagcccatgtactgcttcctgtgtgtgctggccgctgtggacatcgtgatggccagctctgtggtgcccaagatggtgtccatcttctgcagcggggacagcagcatctccttcagcgcctgcttcacccagatgttctttgtgcacctggccacagctgtggagaccggcctgctgctgaccatggcctttgacagatatgtggccatctgcaagcccctgcactacaagaggatcctgaccccccaggtgatgctgggcatgtccatggctgtgaccatccgggctgtgaccttcatgacccccctgtcctggatgatgaaccacctgcccttctgtggcagcaatgtggtggtgcacagctactgcaagcacatcgccctggcccggctggcctgtgccgaccctgtgcccagcagcctgtacagcctgattggcagcagcctgatggtgggcagtgatgtggccttcatcgccgccagctacatcctgatcctgcgggctgtgtttgacctgagcagcaagacagcccagctgaaggccctgagcacctgtggcagccacgtgggcgtgatggccctgtactacctgcccggcatggccagcatctatgctgcctggctgggccaggacatcgtgcccctgcacacccaggtgctgctggccgacctgtatgtgatcatcccagccaccctgaaccccatcatctacggcatgaggaccaagcagctgctggagggcatctggagctacctgatgcacttcctgtttgaccacagcaacctgggcagctag

SEQ ID NO: 36566 - DNA, 1053 bp, Artificial Sequence
  Description of Artificial Sequence: Synthetic coding sequence
atgtgccagcagatcctgcgggactgcatcctgctgatccaccacctgtgcatcaacaggaagaaggtgtccctggtgatgctgggccctgcctacaaccacaccatggagaccccagccagcttcctgctggtgggcatccctggcctgcagagcagccacctgtggctggccatcagcctgagcgccatgtacatcatcgccctgctgggcaacaccatcatcgtgacagccatctggatggacagcaccaggcatgagcccatgtactgcttcctgtgtgtgctggccgctgtggacatcgtgatggccagctctgtggtgcccaagatggtgtccatcttctgcagcggggacagcagcatctccttcagcgcctgcttcacccagatgttctttgtgcacctggccacagctgtggagaccggcctgctgctgaccatggcctttgacagatatgtggccatctgcaagcccctgcactacaagaggatcctgaccccccaggtgatgctgggcatgtccatggccatcaccatccgggccatcatcgccatcacccccctgtcctggatggtgagccacctgcccttctgtggcagcaatgtggtggtgcacagctactgtgagcacatcgccctggcccggctggcctgtgccgaccctgtgcccagcagcctgtacagcctgattggcagcagcctgatggtgggcagtgatgtggccttcatcgccgccagctacatcctgatcctgaaggctgtgtttggcctgagcagcaagacagcccagctgaaggccctgagcacctgtggcagccacgtgggcgtgatggccctgtactacctgcccggcatggccagcatctatgctgcctggctgggccaggatgtggtgcccctgcacacccaggtgctgctggccgacctgtatgtgatcatcccagccaccctgaaccccatcatctacggcatgaggaccaagcagctgcgggagcgcatctggagctacctgatgcacgtgctgtttgaccacagcaacctgggcagctag

SEQ ID NO: 36567 - DNA, 936 bp, Artificial Sequence
  Description of Artificial Sequence: Synthetic coding sequence
atgttctaccacaacaagagcatcttccaccctgtgaccttcttcctgattggcatccctggcctggaggacttccacatgtggatcagcggccccttctgcagcgtgtacctggtggccctgctgggcaatgccaccatcctgctggtgatcaaggtggagcagaccctgcgggagcccatgttctacttcctggccatcctgagcaccatcgacctggccctgagcaccacctctgtgcccaggatgctgggcatcttctggtttgatgcccacgagatcaactacggggcctgtgtggcccagatgttcctgattcatgccttcaccggcatggaggccgaggtgctgctggccatggcctttgacagatatgtggccgtgtgtgcccccctgcactacgccaccatcctgaccagccaggtgctggtgggcatctccatgtgcatcgtcatccggcctgtgctgctgaccctgcccatggtgtacctgatctaccgcctgcccttctgccaggcccacatcatcgcccacagctactgtgagcacatgggcatcgccaagctgagctgtggcaacatccgcatcaatggcatctacggcctgtttgtggtgtccttctttgtgctgaacctggtgctgattggcatctcctatgtgtacatcctgcgggctgtgttccggctgcccagccatgatgcccagctgaaggccctgagcacctgtggggcccacgtgggcgtcatctgtgtgttctacatccccagcgtcttctccttcctgacccacagatttggccaccagatccctggctacatccacatcctggtggccaacctgtacctgatcatcccccccagcctgaaccccatcatctatggagtgaggaccaagcagatccgggagcgggtgctgtatgtgttcaccaagaagtag

SEQ ID NO: 36568 - DNA, 945 bp, Artificial Sequence
  Description of Artificial Sequence: Synthetic coding sequence
atgctgcccagcaacatcaccagcacccaccctgctgtgttcctgctggtgggcatccctggcctggagcacctgcacgcctggatcagcatccccttctgctttgcctacaccctggccctgctgggcaactgcaccctgctcttcatcatccaggctgatgctgccctgcacgagcccatgtacctgttcctggccatgctggccaccatcgacctggtgctgagcagcaccaccctgcccaagatgctggccatcttctggttccgggaccaggagatcaacttctttgcctgcctggtgcagatgttcttcctgcacagcttcagcatcatggagagcgctgtgctgctggccatggcctttgacagatatgtggccatctgcaagcccctgcactacaccaccgtgctgaccggcagcctcatcaccaagattggcatggctgctgtggcccgggctgtgaccctgatgacccccctgcccttcctgctgcggcgcttccactactgccggggccctgtgattgcccactgctactgtgagcacatggctgtggtgcggctggcctgtggggacaccagcttcaacaacatctacggcattgctgtggccatgttcatcgtggtgctggacctgctgtttgtgatcctgtcctatgtgttcatcctgcaggccgtgctgcagctggccagccaggaggcccgctacaaggccttcggcacctgtgtgagccacatcggggccatcctgagcacctacacccctgtggtgatcagctctgtgatgcaccgggtggcccggcatgctgccccccgggtgcacatcctgctggccatcttctacctgctcttcccccccatggtgaaccccatcatctacggcgtgaagaccaagcagatccgggagtatgtgctgagcctcttccagaggaagaacatgtag

SEQ ID NO: 36569 - DNA, 945 bp, Artificial Sequence
  Description of Artificial Sequence: Synthetic coding sequence
atgtctgccagcaacatcaccctgacccaccccacagccttcctgctggtgggcatccctggcctggagcacctgcacatctggatcagcatccccttctgcctggcctacaccctggccctgctgggcaactgcaccctgctgctgatcatccaggctgatgctgccctgcacgagcccatgtacctgttcctggccatgctggccgccatcgacctggtgctgagcagcagcgccctgcccaagatgctggccatcttctggttccgggaccgggagatcaacttctttgcctgcctggcccagatgttcttcctgcacagcttcagcatcatggagagcgctgtgctgctggccatggcctttgacagatatgtggccatctgcaagcccctgcactacaccaaggtgctgaccggcagcctcatcaccaagattggcatggctgctgtggcccgggctgtgaccctgatgacccccctgcccttcctgctgcgctgcttccactactgccggggccctgtgattgcccactgctactgtgagcacatggctgtggtgcggctggcctgtggggacaccagcttcaacaacatctacggcattgctgtggccatgttcatcgtggtgctggacctgctgctggtgatcctgagctacatcttcatcctgcaggccgtgctgctgctggccagccaggaggcccgctacaaggccttcggcacctgtgtgagccacatcggggccatcctggccttctacaccaccgtggtgatcagctctgtgatgcaccgggtggcccggcatgctgcccctcatgtgcacatcctgctggccaacttctacctgctcttcccccccatggtgaaccccatcatctacggcgtgaagaccaagcagatccgggagagcatcctgggcgtcttccccaggaaggacatgtag

SEQ ID NO: 36570 - DNA, 990 bp, Artificial Sequence
  Description of Artificial Sequence: Synthetic coding sequence
atgaccctggtgtccttcttctccttcctgagcaagcccctcatcatgctgctgagcaacagctcctggaggctgagccagcccagcttcctgctggtgggcatccctggcctggaggagagccagcactggatcgccctgcccctgggcatcctgtacctgctggccctggtgggcaatgtgaccatcctcttcatcatctggatggaccccagcctgcaccagagcatgtacctgttcctgtccatgctggccgccatcgacctggtgctggccagcagcacagcccccaaggccctggccgtgctgctggtgcacgcccacgagatcggctacatcgtgtgcctgatccagatgttcttcatccacgccttcagctccatggagagcggcgtgctggtggccatggccctggactgctacgtggccatctgccaccccctgcaccacagcaccatcctgcaccctggggtgattggctgcatcggcatggtggtgctggtgcggggcctgctgctgctgatccccttccccatcctgctgggcaagctgatcttctgccaggccaccatcatcggccacgcctactgtgagcacatggctgtggtgaagctggcctgcagcgagaccaccgtgaacagagcctacggcctgaccatggccctgctggtgattggcctggatgtgctggccatcggcgtgtcctatgcccacatcctgcaggccgtgctgaaggtgcccggcagcgaggcccggctgaaggccttcagcacctgtggcagccacatctgtgtgatcctggtgttctacgtgcccggcatcttctccttcctgacccaccgcttcggccaccacgtgccccaccacgtgcacgtgctgctggccacctggtacctgctgatgcccccagccctgaaccccctggtgtatggagtgaagacccagcagatccggcagagggtgctgcgggtcttcacccagaaggactag

SEQ ID NO: 36571 - DNA, 954 bp, Artificial Sequence
  Description of Artificial Sequence: Synthetic coding sequence
atgctgaccttccacaacgtgtgcagcgtgcccagcagcttctggctgaccggcatccctggcctggagagcctgcacgtgtggctgagcatccccttcggctccatgtacctggtggccgtggtgggcaatgtgaccatcctggccgtggtgaagattgaaagaagcctgcaccagcccatgtacttcttcctgtgcatgctggccgccatcgacctggtgctgagcaccagcaccatccccaagctgctgggcatcttctggtttggagcctgtgacatcggcctggatgcctgcctgggccagatgttcctgatccactgctttgccaccgtggagagcggcatcttcctggccatggcctttgacagatatgtggccatctgcaaccccctgcggcacagcatggtgctgacctacacagtggtgggccgcctgggcctggtgtccctgctgcggggcgtgctgtacatcggccccctgcccctgatgatccggctgcggctgcccctgtacaagacccacgtgatcagccacagctactgtgagcacatggctgtggtggccctgacctgtggggacagccgggtgaacaacgtgtatggcctgagcatcggcttcctggtgctgatcctggacagcgtggccatcgccgccagctatgtgatgatcttccgggctgtgatgggcctggccaccccagaggcccggctgaagaccctgggcacctgtgccagccacctgtgtgccatcctgatcttctacgtgcccatcgctgtgagcagcctcatccacagatttggccagtgtgtgcccccacctgtgcacaccctgctggccaacttctacctgctgatcccccccatcctgaaccccatcgtgtatgctgtgaggaccaagcagatccgggagagcctgctgcagatcccccgcatcgagatgaagatcagatag

SEQ ID NO: 36572 - DNA, 963 bp, Artificial Sequence
  Description of Artificial Sequence: Synthetic coding sequence
atgtccttcctgaatggcaccagcctgaccccagccagcttcatcctgaatggcatccctggcctggaggatgtgcacctgtggatctccttccccctgtgcaccatgtacagcatcgccatcaccggcaactttggcctgatgtacctgatctactgtgatgaggccctgcaccggcccatgtatgtgttcctggccctgctgtccttcacagatgtgctgatgtgcaccagcaccctgcccaacaccctcttcatcctgtggttcaacctgaaggagattgacttcaaggcctgcctggcccagatgttctttgtgcacaccttcaccggcatggagagcggcgtgctgatgctgatggccctggaccactgtgtggccatctgcttccccctgcgctatgccaccatcctgaccaacagcgtgattgccaaggccggcttcctgaccttcctgcggggcgtgatgctggtgatccccagcaccttcctgaccaagaggctgccctactgcaagggaaatgtcatcccccacacctactgtgaccacatgtctgtggccaagatcagctgtggaaatgtgcgggtgaatgccatctacggcctgattgtggccctgctgattggaggctttgacatcctgtgcatcaccatctcctacaccatgatcctgcaggccgtggtgtccctgagcagcgcagatgcccggcagaaggccttcagcacctgcacagcccacttctgtgccatcgtgctgacctacgtgcctgccttcttcaccttcttcacccaccactttggaggccacaccatccccctgcacatccacatcatcatggccaacctgtacctgctgatgccacccaccatgaaccccatcgtgtatggagtgaagacccggcaggtgcgggagagcgtcatccgcttcttcctgaagggcaaggacaacagccacaacttctag

SEQ ID NO: 36573 - DNA, 966 bp, Artificial Sequence
  Description of Artificial Sequence: Synthetic coding sequence
atgtctggggacaacagcagcagcctgaccccaggcttcttcatcctgaatggagtgcccggcctggaggccacccacatctggatcagcctgcccttctgcttcatgtacatcatcgctgtggtgggcaactgtggcctcatctgcctgatcagccatgaggaggccctgcaccggcccatgtactacttcctggccctgctgtccttcacagatgtgaccctgtgcaccaccatggtgcccaacatgctgtgcatcttctggttcaacctgaaggagattgacttcaatgcctgcctggcccagatgttctttgtgcacatgctgaccggcatggagagcggcgtgctgatgctgatggccctggacagatatgtggccatctgctaccccctgcgctatgccaccatcctgaccaaccctgtgattgccaaggccggcctggccaccttcctgagaaatgtgatgctgatcatccccttcaccctgctgaccaagaggctgccctactgccggggcaacttcatcccccacacctactgtgaccacatgtctgtggccaaggtgtcctgtggcaacttcaaggtgaatgccatctacggcctgatggtggccctgctgattggagtgtttgacatctgctgcatctctgtgtcctacaccatgatcctgcaggccgtgatgagcctgagcagcgcagatgcccggcacaaggccttcagcacctgcaccagccacatgtgcagcatcgtcatcacctacgtggccgccttcttcaccttcttcacccacagatttgtgggccacaacatccccaaccacatccacatcatcgtggccaacctgtacctgctgctgccccccaccatgaaccccatcgtgtatggagtgaagaccaagcagatccaggagggcgtcatcaagttcctgctgggggacaaggtgtccttcacctatgacaagtag

SEQ ID NO: 36574 - DNA, 966 bp, Artificial Sequence
  Description of Artificial Sequence: Synthetic coding sequence
atgctgaccctgaacaagacagacctgatcccagccagcttcatcctgaatggagtgcccggcctggaggacacccagctgtggatctccttccccttctgcagcatgtatgtggtggccatggtgggcaactgtggcctgctgtacctgatccactatgaagatgccctgcacaagcccatgtactacttcctggccatgctgtccttcacagacctggtgatgtgcagcagcaccatccccaaggccctgtgcatcttctggttccacctgaaggacatcggctttgatgagtgcctggtgcagatgttcttcacccacaccttcaccggcatggagagcggcgtgctgatgctgatggccctggacagatatgtggccatctgctaccccctgcgctacagcaccatcctgaccaaccctgtgattgccaaggtgggcacagccaccttcctgcggggcgtgctgctgatcatccccttcaccttcctgaccaagctgctgccctactgccggggcaacatcctgccccacacctactgtgaccacatgtctgtggccaagctgagctgtggaaatgtgaaggtgaatgccatctacggcctgatggtggccctgctgatctggggctttgacatcctgtgcatcaccaacagctacaccatgatcctgcgggctgtggtgtccctgagcagcgcagatgcccggcagaaggccttcaacacctgcacagcccacatctgtgccatcgtgttctcctacaccccagccttcttctccttcttcagccacagatttggagagcacatcatcccccccagctgccacatcatcgtggccaacatctacctgctgctgccccccaccatgaaccccatcgtgtatggagtgaagaccaagcagatccgggactgtgtgatccgcatcctgagcggcagcaaggacaccaagagctacagcatgtag

SEQ ID NO: 36575 - DNA, 975 bp, Artificial Sequence
  Description of Artificial Sequence: Synthetic coding sequence
atgcccctcttcaacagcctgtgctggttccccaccatccacgtgaccccacccagcttcatcctgaatggcatccctggcctggagcgggtgcacgtgtggatcagcctgcccctgtgcaccatgtacatcatcttcctggtgggcaacctgggcctggtgtacctgatctactatgaggagagcctgcaccaccccatgtacttcttctttggacatgccctgagcctgattgacctgctgacctgcaccaccaccctgcccaatgccctgtgcatcttctggttcagcctgaaggagatcaacttcaatgcctgcctggcccagatgttctttgtgcacggcttcaccggggtggagagcggcgtgctgatgctgatggccctggaccgctacgtggccatctgctaccccctgcgctatgccaccaccctgaccaaccccatcatcgccaaggccgagctggccaccttcctgcggggcgtgctgctgatgatccccttccccttcctggtgaagaggctgcccttctgccagagcaacatcatcagccacacctactgtgaccacatgtctgtggtgaagctgagctgtgccagcatcaaggtgaatgtcatctacggcctgatggtggccctgctgattggagtgtttgacatctgctgcatcagcctgagctacaccctcatcctgaaggccgccatcagcctgagcagcagtgatgcccggcagaaggccttcagcacctgcacagcccacatcagcgccatcatcatcacctacgtgcctgccttcttcaccttctttgcccacagatttggaggccacaccatcccccccagcctgcacatcatcgtggccaacctgtacctgctgctgccccccaccctgaaccccatcgtgtatggagtgaagaccaagcagatcaggaagagcgtcatcaagttcttccagggcgacaagggagctggatag

SEQ ID NO: 36576 - DNA, 948 bp, Artificial Sequence
  Description of Artificial Sequence: Synthetic coding sequence
atggtgctggccagcggcaacagcagcagccaccctgtgtccttcatcctgctgggcatccctggcctggagagcttccagctgtggatcgccttccccttctgtgccacctatgctgtggccgtggtgggcaacatcaccctgctgcacgtgatcagaattgaccacaccctgcacgagcccatgtacctgttcctggccatgctggccatcacagacctggtgctgagcagcagcacccagcccaagatgctggccatcttctggttccacgcccacgagatccagtaccacgcctgcctgatccaggtgttcttcatccacgccttcagctctgtggagagcggcgtgctgatggccatggccctggactgctacgtggccatctgcttccccctgcggcacagcagcatcctgacccccagcgtggtgatcaagctgggcaccatcgtgatgctgcggggcctgctgtgggtgagccccttctgcttcatggtgtccaggatgcccttctgccagcaccaggccatcccccagagctactgtgagcacatggctgtgctgaagctggtgtgtgccgacaccagcatcagcagaggaaatggcctgtttgtggccttctctgtggccggctttgacatgattgtgattggcatgtcctatgtgatgatcctgcgggctgtgctgcagctgcccagcggggaggcccggctgaaggccttcagcaccaggagcagccacatctgtgtgatcctggccctgtacatcccagccctcttctccttcctgacctacagatttggacatgatgtgccccgggtggtgcacatcctgtttgccaacctgtacctgctgatcccccccatgctgaaccccatcatctatggagtgaggaccaagcagatcggggacagagtcatccagggctgctgcggcaacatcccctag

SEQ ID NO: 36577 - DNA, 1185 bp, Artificial Sequence
  Description of Artificial Sequence: Synthetic coding sequence
atgttctaccccatcctgaatgacatcagcaccaagaacaacagcaacatcatgagctgctgcaacatcctcttcatcaagacagtggagatcatcctggtgtacaaccagacccagagcccctggtaccccatcgtgcccagcaagagcctggtgtacaacaacaacacctgctttgactgctaccacctgcagagggtggactgtgtgcccagccgggaccacatcaaccagagcatggtgctggccagcggcaacagcagcagccaccctgtgtccttcatcctgctgggcatccctggcctggagagcttccagctgtggatcgccttccccttctgtgccacctatgctgtggccgtggtgggcaacatcaccctgctgcacgtgatcagaattgaccacaccctgcacgagcccatgtacctgttcctggccatgctggccatcacagacctggtgctgagcagcagcacccagcccaagatgctggccatcttctggttccacgcccacgagatccagtaccacgcctgcctgatccaggtgttcttcatccacgccttcagctctgtggagagcggcgtgctgatggccatggccctggactgctacgtggccatctgcttccccctgcggcacagcagcatcctgaccccatctgtggtgatcaagctgggcaccatcgtgatgctgcggggcctgctgtgggtgagccccttctgcttcatggtgtccaggatgcccttctgccagcaccaggccatcccccagagctactgtgagcacatggctgtgctgaagctggtgtgtgccgacaccagcatcagcagaggaaatggcctgtttgtggccttctctgtggccggctttgacatgatcgtcatcggcatgtcctatgtgatgatcctgcgggctgtgctgcagctgcccagcggggaggcccggctgaaggccttcagcaccaggagcagccacatctgtgtgatcctggccctgtacatcccagccctcttctccttcctgacctaccgcttcggccatgatgtgccccgggtggtgcacatcctgtttgccaacctgtacctgctgatcccccccatgctgaaccccatcatctacggcgtgaggaccaagcagattggagacagagtcatccagggctgctgcggcaacatcccctag

SEQ ID NO: 36578 - DNA, 963 bp, Artificial Sequence
  Description of Artificial Sequence: Synthetic coding sequence
atggccgagaccctgcagctgaacagcaccttcctgcaccccaacttcttcatcctgaccggcttccctggcctgggcagcgcccagacctggctgaccctggtgtttggccccatctacctgctggccctgctgggcaatggagccctgcctgctgtggtgtggattgacagcaccctgcaccagcccatgttcctgctgctggccatcctggccgccacagacctgggcctggccaccagcatcgcccctggcctgctggccgtgctgtggctgggccccaggtctgtgccctatgctgtgtgcctggtgcagatgttctttgtgcacgccctgacagccatggagagcggcgtgctgctggccatggcctgtgacagagctgctgccatcggccggcccctgcactaccctgtgctggtgaccaaggcctgtgtgggctatgctgccctggccctggccctgaaggctgtggccatcgtggtgcccttccccctgctggtggccaagtttgagcacttccaggccaagaccatcggccacacctactgtgcccacatggctgtggtggagctggtggtgggcaacacccaggccaccaacctgtatggcctggccctgagcctggccatcagcggcatggacatcctgggcatcaccggcagctatggcctcatcgcccatgctgtgctgcagctgcccacccgggaggcccacgccaaggccttcggcacctgcagcagccacatctgtgtgatcctggccttctacatccctggcctcttctcctacctgacccacagatttggccaccacacagtgcccaagcctgtgcacatcctgctgagcaacatctacctgctgctgcccccagccctgaaccccctcatctacggggcccggaccaagcagatccgggaccggctgctggagaccttcaccttcaggaagagccccctgtag

SEQ ID NO: 36579 - DNA, 957 bp, Artificial Sequence
  Description of Artificial Sequence: Synthetic coding sequence
atgatccagcccatggccagccccagcaacagcagcacagtgcctgtgtctgagttcctgctgatctgcttccccaacttccagagctggcagcactggctgagcctgcccctgagcctgctcttcctgctggccatgggcgccaacaccaccctgctgatcaccatccagctggaggccagcctgcaccagcccctgtactacctgctgagcctgctgagcctgctggacatcgtgctgtgcctgaccgtcatccccaaggtgctggccatcttctggtatgacctgcggagcatctccttccctgcctgcttcctgcagatgttcatcatgaacagcttcctgcccatggagagctgcaccttcatggtgatggcctatgaccgctacgtggccatctgccaccccctgcgctaccccagcatcatcaccaaccagtttgtggccaaggccagcgtcttcatcgtggtgagaaatgccctgctgacagcccccatccccatcctgaccagcctgctgcactactgtggggagaatgtgattgagaactgcatctgtgccaacctgtctgtgtcccggctgagctgtgacaacttcaccctgaaccgcatctaccagtttgtggccggctggaccctgctgggcagtgacctcttcctgatcttcctgagctacaccttcatcctgcgggctgtgctgcgcttcaaggccgagggcgctgctgtgaaggccctgagcacctgtggcagccacttcatcctgatcctcttcttcagcaccatcctgctggtggtggtgctgaccaacgtggccaggaagaaggtgcccatggacatcctgatcctgctgaatgtgctgcaccacctgatccccccagccctgaaccccatcgtgtatggagtgaggaccaaggagatcaagcagggcatccagaagctgctgcagaggggccgctag

SEQ ID NO: 36580 - DNA, 948 bp, Artificial Sequence
  Description of Artificial Sequence: Synthetic coding sequence
atgaccacccacagaaatgacaccctgagcacagaggccagtgacttcctgctgaactgctttgtgcgcagccccagctggcagcactggctgagcctgcccctgagcctgctcttcctgctggccgtgggcgccaacaccaccctgctgatgaccatctggctggaggccagcctgcaccagcccctgtactacctgctgagcctgctgagcctgctggacatcgtgctgtgcctgaccgtcatccccaaggtgctgaccatcttctggtttgacctgcggcccatctccttccctgcctgcttcctgcagatgtacatcatgaactgcttcctggccatggagagctgcaccttcatggtgatggcctatgacagatatgtggccatctgccaccccctgcgctaccccagcatcatcacagaccactttgtggtgaaggccgccatgttcatcctgaccagaaatgtgctgatgaccctgcccatccccatcctgagcgcccagctgcgctactgcggcagaaatgtgattgagaactgcatctgtgccaacatgtctgtgtcccggctgagctgtgatgatgtgaccatcaaccacctgtaccagtttgctgggggctggaccctgctgggcagtgacctgatcctgatcttcctgagctacaccttcatcctgcgggctgtgctgcggctgaaggccgagggcgctgtggccaaggccctgagcacctgtggcagccacttcatgctgatcctcttcttcagcaccatcctgctggtgtttgtgctgacccacgtggccaagaagaaggtgtccccagatgtgcctgtgctgctgaatgtgctgcaccacgtgatcccagctgccctgaaccccatcatctacggcgtgaggacccaggagatcaagcagggcatgcagaggctgctgaagaagggctgctag

SEQ ID NO: 36581 - DNA, 1098 bp, Artificial Sequence
  Description of Artificial Sequence: Synthetic coding sequence
atgatgaccgtcatcctgaagaccctgctgggccagatccagggcctgagcggcaacccccacagcaccaccagcaggatgtacttcctgtgcttctgcaccagcctgctgcgcttcaaggtgcactgggtgagccgcctcatcaggaagctgtacatggccagccccagcaatgacagcacagcccctgtgtctgagttcctgctgatctgcttccccaacttccagagctggcagcactggctgagcctgcccctgagcctgctcttcctgctggccatgggcgccaacaccaccctgctgatcaccatccagctggaggccagcctgcaccagcccctgtactacctgctgagcctgctgagcctgctggacatcgtgctgtgcctgaccgtcatccccaaggtgctggccatcttctggtttgacctgcggagcatctccttccctgcctgcttcctgcagatgttcatcatgaacagcttcctgaccatggagagctgcaccttcatggtgatggcctatgaccgctacgtggccatctgccaccccctgcgctaccccagcatcatcacagaccagtttgtggcccgggctgtggtgtttgtgattgccagaaatgcctttgtgtccctgcctgtgcccatgctgagcgcccggctgcgctactgtgccggcaacatcatcaagaactgcatctgcagcaacctgtctgtgtccaagctgagctgtgatgacatcaccttcaaccagctgtaccagtttgtggccggctggaccctgctgggcagtgacctgatcctgattgtcatctcctacagcttcatcctgaaggtggtgctgcgcatcaaggccgagggcgctgtggccaaggccctgagcacctgtggcagccacttcatcctgatcctcttcttcagcacagtgctgctggtgctggtgatcaccaacctggccaggaagaggatccccccagatgtgcccatcctgctgaacatcctgcaccacctgatccccccagccctgaaccccatcgtgtatggagtgaggaccaaggagatcaagcagggcatccagaacctgctgaagaggctgtag

SEQ ID NO: 36582 - DNA, 975 bp, Artificial Sequence
  Description of Artificial Sequence: Synthetic coding sequence
atgaaccacatgtctgccagcctgaagatcagcaacagcagcaagttccaggtgtctgagttcatcctgctgggcttccctggcatccacagctggcagcactggctgagcctgcccctggccctgctgtacctgagcgccctggccgccaacaccctcatcctgatcatcatctggcagaaccccagcctgcagcagcccatgtacatcttcctgggcatcctgtgcatggtggacatgggcctggccaccaccatcatccccaagatcctggccatcttctggtttgatgccaaggtgatcagcctgcctgaatgttttgcccagatctatgccatccacttctttgtgggcatggagagcggcatcctgctgtgcatggcctttgaccgctacgtggccatctgccaccccctgcgctaccccagcatcgtgaccagcagcctcatcctgaaggccaccctcttcatggtgctgagaaatggcctgtttgtgacccctgtgcctgtgctggccgcccagagggactactgcagcaagaatgaaattgagcactgcctgtgcagcaacctgggcgtgaccagcctggcctgtgatgacagaagacccaacagcatctgccagctggtgctggcctggctgggcatgggcagtgacctgagcctcatcatcctgagctacatcctgatcctgtacagcgtgctgcggctgaacagcgctgaggccgccgccaaggccctgagcacctgcagcagccacctgaccctcatcctcttcttctacaccatcgtggtggtgatctctgtgacccacctgacagagatgaaggccaccctcatccctgtgctgctgaatgtgctgcacaacatcatcccccccagcctgaaccccaccgtgtatgccctgcagaccaaggagctgcgggccgccttccagaaggtgctgtttgccctgaccaaggagatccgctcctag

SEQ ID NO: 36583 - DNA, 960 bp, Artificial Sequence
  Description of Artificial Sequence: Synthetic coding sequence
atggacaccagcacctctgtgacctatgacagcagcctgcagatcagccagttcatcctgatgggcctgcccggcatccacgagtggcagcactggctgagcctgcccctgaccctgctgtacctgctggccctgggcgccaacctgctgatcatcatcaccatccagcatgaaacagtgctgcacgagcccatgtaccacctgctgggcatcctggccgtggtggacatcggcctggccaccaccatcatgcccaagatcctggccatcttctggtttgatgccaaggccatcagcctgcccatgtgctttgcccagatctatgccatccactgcttcttctgcatcgagagcggcatcttcctgtgcatggctgtggaccgctacatcgccatctgccggcccctgcagtaccccagcatcgtgaccaaggcctttgtgttcaaggccaccggcttcatcatgctgagaaatggcctgctgaccatccctgtgcccatcctggccgcccagaggcactactgcagcagaaatgaaattgagcactgcctgtgcagcaacctgggcgtcatcagcctggcctgtgatgacatcaccgtgaacaagttctaccagctgatgctggcctgggtgctggtgggcagtgacatggccctggtgttcagcagctatgctgtgatcctgcacagcgtgctgcggctgaacagcgctgaggccatgagcaaggccctgagcacctgcagcagccacctgatcctgatcctcttccacacaggcatcatcgtgctgtctgtgacccacctggccgagaagaagatccccctcatccctgtgttcctgaatgtgctgcacaacgtcatccccccagccctgaaccccctggcctgtgccctgaggatgcacaagctgcggctgggcttccagaggctgctgggcctgggccaggatgtgtccaagtag

SEQ ID NO: 36584 - DNA, 984 bp, Artificial Sequence
  Description of Artificial Sequence: Synthetic coding sequence
atggagtggaggaaccacagcggccgggtgtctgaatttgtgctgctgggcttccctgccccagcccccctgcaggtgctgctgtttgccctgctgctgctggcctacgtgctggtgctgacagagaacaccctcatcatcatggccatccggaaccacagcaccctgcacaagcccatgtacttcttcctggccaacatgtccttcctggagatctggtacgtgacagtgaccatccccaagatgctggccggctttgtgggcagcaagcaggaccacggccagctgatcagctttgagggctgcatgacccagctgtacttcttcctgggcctgggctgcacagaatgtgtgctgctggccgtgatggcctatgaccgctacatggccatctgctaccccctgcactaccctgtgattgtgtctggccgcctgtgtgtgcagatggctgctggctcctgggccggcggcttcggcatctccatggtgaaggtgttcctgatcagcggcctgagctactgcggccccaacatcatcaaccacttcttctgtgatgtgagccccctgctgaacctgagctgcacagacatgagcacagctgagctgacagacttcatcctggccatcttcatcctgctgggccccctgtctgtgactggagccagctatgtggccatcactggagctgtgatgcacatccccagcgctgctggccgctacaaggccttcagcacctgtgccagccacctgactgtggtgatcatcttctacgccgccagcatcttcatctatgcccggcccaaggccctgagcgcctttgacaccaacaagctggtgtctgtgctgtatgctgtgattgtgcccctgctgaaccccatcatctactgcctgaggaaccaggaggtgaagagggccctgtgctgcaccctgcacctgtaccagcaccaggaccctgaccccaagaaggccagcagaaatgtgtag

SEQ ID NO: 36585 - DNA, 936 bp, Artificial Sequence
  Description of Artificial Sequence: Synthetic coding sequence
atggagctggagaaccagaccagggtgaccaagttcatcctggtgggcttccctggcagcctgtccatgagagctgccatgttcctgatcttcctggtggcctacatcctgactgtggctgaaaatgtcatcatcatcctgctggtgctgcagaaccggcccctgcacaagcccatgtacttcttcctggccaacctgtccttcctggagacctggtacatctctgtgacagtgcccaagctgctcttctccttctggagcgtgaacaacagcatctccttcaccctgtgcatgatccagctgtacttcttcatcgccctgatgtgcacagaatgtgtgctgctggccgccatggcctatgacagatatgtggccatctgccggcccctgcactaccccaccatcatgagccacggcctgtgcttccggctggccctgggctcctgggccatcggcttcggcatcagcctggccaagatctacttcatcagctgcctgtccttctgtggccccaacgtcatcaaccacttcttctgtgacatcagccctgtgctgaacctgagctgcacagacatgagcatcacagagctggtggacttcatcctggccctggtgatcttcctgttccccctcttcatcaccgtgctgtcctatggctgcatcctggccaccatcctgtgcatgcccaccgggaagcagaaggccttcagcacctgtgccagccacctggtggtggtgaccatcttctacagcgccatcatcttcatgtatgcccggcccagggtcatccacgccttcaacatgaacaagatcatcagcatcttctacgccatcgtgacccccagcctgaaccccttcatctactgcctgaggaaccgggaggtgaaggaggccctgaagaagctggcctactgccaggccagcagaagtgactag

SEQ ID NO: 36586 - DNA, 939 bp, Artificial Sequence
  Description of Artificial Sequence: Synthetic coding sequence
atgtctggagaaaatgtgaccaaggtgtccaccttcatcctggtgggcctgcccacagcccctggcctgcagtacctgctcttcctgctcttcctgctgacctacctgtttgtgctggtggagaacctggccatcatcctgattgtgtggagcagcaccagcctgcaccggcccatgtactacttcctgagctccatgtccttcctggagatctggtacgtgtctgacatcacccccaagatgctggagggcttcctgctgcagcagaagaggatcagctttgtgggctgcatgacccagctgtacttcttcagcagcctggtgtgcacagaatgtgtgctgctggcctccatggcctatgacagatatgtggccatctgccaccccctgcgctaccacgtgctggtgaccccaggcctgtgcctgcagctggtgggcttctcctttgtgtctggcttcaccatctccatgatcaaggtgtgcttcatcagctctgtgaccttctgtggcagcaatgtgctgaaccacttcttctgtgacatcagccccatcctgaagctggcctgcacagacttcagcacagctgagctggtggacttcatcctggccttcatcatcctggtgttccccctgctggccaccatcctgagctactggcacatcaccctggccgtgctgcgcatccccagcgccaccggctgctggagggccttcagcacctgtgccagccacctgactgtggtgacagtgttctacacagccctgctcttcatgtatgtgcggccccaggccatcgacagccagagcagcaacaagctgatctctgctgtgtacacagtggtgacccccatcatcaaccccctcatctactgcctgaggaacaaggagttcaaggatgccctgaagaaggccctgggcctgggccagaccagccactag

SEQ ID NO: 36587 - DNA, 996 bp, Artificial Sequence
  Description of Artificial Sequence: Synthetic coding sequence
atgtctggagaaaatgtgaccagggtgggcaccttcatcctggtgggcttccccacagcccctggcctgcagtacctgctcttcctgctcttcctgctgacctacctgtttgtgctggtggagaacctggccatcatcctgactgtgtggagcagcaccagcctgcaccggcccatgtactacttcctgagctccatgtccttcctggagatctggtacgtgtctgacatcacccccaagatgctggagggcttcctgctgcagcagaagaggatcagctttgtgggctgcatgacccagctgtacttcttcagcagcctggtgtgcacagaatgtgtgctgctggcctccatggcctatgacagatatgtggccatctgccaccccctgcgctaccacgtgctggtgaccccaggcctgtgcctgcagctggtgggcttctcctttgtgtctggcttcaccatctccatgatcaaggtgtgcttcatcagctctgtgaccttctgtggcagcaatgtgctgaaccacttcttctgtgacatcagccccatcctgaagctggcctgcacagacttcagcacagctgagctggtggacttcatcctggccttcatcatcctggtgttccccctgctggccaccatgctgtcctatgcccacatcaccctggccgtgctgcgcatccccagcgccaccggctgctggagggccttcttcacctgtgccagccacctgactgtggtgacagtgttctacacagccctgctcttcatgtatgtgcggccccaggccatcgacagccgcagcagcaacaagctgatctctgtgctgtacaccgtcatcacccccatcctgaaccccctcatctactgcctgaggaacaaggagttcaagaatgccctgaagaaggccttcggcctgaccagctgtgctgtggagggccgcctgagcagcctgctggagctgcacctgcagatccacagccagcccctgtag

SEQ ID NO: 36588 - DNA, 939 bp, Artificial Sequence
  Description of Artificial Sequence: Synthetic coding sequence
atgaggaaccacacagagatcacagagttcatcctgctgggcctgacagatgaccccaacttccaggtggtgatctttgtgttcctgctgatcacctacatgctgagcatcaccggcaacctgaccctcatcaccatcaccctgctggacagccacctgcagacccccatgtacttcttcctgaggaacttcagcatcctggagatctccttcaccaccgtgtccatccccaagttcctgggcaacatcatcagcggggacaagaccatctccttcaacaactgcatcgtgcagctgttcttcttcatcctgctgggcgtgacagagttctacctgctggccgccatgtcctatgacagatatgtggccatctgcaagcccctgcactgcctgagcatcatgaacagaagagtgtgcaccctgctggtgttcacctcctggctggtgtccttcctgatcatcttccctgccctgatgctgctgctgaagctgcactactgccgcagcaacatcatcgaccacttcacctgtgactacttccccctgctgcagctggcctgcagcgacaccaagttcctggaggtgatgggcttcagctgtgccgccttcaccctgatgttcaccctggccctgatcttcctgagctacatctacatcatccgcaccatcctgcgcatccccagcaccagccagaggaccaaggccttcagcacctgcagcagccacatggtggtggtgtccatctcctatggcagctgcatcttcatgtacatcaagcccagcgccaaggacagagtgtccctgagcaagggcgtggccatcctgaacacctctgtggcccccatgatgaaccccttcatctacagcctgaggaaccagcaggtgaagcaggccttcatcaacatggccaggaagacagtgttcttcaccagcacctag

SEQ ID NO: 36589 - DNA, 939 bp, Artificial Sequence
  Description of Artificial Sequence: Synthetic coding sequence
atgaagaaccacacagtcatccgcaccttcatcctgctgggcctgaccggggacccccacctgcaggtgctgctcttcatcttcctgttcctgacctacatgctgtctgtgacaggcaacctgaccatcatcaccctgaccctggtggaccaccacctgaagacccccatgtacttcttcctgaggaacttctccttcctggaggtgtccttcaccaccgtgtgcatcccccgcttcctgtacaacatctccatgggagacaacaccatcacctacaatgcctgtgccagccagatcttctttgtgatcctgtttggagccacagagttcttcctgctggccgccatgtcctatgacagatatgtggccatctgcaagcccctgcactacgtggtgatcatgaacaacagagtgtgcaccctgctggtgctgtgctgctgggtggccggcctgatgatcatcgtgccccccctgagcctgggcctgcagctggagttctgtgacagcaatgccatcgaccacttcagctgtgatgctggccccctgctgaagatcagctgcagcgacacctgggtgattgagcagatggtgatcctgatggctgtgtttgccctgatcatcaccctggtgtgtgtgatcctgagctacctgtacatcgtgaggaccatcctgaagttccccagcgtgcagcagaggaagaaggccttcagcacctgcagcagccacatgattgtggtgtccatcgcctacggcagctgcatcttcatctacatcaagcccagcgccaaggatgaggtggccatcaacaagggcgtgtctgtgctgaccacctctgtggcccccctgctgaaccccttcatctacaccctgaggaacaagcaggtgaagcaggccttcagtgacagcatcaagagaattgccttcctgagcaagaagtag

SEQ ID NO: 36590 - DNA, 936 bp, Artificial Sequence
  Description of Artificial Sequence: Synthetic coding sequence
atgaaccacaccatggtgacagaatttgtgctgctgggcctgagtgatgatcctgacctgcagatcgtcatcttcctgttcctgttcatcacctacatcctgtctgtgactggaaacctgaccatcatcaccctgacctttgtggacagccacctgcagacccccatgtacttcttcctgaggaacttctccttcctggagatctccttcaccaccgtgtgcatcccccgcttcctgggcgccatcatcaccaggaacaagaccatctcctacaacaactgtgccgcccagctgttcttcttcatcttcatgggcgtgacagagttctacatcctgacagccatgtcctatgaccgctacgtggccatctgcaagcccctgcactacaccagcatcatgaacaggaagctgtgcaccctgctggtgctgtgtgcctggctgagcggcttcctgaccatcttcccccccctgatgctgctgctgcagctggactactgtgccagcaatgtgattgaccactttgcctgtgactacttccccctgctgcagctgagctgcagcgacacctggctgctggaggtgattggcttctactttgccctggtgaccctgctcttcaccctggccctggtgatcctgagctacatgtacatcatccgcaccatcctgcgcatccccagcgccagccagaggaagaaggccttcagcacctgcagcagccacatgatcgtcatcagcatctcctatggcagctgcatcttcatgtatgccaaccccagcgccaaggagaaggccagcctgaccaagggcatcgccatcctgaacacctctgtggcccccatgctgaaccccttcatctacaccctgaggaaccagcaggtgaagcaggccttcaagaatgtggtgcacaaggtggtgttctacgccaaccagtag

SEQ ID NO: 36591 - DNA, 930 bp, Artificial Sequence
  Description of Artificial Sequence: Synthetic coding sequence
atgaagaacagaaccatgtttggagagttcatcctgctgggcctgaccaaccagcctgagctgcaggtgatgatcttcatcttcctgttcctgacctacatgctgagcatcctgggcaacctgaccatcatcaccctgaccctgctggacccccacctgcagacccccatgtacttcttcctgaggaacttctccttcctggagatctccttcaccagcatcttcatcccccgcttcctgacctccatgaccactggaaacaaggtgatcagctttgctggctgcctgacccagtacttctttgccatcttcctgggcgccacagagttctacctgctggcctccatgtcctatgacagatatgtggccatctgcaagcccctgcactacctgaccatcatgagcagccgggtgtgcatccagctggtgttctgctcctggctgggcggcttcctggccatcctgccccccatcatcctgatgacccaggtggacttctgtgtgagcaacatcctgaaccactactactgtgactatggccccctggtggagctggcctgcagcgacaccagcctgctggagctgatggtgatcctgctggccgtggtgaccctgatggtgaccctggtgctggtgaccctgagctacacctacatcatccgcaccatcctgcgcatccccagcgcccagcagaggaccaaggccttcagcacctgcagcagccacatgatcgtcatcagcctgtcctatggcagctgcatgttcatgtacatcaaccccagcgccaaggagggcggggccttcaacaagggcattgctgtgctgatcacctctgtgacccccctgctgaaccccttcatctacaccctgaggaaccagcaggtgaagcaggccttcaaggacagcgtgaagaagatcgtgaagctgtag

SEQ ID NO: 36592 - DNA, 939 bp, Artificial Sequence
  Description of Artificial Sequence: Synthetic coding sequence
atgcccaacatgaccagcatccgggagttcatcctgctgggcttcacagacaaccctgagctgcaggtggtgatcttcttcttcatgctgatcacctacctgctgtctgtgtctggcaacatgatcatcatcatgctgaccctgagcaacatccacctgaagacccccatgtacttcttcctgaggaacttctccttcctggagatctccttcaccaccgtcttcatcccccgcttcctgatcaacatcgccactggagacaccaccatctcctacaatgcctccatggcccaggtgttcttcctgatcctgctgggcagcacagagttcttcctgctggccgtgatgtcctatgacagatatgtggccatctgcaagcccctgcactacaccaccatcatgagcaacaaggtgtgcaactggctggtgatcagctcctggctggccggcttcctgatcatcttcccccctgtgatcatgggcctgcagctggacttctgtgacagcagcaccatcgaccacttcatctgtgacagcagccccatgctgctgattgcctgcacagacacccagttcctggagctgatggccttcctgctggccgtgttcaccctgatggtgaccctggccctggtggtgctgagctacaccctcatcctgaagaccatcctgaagatccccagcgcccagcagaggaagaaggccttcagcacctgcagcagccacatgattgtggtgtctgtgtcctatggcagctgcatcttcatgtgtgtgaagaccagcgccaaggagggcatggccctgagcaagggcgtggccgtgctgaacacctctgtggcccccatgctgaaccccttcatctacaccctgaggaaccagcaggtgaagcaggccctgcgggagttcaccaagaagatcctgagcctgaacaagcagtag

SEQ ID NO: 36593 - DNA, 954 bp, Artificial Sequence
  Description of Artificial Sequence: Synthetic coding sequence
atgcagaagtctgtgatgaggaagcacacagccatcaccaccttcatcctgctgggcctgacagaggacccccagctgcaggtgctgctcttcatgttcctgttcatcacctacatgctgtctgtgacaggcaagctgaccatcatcgccctgaccatgctggacccccacctgaagacccccatgtacttcttcctgcagaacctgtccttcctggagatctccttcaccgccacctgtgtgccccgcttcctgtacagcatcagcacaggcaacaagatcatcacctacaatgcctgcgtcatccagctgttctttgctgacctgtttggagtgacagagttcttcctgctggccaccatgtcctatgaccgctacgtggccatctgcaagcccctgcactacatggccatcatgagcaacaaggtgtgcaagaccatggtgatctgctgctggatggccgccctgatgatcatcctgccccccctgagcctgggcttccacctggagttctgtgacagcaatgtcatcaaccacttcggctgtgatgccctgcccatcctgaagatcccctgcagcgacaccagcctcatcgagcagatggtggtggccagcgctgtgctgaccttcatcatcaccctggtgtgtgtggtgctgagctacacctacatcatccgcaccatcctgaagttccccagcgtgcagcagaagaagaaggccttcagcacctgcagcagccacatcaccgtggtgtccatcacctacggcagctgcatcttcatctacatcaagcccagcgccaaggaggaggtgaacatcaacaagggcgtgtctgtgctgatcagcagcatcagccccatgctgaacagcttcatctacaccctgagaaatgagcaggtgaagcaggccttccatgacagcctgaagaagatcgccttccggctgaagaagtag

SEQ ID NO: 36594 - DNA, 939 bp, Artificial Sequence
  Description of Artificial Sequence: Synthetic coding sequence
atgaggaagcacacagccatcaccaccttcatcctgctgggcctgacagaggacccccagctgcaggtgctgctcttcatgttcctgttcatcacctacatgctgtctgtgacaggcaagctgaccatcatcgccctgaccatgctggacccccacctgaagacccccatgtacttcttcctgcagaacctgtccttcctggagatctccttcaccgccacctgtgtgccccgcttcctgtacagcatcagcactggaaacaagatcatcacctacaatgcctgtgtgatccagctgttctttgctgacctgtttggagtgacagagttcttcctgctggccaccatgtcctatgacagatatgtggccatctgcaagcccctgcactacatggccatcatgagcaacaaggtgtgcaagaccatggtgatctgctgctggatggccgccctgatgatcatcctgccccccctgagcctgggcttccacctggagttctgtgacagcaatgtcatcaaccacttcggctgtgatgccctgcccatcctgaagatcccctgcagcgacaccagcctgattgagcagatggtggtggccagcgctgtgctgaccttcatcatcaccctggtgtgtgtggtgctgagctacacctacatcatccgcaccatcctgaagttccccagcgtgcagcagaagaagaaggccttcagcacctgcagcagccacatcaccgtggtgtccatcacctacggcagctgcatcttcatctacatcaagcccagcgccaaggaggaggtgaacatcaacaagggcgtgtctgtgctgatcagcagcatcagccccatgctgaacagcttcatctacaccctgagaaatgagcaggtgaagcaggccttccatgacagcctgaagaagatcgccttccggctgaagaagtag

SEQ ID NO: 36595 - DNA, 939 bp, Artificial Sequence
  Description of Artificial Sequence: Synthetic coding sequence
atgaagaaccacacccggcagatcgagttcatcctgctgggcctgacagacaacagccagctgcagatcgtcatcttcctgttcctgctgctgaactgtgtgctgtccatgattggcaacttcaccatcatcgccctgatcctgctggacagccagctgaagacccccatgtacttcttcctgaggaacttctccttcctggagatctccttcaccacagcctgcatcccccgcttcctgatcaccatcgtgacccgggagaagaccatcagctgcaatggctgcatcagccagctgttcttctacatcttcctgggcgtgacagagttcttcctgctggccgccctgtcctatgacagatatgtggccatctgcaagcccctgcgctacatgagcatcatgagcaacaaggtgtgctaccagctggtgttcagctcctgggtgacaggcttcctgatcatcttcacccccctcatcctgggcctgaacctggacttctgtgccagcaacatcatcgaccacttcatctgtgacatcagcctcatcctgcagctgagctgcagcgacacccacctgctggagctgattgccttcctgctggccgtgatgaccctcatcgtgaccctcttcctggtgatcctgagctacagctacatcatcaagaccatcctgaagttccccagcgcccagcagaagaagaaggccttcagcacctgcagcagccacatgattgtggtgtccatcacctacggcagctgcatgttcatctacatcaagcccagcgccaatgaaagagtggccctgagcaagggcgtgacagtgctgaacacctctgtggcccccctgctgaaccccttcatctacaccctgaggaaccagcaggtgaagcaggccttcaaggctgtgttcaggaagatcttcagcgccagtgacaagtag

SEQ ID NO: 36596 - DNA, 939 bp, Artificial Sequence
  Description of Artificial Sequence: Synthetic coding sequence
atgaggaaccacaccaccgtggccaacttcatcctgctgggcctgacagatgacccccagctgcaggtgatcatcttcctgctgctcttcttcacctacatgctgagcatcaccggcaacctgaccatcatcaccctgaccctgctggacctgcacctgaagacccccatgtacttcttcctgaggaacttctccttcctggaggtgtccttcaccaccgtgtacatccccaagttcctggtgtccatggccactggagacaagaccatctcctacaatgactgtgccgcccagctgttcttcaccatcctgctgggcgccacagagttcttcctgctggccgccatgtcctatgaaagatatgtggccatctgcaagcccctgcactacaccaccatcatgagcagccgggtgtgcagcctgctggtgtttgcctcctggatggccggcttcctgatcatcttcccccccctgctgatgggcctgcagctggacttctgtgccgccaacacagtggaccacttcttctgtgatgtgagccccatcctgcagctgagctgcacagacacagacatcatcgagctgatgatgctgctgagcgccatcctgaccctgctggtgaccctggtgctggtgatcctgagctacaccaacatcatccgcaccatcctgaagatccccagcagccagcagaggaagaaggccttcagcacctgcagcagccacatggtggtggtgtccatctcctatggcagctgcatcttcatgtatgtgaagcccagcgccaaggagcgggtgtccctgaacaagggcatcgccctgctgagcacctctgtggcccccatgctgaaccccttcatctacaccctgaggaacaagcaggtgaaggatgtgttcaagcacacagtgaagaagattgagctgttctccatgaagtag

SEQ ID NO: 36597 - DNA, 939 bp, Artificial Sequence
  Description of Artificial Sequence: Synthetic coding sequence
atgaggaacagcacagctgtgacagacttcatcctgctgggcctgaccagtgacccccagtggcaggtggtgctcttcatcttcctgctggtgacctacatgctgtctgtgacaggcaacctgatcatcatcaccctgaccctgagtgacccccacctgcagacccccatgtacttcttcctgaggaacttctccttcctggagatctccttcacctctgtgtgcatcccccgcttcctggtgacagtggtgactggaaacagaaccatctcctacaacggctgtgtggcccagctgttcttcttcatcttcctgggcgtgacagagttctacctgctggccgccatgtcctatgaccgctgcatggccatctgcaagcccctgcactacaccatcatcatgagcaccagggtgtgcaccctgctggtgttcagctcctggctggccggcttcctgatcatcttcccccctgtgatgctgctgctgcagctggacttctgtgccagcaatgtcatcgaccacttcatctgtgacagcagccccatgctgcagctgagctgcaccaacacccacttcctggagctgatggccttcttcctggccgtggtgaccctgatggtgaccctgaccctggtgatcctgagctacaccaacatcatccgcaccatcctgaagatccccagcatgagccagaggaagaaggccttcagcacctgcagcagccacatgattgtggtgtccatctcctacagcagctgcatcttcatgtacatcaagaccagcgcccgggagcgggtgaccctgagcaagggcgtggccgtgctgaacacctctgtggcccccctgctgaaccccttcatctacaccctgaggaacaagcaggtgaagcaggccttcaagtccatggtgcagaagatgatcttcagcctgaacaagtag

SEQ ID NO: 36598 - DNA, 927 bp, Artificial Sequence
  Description of Artificial Sequence: Synthetic coding sequence
atggacaccggcaacaagaccctgccccaggacttcctgctgctgggcttccctggcagccagaccctgcagctgagcctcttcatgctgttcctggtgatgtacatcctgactgtgtctggaaatgtggccatcctgatgctggtgtccaccagccaccagctgcacacccccatgtacttcttcctgagcaacctgtccttcctggagatctggtacaccacagctgctgtgcccaaggccctggccatcctgctgggccgcagccagaccatctccttcaccagctgcctgctgcagatgtactttgtgttcagcctgggctgcacagagtacttcctgctggccgccatggcctatgaccgctgcctggccatctgctaccccctgcactacggggccatcatgagcagcctgctgagcgcccagctggccctgggctcctgggtgtgtggctttgtggccatcgctgtgcccacagccctgatcagcggcctgtccttctgtggcccccgggccatcaaccacttcttctgtgacatcgccccctggatcgccctggcctgcaccaacacccaggccgtggagctggtggcctttgtgattgctgtggtggtgatcctgagcagctgcctgatcacctttgtgtcctatgtgtacatcatcagcaccatcctgcgcatccccagcgccagcggccgcagcaaggccttcagcacctgcagcagccacctgactgtggtgctgatctggtacggcagcacagtgttcctgcacgtgaggaccagcatcaaggatgccctggacctgatcaaggctgtgcacgtgctgaacacagtggtgacccctgtgctgaaccccttcatctacaccctgaggaacaaggaggtgcgggagaccctgctgaagaagtggaagggcaagtag

SEQ ID NO: 36599 - DNA, 1044 bp, Artificial Sequence
  Description of Artificial Sequence: Synthetic coding sequence
atgggcaactggacagctgctgtgacagaatttgtgctgctgggcttcagcctgagccgggaggtggagctgctgctgctggtgctgctgctgcccaccttcctgctgaccctgctgggcaacctgctgatcatcagcacagtgctgagctgcagccggctgcacacccccatgtacttcttcctgtgcaacctgagcatcctggacatcctcttcaccagcgtcatcagccccaaggtgctggccaacctgggcagccgggacaagaccatcagctttgctggctgcatcacccagtgctacttctacttcttcctgggcaccgtggagttcctgctgctgactgtgatgtcctatgacagatatgccaccatctgctgccccctgcgctacaccaccatcatgaggcccagcgtgtgcattggaacagtggtgttctcctgggtgggcggcttcctgtctgtgctcttccccaccatcctgatcagccagctgcccttctgtggcagcaacatcatcaaccacttcttctgtgacagcggccccctgctggccctggcctgtgccgacaccacagccatcgagctgatggacttcatgctgagctccatggtgatcctgtgctgcatcgtgctggtggcctacagctacacctacatcatcctgaccatcgtgcgcatccccagcgccagcggcaggaagaaggccttcaacacctgtgccagccacctgaccatcgtcatcatccccagcggcatcaccgtcttcatctacgtgacccccagccagaaggagtacctggagatcaacaagatccccctggtgctgagctctgtggtgacccccttcctgaaccccttcatctacaccctgagaaatgacacagtgcagggcgtgctgagagatgtgtgggtgcgggtgcggggcgtgtttgagaagaggatgagagctgtgctgcggagccggctgagcagcaacaaggaccaccagggccgggcctgcagcagccccccctgtgtgtacagcgtgaagctgcagtgctag

SEQ ID NO: 36600 - DNA, 975 bp, Artificial Sequence
  Description of Artificial Sequence: Synthetic coding sequence
atggagagccccaacagaaccaccatccaggagttcatcttcagcgccttcccctacagctgggtgaagtctgtggtgtgctttgtgcccctgctcttcatctatgccttcatcgtggtgggcaacctggtgatcatcaccgtggtgcagctgaacacccacctgcacacccccatgtacaccttcatcagcgccctgtccttcctggagatctggtacaccacagccaccatccccaagatgctgagcagcctgctgtctgagaggagcatctccttcaacggctgcctgctgcagatgtacttcttccacagcacaggcatctgtgaggtgtgcctgctgactgtgatggcctttgaccactacctggccatctgcagccccctgcactaccccagcatcatgacccccaagctgtgcacccagctgaccctgagctgctgcgtgtgtggcttcatcacccccctgcctgagatcgcctggatcagcaccctgcccttctgtggcagcaaccacctggagcacatcttctgtgacttcctgcctgtgctgcggctggcctgcacagacacccgggccatcgtgatgatccaggtggtggatgtgattcatgctgtggagatcatcacagctgtgatgctgatcttcatgtcctatgatggcatcgtggccgtcatcctgcgcatccacagcgctgggggcagaagaacagccttcagcacctgtgtgagccacttcatcgtgttcagcctcttctttggatctgtgaccctgatgtacctgcgcttcagcgccacctacagcctcttctgggacatcgccatcgccctggcctttgctgtgctgagccccttcttcaaccccatcatctacagcctgaggaacaaggagatcaaggaggccatcaagaagcacatcggccaggccaagatcttcttctctgtgcggcccggcaccagcagcaagatcttctag

SEQ ID NO: 36601 - DNA, 948 bp, Artificial Sequence
  Description of Artificial Sequence: Synthetic coding sequence
atggagagcggcaaccagagcacagtgacagagttcatcttcaccggcttcccccagctgcaggacggcagcctgctgtacttcttccccctgctcttcatctacaccttcatcatcatcgacaacctgctgatcttctctgctgtgcggctggacacccacctgcacaaccccatgtacaacttcatcagcatcttctccttcctggagatctggtacaccacagccaccatccccaagatgctgagcaacctgatcagcgagaagaaggccatctccatgacaggctgcatcctgcagatgtacttcttccacagcctggagaacagcgagggcatcctgctgaccaccatggccatcgacagatatgtggccatctgcaaccccctgcgctaccagatgatcatgaccccccggctgtgtgcccagctgtctgctggcagctgcctgtttggcttcctgatcctgctgcctgagatcgtgatgatcagcaccctgcccttctgtggccccaaccagatccaccagatcttctgtgacctggtgcctgtgctgagcctggcctgcacagacacctccatgatcctgattgaagatgtgattcatgctgtgaccatcatcatcaccttcctgatcatcgccctgtcctatgtgcgcatcgtgaccgtcatcctgcgcatccccagcagcgagggccggcagaaggccttcagcacctgtgccggccacctgatggtgttccccatcttctttggatctgtgtccctgatgtacctgcgcttcagtgacacctacccacctgtgctggacacagccatcgccctgatgttcaccgtgctggcccccttcttcaaccccatcatctacagcctgaggaacaaggacatgaacaatgccatcaagaagctgttctgcctgcagaaggtgctgaacaagccaggcggctag

SEQ ID NO: 36602 - DNA, 996 bp, Artificial Sequence
  Description of Artificial Sequence: Synthetic coding sequence
atgtgctggaccatgcccagccccttcaccggcagcagcaccaggaacatggagagcggcaaccagagcacagtgacagagttcatcttcaccggcttcccccagctgcaggacggcagcctgctgtacttcttccccctgctcttcatctacaccttcatcatcatcgacaacctgctgatcttctctgctgtgcggctggacacccacctgcacaaccccatgtacaacttcatcagcatcttctccttcctggagatctggtacaccacagccaccatccccaagatgctgagcaacctgatcagcgagaagaaggccatctccatgacaggctgcatcctgcagatgtacttcttccacagcctggagaacagcgagggcatcctgctgaccaccatggccatcgacagatatgtggccatctgcaaccccctgcgctaccagatgatcatgaccccccggctgtgtgcccagctgtctgctggcagctgcctgtttggcttcctgatcctgctgcctgagatcgtgatgatcagcaccctgcccttctgtggccccaaccagatccaccagatcttctgtgacctggtgcctgtgctgagcctggcctgcacagacacctccatgatcctgattgaagatgtgattcatgctgtgaccatcatcatcaccttcctgatcatcgccctgtcctatgtgcgcatcgtgaccgtcatcctgcgcatccccagcagcgagggccggcagaaggccttcagcacctgtgccggccacctgatggtgttccccatcttctttggatctgtgtccctgatgtacctgcgcttcagtgacacctacccacctgtgctggacacagccatcgccctgatgttcaccgtgctggcccccttcttcaaccccatcatctacagcctgaggaacaaggacatgaacaatgccatcaagaagctgttctgcctgcagaaggtgctgaacaagccaggcggctag

SEQ ID NO: 36603 - DNA, 1032 bp, Artificial Sequence
  Description of Artificial Sequence: Synthetic coding sequence
atgaagcagtacagcgtgggcaaccagcacagcaactaccgcagcctgctcttccccttcctgtgcagccagatgacccagctgacagccagcggcaaccagaccatggtgacagagttcctgttctccatgttcccccacgcccacagaggaggcctgctcttcttcatccccctgctgctgatctacggcttcatcctgaccggcaacctgatcatgtttattgtcatccaggtgggcatggccctgcacacccccctgtacttcttcatctctgtgctgtccttcctggagatctgctacaccaccaccaccatccccaagatgctgagctgcctgatcagcgagcagaagagcatctctgtggccggctgcctgctgcagatgtacttcttccacagcctgggcatcacagagagctgtgtgctgacagccatggccatcgaccgctacatcgccatctgcaaccccctgcgctaccccaccatcatgatccccaagctgtgcatccagctgactgtgggcagctgcttctgtggcttcctgctggtgctgcctgagatcgcctggatcagcaccctgcccttctgtggcagcaaccagatccaccagatcttctgtgacttcacccctgtgctgagcctggcctgcacagacaccttcctggtggtgattgtggatgccatccatgctgctgagatcgtggccagcttcctggtgattgccctgagctacatccgcatcatcatcgtcatcctgggcatgcacagcgctgagggccaccacaaggccttcagcacctgtgccgcccacctggccgtgttcctgctcttctttggatctgtggccgtgatgtacctgcgcttcagcgccacctacagcgtcttctgggacacagccatcgctgtgacctttgtgatcctggcccccttcttcaaccccatcatctacagcctgaagaacaaggacatgaaggaggccatcggccgcctcttccactaccagaagagagctggctgggccggcaagtag

SEQ ID NO: 36604 - DNA, 942 bp, Artificial Sequence
  Description of Artificial Sequence: Synthetic coding sequence
atgggcaactggagcacagtgacagagatcaccctgattgccttccctgccctgctggagatccgcatcagcctgtttgtggtgctggtggtgacctacaccctgacagccaccggcaacatcaccatcatcagcctcatctggattgaccaccggctgcagacccccatgtacttcttcctgagcaacctgtccttcctggacatcctgtacaccaccgtcatcacccccaagctgctggcctgcctgctgggggaggagaagaccatcagctttgctggctgcatgatccagacctacttctacttcttcctgggcaccgtggagttcatcctgctggccgtgatgagctttgaccgctacatggccatctgtgaccccctgcactacaccgtcatcatgaacagccgggcctgcctgctgctggtgctgggctgctgggtgggcgccttcctgtctgtgctcttccccaccatcgtggtgacccggctgccctactgcaggaaggagatcaaccacttcttctgtgacatcgcccccctgctgcaggtggcctgcatcaacacccacctgattgagaagatcaacttcctgctgagcgccctggtgatcctgagcagcctggccttcaccaccggcagctatgtgtacatcatcagcaccatcctgcgcatccccagcacccagggccggcagaaggccttcagcacctgtgccagccacatcaccgtggtgtccatcgcccacggcagcaacatctttgtgtatgtgcggcccaaccagaacagcagcctggactatgacaaggtggccgctgtgctgatcaccgtggtgacccccctgctgaaccccttcatctacagcctgagaaatgagaaggtgcaggaggtgctgcgggagaccgtgaaccgcatcatgaccctcatccagaggaagacctag

SEQ ID NO: 36605 - DNA, 939 bp, Artificial Sequence
  Description of Artificial Sequence: Synthetic coding sequence
atggacaccggcaactggagccaggtggccgagttcatcatcctgggcttcccccacctgcagggcgtgcagatctacctgttcctgctgctgctgctgatctacctgatgacagtgctgggcaacctgctgatcttcctggtggtgtgcctggacagccggctgcacacccccatgtaccactttgtgtccatcctgtccttcagcgagctgggctacacagctgccaccatccccaagatgctggccaacctgctgtctgagaagaagaccatctccttcagcggctgcctgctgcagatctacttcttccacagcctgggcgccacagagtgctacctgctgacagccatggcctatgaccgctacctggccatctgccggcccctgcactaccccaccctgatgacccccaccctgtgtgccgagatcgccatcggctgctggctgggcggcctggccggccctgtggtggagatcagcctcatcagccggctgcccttctgtggccccaaccgcatccagcacgtgttctgtgacttcccccctgtgctgagcctggcctgcacagacaccagcatcaacgtgctggtggactttgtgatcaacagctgcaagatcctggccaccttcctgctgatcctgtgcagctatgtgcagatcatctgcaccgtgctgcgcatccccagcgctgctgggaagaggaaggccatcagcacctgtgccagccacttcaccgtggtgctgatcttctacggcagcatcctgtccatgtatgtgcagctgaagaagagctacagcctggactatgaccaggccctggccgtggtgtacagcgtgctgacccccttcctgaaccccttcatctacagcctgaggaacaaggagatcaaggaggccgtgcggcggcagctgaagagaattggcatcctggcctag

SEQ ID NO: 36606 - DNA, 954 bp, Artificial Sequence
  Description of Artificial Sequence: Synthetic coding sequence
atggaccagtacaaccacagcagcctggccgagtttgtgttcctgggctttgcctctgtgggctacgtgcggggctggctgtttgtgctgctgctgctggcctacctgttcaccatctgtggcaacatgctgatcttcagcgtcatccggctggatgctgccctgcacacccccatgtaccactttgtgtctgtgctgtccttcctggagctgtggtacacagccaccaccatccccaagatgctgagcaacatcctgtctgagaagaagaccatcagctttgctggctgcctgctgcagacctacttcttccacagcctgggcgccagcgagtgctacctgctgacagccatggcctatgaccgctacctggccatctgccggcccctgcactaccccatcatcatgaccaccaccctgtgtgccaagatggccgccgcctgctggacctgtggcttcctgtgccccatcagcgaggtgatcctggccagccagctgcccttctgtgcctacaatgagatccagcacatcttctgtgacttcccccccctgctgagcctggcctgcaaggacaccagcgccaacatcctggtggactttgccatcaatgccttcatcatcctgatcaccttcttcttcatcatgatctcctatgcccgcatcatcggggctgtgctgaagatcaagacagccagcggcaggaagaaggccttcagcacctgtgccagccacctggccgtggtgctgatcttcttcggcagcatcatcttcatgtatgtgcggctgaagaagagctacagcctgaccctggacaggaccctggccatcgtgtacagcgtgctgacccccatggtgaaccccatcatctacagcctgaggaacaaggagatcatcaaggccatcaagaggaccatcttccagaagggggacaaggccagcctggcccacctgtag

SEQ ID NO: 36607 - DNA, 954 bp, Artificial Sequence
  Description of Artificial Sequence: Synthetic coding sequence
atgaggaacctgagcggcggccacgtggaggagtttgtgctggtgggcttccccaccaccccacccctgcagctgctgctgtttgtgctcttctttgccatctacctgctgaccctgctggagaatgccctgattgtgttcaccatctggctggcccccagcctgcaccggcccatgtacttcttcctgggccacctgtccttcctggagctgtggtacatcaacgtgaccatcccccggctgctggccgccttcctgacccaggacggccgggtgtcctatgtgggctgcatgacccagctgtacttcttcatcgccctggcctgcacagaatgtgtgctgctggccgtgatggcctatgaccgctacctggccatctgtggccccctgctgtaccccagcctgatgcccagcagcctggccacccggctggccgccgcctcctggggcagcggcttcttcagctccatgatgaagctgctcttcatcagccagctgagctactgcggccccaacatcatcaaccacttcttctgtgacatcagccccctgctgaacctgacctgcagcgacaaggagcaggccgagctggtggacttcctgctggccctggtgatgatcctgctgcccctgctggccgtggtgtcctcctacacagccatcatcgccgccatcctgcgcatccccaccagccggggccgccacaaggccttcagcacctgtgccgcccacctggccgtggtggtgatctactacagcagcaccctcttcacctacgcccggccccgggccatgtacaccttcaaccacaacaagatcatctctgtgctgtacaccatcatcgtgcccttcttcaacccagccatctactgcctgaggaacaaggaggtgaaggaggccttcaggaagacagtgatgggccgctgccactaccccagagatgtgcaggactag

SEQ ID NO: 36608 - DNA, 954 bp, Artificial Sequence
  Description of Artificial Sequence: Synthetic coding sequence
atgcagccctacaccaagaactggacccaggtgacagaatttgtgatgatgggctttgctggcatccacgaggcccacctgctcttcttcatcctcttcctgaccatgtacctgttcaccctggtggagaacctggccatcatcctggtggtgggcctggaccaccggctgcggcggcccatgtacttcttcctgacccacctgagctgcctggagatctggtacacctctgtgacagtgcccaagatgctggccggcttcatcggcgtggatggcggcaagaacatctcctatgctgactgcctgagccagctgttcatcttcaccttcctgggcgccacagagtgcttcctgctggccgccatggcctatgacagatatgtggccatctgcatgcccctgcactacggggcctttgtgtcctggggcacctgcatccggctggccgccgcctgctggctggtgggcttcctgacccccatcctgcccatctacctgctgagccagctgaccttctacggccccaacgtcatcgaccacttcagctgtgatgccagccccctgctggccctgagctgcagtgatgtgacctggaaggagaccgtggacttcctggtgtccctggccgtgctgctggccagctccatggtgattgctgtgtcctatggcaacatcgtgtggaccctgctgcacatccgctctgctgctgagcgctggaaggccttcagcacctgtgccgcccacctgactgtggtgtccctcttctacggcaccctcttcttcatgtatgtgcagaccaaggtgaccagcagcatcaacttcaacaaggtggtgtctgtgttctacagcgtggtgacccccatgctgaaccccctcatctacagcctgaggaacaaggaggtgaagggggccctgggccgggtcttcagcctgaacttctggaagggccagtag

SEQ ID NO: 36609 - DNA, 996 bp, Artificial Sequence
  Description of Artificial Sequence: Synthetic coding sequence
atgagcccagatggcaaccacagcagtgaccccacagaatttgtgctggccggcctgcccaacctgaacagcgcccgggtggagctgttctctgtgttcctgctggtgtacctgctgaacctgactggaaatgtgctgattgtgggcgtggtgcgggctgacacccggctgcagacccccatgtacttcttcctgggcaacctgagctgcctggagatcctgctgaccagcgtcatcatccccaagatgctgagcaacttcctgagccggcagcacaccatcagctttgctgcctgcatcacccagttctacttctacttcttcctgggcgccagcgagttcctgctgctggccgtgatgtctgctgaccgctacctggccatctgccaccccctgcgctaccccctgctgatgtctggagctgtgtgcttccgggtggccctggcctgctgggtgggcggcctggtgcctgtgctgggccccaccgtggccgtggccctgctgcccttctgcaagcagggcgctgtggtgcagcacttcttctgtgacagcggccccctgctgcggctggcctgcaccaacaccaagaagctggaggagacagactttgtgctggccagcctggtgattgtgagcagcctgctgatcacagctgtgtcctatggcctcatcgtgctggccgtgctgagcatccccagcgccagcggccggcagaaggccttcagcacctgcaccagccacctgattgtggtgaccctcttctacggcagcgccatcttcctgtatgtgcggcccagccagagcggctctgtggacaccaactgggccgtgaccgtcatcaccacctttgtgacccccctgctgaaccccttcatctatgccctgagaaatgagcaggtgaaggaggccctgaaggacatgttcaggaaggtggtggccggcgtgctgggcaacctgctgctggacaagtgcctgtctgagaaggctgtgaagtag

SEQ ID NO: 36610 - DNA, 972 bp, Artificial Sequence
  Description of Artificial Sequence: Synthetic coding sequence
atgaaccctgagaactggacccaggtgaccagctttgtgctgctgggcttccccagcagccacctgatccagttcctggtgttcctgggcctgatggtgacctacatcgtgacagccaccgggaagctgctgatcatcgtgctgtcctggattgaccagaggctgcacatccagatgtacttcttcctgaggaacttctccttcctggagctgctgctggtgacagtggtggtgcccaagatgctggtggtgatcctgactggagaccacaccatcagctttgtgtcctgcatcatccagagctacctgtacttcttcctgggcaccacagacttcttcctgctggccgtgatgagcctggaccgctacctggccatctgccggcccctgcgctatgagaccctgatgaatggacatgtgtgcagccagctggtgctggcctcctggctggccggcttcctgtgggtgctgtgccccaccgtgctgatggccagcctgcccttctgtggccccaacggcatcgaccacttcttccgggacagctggcccctgctgcggctgagctgtggggacacccacctgctgaagctggtggccttcatgctgagcaccctggtgctgctgggcagcctggccctgacctctgtgtcctatgcctgcatcctggccaccgtgctgcgggcccccacagctgctgagaggaggaaggccttcagcacctgtgccagccacctgactgtggtggtgatcatctacggcagcagcatcttcctgtacatccgcatgtctgaggcccagagcaagctgctgaacaagggggcctctgtgctgagctgcatcatcacccccctgctgaaccccttcatcttcaccctgagaaatgacaaggtgcagcaggccctgcgggaggccctgggctggccccggctgacagctgtgatgaagctgcgggtgaccagccagaggaagtag

SEQ ID NO: 36611 - DNA, 942 bp, Artificial Sequence
  Description of Artificial Sequence: Synthetic coding sequence
atggccaacctgagccagcccagcgagtttgtgctgctgggcttcagcagctttggagagctgcaggccctgctgtatggccccttcctgatgctgtacctgctggccttcatgggcaacaccatcatcatcgtgatggtgattgctgacacccacctgcacacccccatgtacttcttcctgggcaacttcagcctgctggagatcctggtgaccatgacagctgtgcccaggatgctgagtgacctgctggtgccccacaaggtgatcaccttcaccggctgcatggtgcagttctacttccacttcagcctgggcagcaccagcttcctgatcctgacagacatggccctggacagatttgtggccatctgccaccccctgcgctatggcaccctgatgagccgggccatgtgtgtgcagctggccggggccgcctgggccgcccccttcctggccatggtgcccaccgtgctgagccgggcccacctggactactgccacggagatgtgatcaaccacttcttctgtgacaatgagcccctgctgcagctgagctgcagcgacacccggctgctggagttctgggacttcctgatggccctgacctttgtgctgagcagcttcctggtgaccctcatctcctatggctacatcgtgaccaccgtgctgcgcatccccagcgccagcagctgccagaaggccttcagcacctgtggcagccacctgaccctggtgttcatcggctacagcagcaccatcttcctgtatgtgcggcctgggaaggcccacagcgtgcaggtgaggaaggtggtggccctggtgacctctgtgctgacccccttcctgaaccccttcatcctgaccttctgcaaccagacagtgaagacagtgctgcagggccagatgcagaggctgaagggcctgtgcaaggcccagtag

SEQ ID NO: 36612 - DNA, 939 bp, Artificial Sequence
  Description of Artificial Sequence: Synthetic coding sequence
atgagaaatggaacagtcatcacagagttcatcctgctgggcttccctgtgatccagggcctgcagacccccctcttcatcgccatcttcctgacctacatcctgaccctggccggaaatggcctcatcatcgccaccgtgtgggccgagccccggctgcagatccccatgtacttcttcctgtgcaacctgtccttcctggagatctggtacaccaccaccgtcatccccaagctgctgggcacctttgtggtggccaggacagtcatctgcatgagctgctgcctgctgcaggccttcttccacttctttgtgggcaccacagagttcctgatcctgaccatcatgagctttgaccgctacctgaccatctgcaaccccctgcaccaccccaccatcatgaccagcaagctgtgcctgcagctggccctgagctcctgggtggtgggcttcaccatcgtgttctgccagaccatgctgctgatccagctgcccttctgtggcaacaacgtcatcagccacttctactgtgatgtgggccccagcctgaaggccgcctgcatcgacaccagcatcctggagctgctgggcgtgattgccaccatcctggtgattcctggcagcctgctcttcaacatgatctcctacatctacatcctgagcgccatcctgcgcatccccagcgccaccggccaccagaagaccttcagcacctgtgccagccacctgactgtggtgtccctgctgtatggagctgtgctcttcatgtacctgcggcccacagcccacagcagcttcaagatcaacaaggtggtgtctgtgctgaacaccatcctgacccccctgctgaaccccttcatctacaccatccggaacaaggaggtgaagggggccctgaggaaggccatgacctgccccaagacaggccacgccaagtag

SEQ ID NO: 36613 - DNA, 978 bp, Artificial Sequence
  Description of Artificial Sequence: Synthetic coding sequence
atgaccaccatcatcctggaggtggacaaccacacagtgaccacccgcttcatcctgctgggcttccccaccaggcctgccttccagctgctcttcttcagcatcttcctggccacctacctgctgaccctgctggagaacctgctgatcatcctggccatccacagtgatggccagctgcacaagcccatgtacttcttcctgagccacctgtccttcctggagatgtggtacgtgaccgtcatcagccccaagatgctggtggacttcctgagccatgacaagagcatctccttcaacggctgcatgacccagctgtacttctttgtgacctttgtgtgcacagagtacatcctgctggccatcatggcctttgaccgctacgtggccatctgcaaccccctgcgctaccctgtgatcatgaccaaccagctgtgtggcaccctggccggcggctgctggttctgtggcctgatgacagccatgatcaagatggtgttcatcgcccagctgcactactgcggcatgccccagatcaaccactacttctgtgacatcagccccctgctgaatgtgtcctgtgaagatgccagccaggccgagatggtggacttcttcctggccctgatggtgattgccatccccctgtgtgtggtggtggccagctatgctgccatcctggccaccatcctgcgcatccccagcgcccagggccggcagaaggccttcagcacctgtgccagccacctgactgtggtgatcctcttctacagcatgaccctcttcacctacgcccggcccaagctgatgtatgcctacaacagcaacaaggtggtgtctgtgctgtacaccgtcatcgtgcccctgctgaaccccatcatctactgcctgaggaaccacgaggtgaaggccgccctgaggaagaccatccactgccggggcagcggcccccagggcaatggagccttcagcagctag

SEQ ID NO: 36614 - DNA, 930 bp, Artificial Sequence
  Description of Artificial Sequence: Synthetic coding sequence
atgaagtcctggaacaacaccatcatcctggagttcctgctgctgggcatcagcgaggagcctgagctgcaggccttcctgtttggcctcttcctgtccatgtacctggtgacagtgctgggcaacctgctgatcatcctggccaccatcagtgacagccacctgcacacccccatgtacttcttcctgagcaacctgagctttgtggacatctgctttgtgtccaccaccgtgcccaagatgctggtgaacatccagacccacaacaaggtgatcacctacgccggctgcatcacccagatgtgcttcttcctgctgtttgtgggcctggacaacttcctgctgactgtgatggcctatgacagatttgtggccatctgccaccccctgcactacatggtgatcatgaacccccagctgtgtggcctgctggtgctggcctcctggatcatgtctgtgctgaacagcatgctgcagagcctgatggtgctgcccctgcccttctgcacccacatggagatcccccacttcttctgtgagatcaaccaggtggtgcacctggcctgcagcgacaccttcctgaatgacatcgtgatgtactttgctgtggccctgctgggcggcggccccctgaccggcatcctgtacagctacagcaagatcgtgagcagcatccgggccatcagcagcgcccagggcaagtacaaggccttcagcacctgtgccagccacctgtctgtggtgtccctcttctacggcacctgcctgggcgtgtacctgagcagcgctgccacccacaacagccacactggagctgctgcctctgtgatgtacacagtggtgacccccatgctgaaccccttcatctacagcctgaggaacaagcacatcaagggggccatgaagaccttcttccggggcaagcagtag

SEQ ID NO: 36615 - DNA, 930 bp, Artificial Sequence
  Description of Artificial Sequence: Synthetic coding sequence
atggagccagaaaatgacaccggcatcagcgagtttgtgctgctgggcctgtctgaggagcctgagctgcagcccttcctgtttggcctcttcctgtccatgtacctggtgacagtgctgggcaacctgctgatcatcctggccaccatcagtgacagccacctgcacacccccatgtacttcttcctgagcaacctgagctttgctgacatctgcttcatcagcaccaccatccccaagatgctgatcaacatccagacccagagcagggtcatcacctacgccggctgcatcacccagatgtgcttctttgtgctgtttggaggcctggacagcctgctgctggccgtgatggcctatgacagatttgtggccatctgccaccccctgcactacaccgtcatcatgaacccccggctgtgtggcctgctggtgctggcctcctggatgattgctgccctgaacagcctgagccagagcctgatggtgctgtggctgtccttctgcacagacctggagatcccccacttcttctgtgagctgaaccaggtgatccacctggcctgcagcgacaccttcctgaatgacatgggcatgtactttgctgctggcctgctggccggcggccccctggtgggcatcctgtgcagctacagcaagatcgtgagcagcatccgggccatcagcagcgcccagggcaagtacaaggccttcagcacctgtgccagccacctgtctgtggtgtccctcttctgctgcaccggcctgggcgtgtacctgaccagcgctgccacccacaacagccacaccagcgccacagcctctgtgatgtacacagtggccacccccatgctgaaccccttcatctacagcctgaggaacaaggacatcaagagggccctgaagatgtccttccggggcaagcagtag

SEQ ID NO: 36616 - DNA, 930 bp, Artificial Sequence
  Description of Artificial Sequence: Synthetic coding sequence
gtgaaggctggaaatgagacccagatcagcgagttcctgctgctgggcttcagcgagaagcaggagctgcagcccttcctgtttggcctcttcctgtccatgtacctggtgacagtgctgggcaacctgctgatcatcctggccgccatcagtgacagctgcctgcacacccccatgtacttcttcctgagcaacctgagctttgtggacatctgctttgccagcaccatggtgcccaagatgctggtgaacatccagacccagagcaaggtgatcacctacgccggctgcatcacccagatgtgcttctttgtgctcttcatcgtgctggacagcctgctgctgactgtgatggcctatgaccagtttgtggccatctgccaccccctgcactacaccgtcatcatgagcccccagctgtgtggcctgctggtgctggtgtcctggatcatgtctgtgctgaacagcatgctgcagagcctggtgaccctgcagctgtccttctgcacagacctggagatcccccacttcttctgtgagctgaatgagatgatccacctggcctgcagcgacacctttgtgaacaacatggtgatgcactttgctgctgtgctgctggatggcggccccctggtgggcatcctgtacagctactgcagaattgtgagcagcatccgggccatcagcagcacccagggcaagtacaaggccctgagcacctgtgccagccacctgtctgtggtgtccatcttctacggcaccggcctgggcgtgtacctgagcagcaccatgacccagaacctgcacagcacagctgtggcctctgtgatgtacacagtggtgacccccatgctgaaccccttcatctacagcctgaggaacaaggacatcaagggggccctgacccagttcttccggggcaagcagtag

SEQ ID NO: 36617 - DNA, 960 bp, Artificial Sequence; identical to SEQ ID NO: 36143
  Description of Artificial Sequence: Synthetic coding sequence

SEQ ID NO: 36618 - DNA, 939 bp, Artificial Sequence
  Description of Artificial Sequence: Synthetic coding sequence
atggaggccggcaaccagacaggcttcctggagttcatcctgctgggcctgtctgaagatcctgagctgcagcccttcatcttcggcctcttcctgtccatgtacctggtgacagtgctgggcaacctgctgatcatcctggccatcagcagtgacagccacctgcacacccccatgtacttcttcctgagcaacctgtcctgggtggacatctgcttcagcacctgcatcgtgcccaagatgctggtgaacatccagacagagaacaaggccatctcctacatggactgcctgacccaggtgtacttctccatgttcttccccatcctggacaccctgctgctgactgtgatggcctatgacagatttgtggccgtgtgccaccccctgcactacatgatcatcatgaacccccacctgtgtggcctgctggtgtttgtgacctggctgattggagtgatgaccagcctgctgcacatcagcctgatgatgcacctgatcttctgcaaggactttgagatcccccacttcttctgtgagctgacctacatcctgcagctggcctgcagcgacaccttcctgaacagcaccctcatctacttcatgactggagtgctgggcgtcttccccctgctgggcatcatcttctcctacagcagaattgccagcagcatcaggaagatgagcagcagcggcggcaagcagaaggccctgagcacctgtggcagccacctgtctgtggtgtccctcttctacggcaccggcatcggcgtgcacttcaccagcgctgtgacccacagcagccagaagatctctgtggcctctgtgatgtacacagtggtgacccccatgctgaaccccttcatctacagcctgaggaacaaggatgtgaagggggccctgggcagcctgctgagccgggccgccagctgcctgtag

SEQ ID NO: 36619 - DNA, 1020 bp, Artificial Sequence
  Description of Artificial Sequence: Synthetic coding sequence
atgagctacttccccatcctcttcttcttcttcctgaagcgctgccccagctacacagagccccagaacctgactggagtgtctgagttcctgctgctgggcctgtctgaagatcctgagctgcagcctgtgctggccggcctcttcctgtccatgtacctggtgacagtgctgggcaacctgctgatcatcctggccgtgtccagtgacagccacctgcacacccccatgtacttcttcctgagcaacctgagcctggccgacatcggcttcaccagcaccaccgtgcccaagatgattgtggacatgcagacccacagcagggtcatctcctatgagggctgcctgacccagatgtccttctttgtgctgtttgcctgcatggatgacatgctgctgtctgtgatggcctatgacagatttgtggccatctgccaccccctgcactaccgcatcatcatgaacccccggctgtgtggcttcctgatcctgctgtccttcttcatcagcctgctggacagccagctgcacaacctgatcatgctgcagctgacctgcttcaaggatgtggacatcagcaacttcttctgtgaccccagccagctgctgcacctgcgctgcagcgacaccttcatcaatgagatggtgatctacttcatgggcgccatcttcggctgcctgcccatcagcggcatcctcttctcctactacaagatcgtgagccccatcctgcgggtgcccaccagtgatggcaagtacaaggccttcagcacctgtggcagccacctggccgtggtgtgcctcttctacggcaccggcctggtgggctacctgagcagcgctgtgctgcccagccccaggaagtccatggtggcctctgtgatgtacacagtggtgacccccatgctgaaccccttcatctacagcctgaggaacaaggacatccagagcgccctgtgccgcctgcacggccgcatcatcaagagccaccacctgcaccccttctgctacatgggctag

SEQ ID NO: 36620 - DNA, 1002 bp, Artificial Sequence
  Description of Artificial Sequence: Synthetic coding sequence
atgggccccaggaaccagacagctgtgtctgagttcctgctgatgaaggtgacagaagatcctgagctgaagctgatccccttcagcctcttcctgtccatgtacctggtgaccatcctgggcaacctgctgatcctgctggccgtcatcagtgacagccacctgcacacccccatgtacttcctgctcttcaacctgtccttcacagacatctgcctgaccaccaccaccgtgcccaagatcctggtgaacatccaggcccagaaccagagcatcacctacacaggctgcctgacccagatctgcctggtgctggtgtttgctggcctggagagctgcttcctggccgtgatggcctatgacagatatgtggccatctgccaccccctgcgctacacagtgctgatgaatgtgcacttctggggcctgctgatcctgctgtccatgttcatgagcaccatggatgccctggtgcagagcctgatggtgctgcagctgtccttctgcaagaatgtggagatccccctcttcttctgtgaggtggtgcaggtgatcaagctggcctgcagcgacaccctcatcaacaacatcctgatctactttgccagctctgtgtttggagccatccccctgagcggcatcatcttctcctacagccagatcgtgacctctgtgctgaggatgcccagcgcccggggcaagtacaaggccttcagcacctgtggctgccacctgagcgtcttcagcctcttctacggcacagccttcggcgtgtacatcagcagcgctgtggccgagagcagccgcatcacagctgtggcctctgtgatgtacacagtggtgccccagatgatgaaccccttcatctacagcctgaggaacaaggagatgaagaaggccctgaggaagctgattggctggagcacagtggcccggagccggctgacagccaacagcgccagccgggtgcacgccatcctgctgcccaggcctcctgagtag

SEQ ID NO: 36621 - DNA, 936 bp, Artificial Sequence
  Description of Artificial Sequence: Synthetic coding sequence
atgggccccaggaaccagacagctgtgtctgagttcctgctgatgaaggtgacagaagatcctgagctgaagctgatccccttcagcctcttcctgtccatgtacctggtgaccatcctgggcaacctgctgatcctgctggccgtcatcagtgacagccacctgcacacccccatgtacttcctgctcttcaacctgtccttcacagacatctgcctgaccaccaccaccgtgcccaagatcctggtgaacatccaggcccagaaccagagcatcacctacacaggctgcctgacccagatctgcctggtgctggtgtttgctggcctggagagctgcttcctggccgtgatggcctatgacagatatgtggccatctgccaccccctgcgctacacagtgctgatgaatgtgcacttctggggcctgctgatcctgctgtccatgttcatgagcaccatggatgccctggtgcagagcctgatggtgctgcagctgtccttctgcaagaatgtggagatccccctcttcttctgtgaggtggtgcaggtgatcaagctggcctgcagcgacaccctcatcaacaacatcctgatctactttgccagctctgtgtttggagccatccccctgagcggcatcatcttctcctacagccagatcgtgacctctgtgctgaggatgcccagcgcccggggcaagtacaaggccttcagcacctgtggctgccacctgagcgtcttcagcctcttctacggcacagccttcggcgtgtacatcagcagcgctgtggccgagagcagccgcatcacagctgtggcctctgtgatgtacacagtggtgccccagatgatgaaccccttcatctacagcctgaggaacaaggagatgaagaaggccctgaggaagctgattggccgcctcttccccttctag

SEQ ID NO: 36622 - DNA, 1038 bp, Artificial Sequence
  Description of Artificial Sequence: Synthetic coding sequence
atgcccatgcagctgctgctgacagacttcatcatcttcagcatccgcttcatcatcaacagcatggaggccaggaaccagacagccatcagcaagttcctgctgctgggcctgattgaggaccctgagctgcagcctgtgctcttcagcctcttcctgtccatgtacctggtgaccatcctgggcaacctgctgatcctgctggccgtcatcagtgacagccacctgcacacccccatgtacttcttcctgagcaacctgtccttcctggacatctgcctgagcaccaccaccatccccaagatgctggtgaacatccaggcccagaacagaagcatcacctacagcggctgcctgacccagatctgctttgtgctcttctttgctggcctggagaactgcctgctggccgccatggcctatgaccgctacgtggccatctgccaccccctgcgctacaccgtcatcatgaacccccggctgtgtggcctgctgatcctgctgagcctgctgacctctgtggtgaatgccctgctgctgagcctgatggtgctgcggctgtccttctgcacagacctggagatccccctcttcttctgtgagctggcccaggtgatccagctgacctgcagcgacaccctcatcaacaacatcctgatctactttgctgcctgcatctttggaggagtgcccctgagcggcatcatcctgagctacacccagatcaccagctgtgtgctgaggatgcccagcgccagcggcaagcacaaggctgtgtccacctgtggcagccacctgagcatcgtgctgctcttctatggagctggcctgggcgtgtacatcagctctgtggtgacagacagccccaggaagacagctgtggcctctgtgatgtacagcgtcttcccccagatggtgaaccccttcatctacagcctgaggaacaaggacatgaagggcaccctgaggaagttcatcggccgcatccccagcctgctgtggtgtgccatctgcttcggcttccgcttcctggagtag

SEQ ID NO: 36623 - DNA, 939 bp, Artificial Sequence
  Description of Artificial Sequence: Synthetic coding sequence
atgaaggccggcaacttcagtgacaccccagagttcttcctgctgggcctgagcggggaccctgagctgcagcccatcctcttcatgctgttcctgtccatgtacctggccaccatgctgggcaacctgctgatcatcctggccgtgaacagcgacagccacctgcacacccccatgtacttcctgctgagcatcctgagcctggtggacatctgcttcaccagcaccaccatgcccaagatgctggtgaacatccaggcccaggcccagagcatcaactacacaggctgcctgacccagatctgctttgtgctggtgtttgtgggcctggagaatggcatcctggtgatgatggcctatgacagatttgtggccatctgccaccccctgcgctacaacgtcatcatgaaccccaagctgtgtggcctgctgctgctgctgtccttcatcgtgtctgtgctggatgccctgctgcacaccctgatggtgctgcagctgaccttctgcatcgacctggagatcccccacttcttctgtgagctggcccacatcctgaagctggcctgcagtgatgtgctgatcaacaacatcctggtgtacctggtgaccagcctgctgggcgtggtgcccctgagcggcatcatcttctcctacaccagaattgtgtcctctgtgatgaagatccccagcgctgggggcaagtacaaggccttcagcatctgtggcagccacctgattgtggtgtccctcttctacggcaccggcttcggcgtgtacctgagcagcggggccacccacagcagcaggaagggggccatcgcctctgtgatgtacacagtggtgacccccatgctgaaccccctcatctacagcctgaggaacaaggacatgctgaaggccctgaggaagctgatcagccgcatccccagcttccactag

SEQ ID NO: 36624 - DNA, 981 bp, Artificial Sequence
  Description of Artificial Sequence: Synthetic coding sequence
atgggcttcctgagccccatgcacccctgccggccccccacccagaggaggatggccgccggcaaccacagcacagtgacagagttcatcctgaagggcctgaccaagagagctgacctgcagctgcccctcttcctgctcttcctgggcatctacctggtgaccatcgtgggcaacctgggcatgatcaccctcatctgcctgaacagccagctgcacacccccatgtactacttcctgagcaacctgagcctgatggacctgtgctacagcagcgtcatcacccccaagatgctggtgaactttgtgtctgagaagaacatcatctcctatgccggctgcatgagccagctgtacttcttcctggtgtttgtgattgctgagtgctacatgctgactgtgatggcctatgaccgctacgtggccatctgccaccccctgctgtacaacatcatcatgagccaccacacctgcctgctgctggtggccgtggtgtatgccatcggcctgattggcagcaccattgaaacaggcctgatgctgaagctgccctactgtgagcacctgatcagccactacttctgtgacatcctgcccctgatgaagctgagctgcagcagcacctatgatgtggagatgaccgtcttcttctctgctggcttcaacatcatcgtgaccagcctgactgtgctggtgtcctacaccttcatcctgagcagcatcctgggcatcagcaccacagagggccgcagcaaggccttcagcacctgcagcagccacctggccgctgtgggcatgttctacggcagcacagccttcatgtacctgaagcccagcaccatcagcagcctgacccaggagaatgtggcctctgtgttctacaccaccgtcatccccatgctgaaccccctcatctacagcctgaggaacaaggaggtgaaggctgctgtgcagaagaccctgcggggcaagctgttctag

SEQ ID NO: 36625 - DNA, 933 bp, Artificial Sequence
  Description of Artificial Sequence: Synthetic coding sequence
atggccgccaagaacagctctgtgacagagttcatcctggagggcctgacccaccagcccggcctgcgcatccccctcttcttcctgttcctgggcttctacacagtgacagtggtgggcaacctgggcctcatcaccctcatcggcctgaacagccacctgcacacccccatgtacttcttcctgttcaacctgagcctgattgacttctgcttcagcaccaccatcacccccaagatgctgatgagctttgtgtccaggaagaacatcatctccttcaccggctgcatgacccagctgttcttcttctgcttctttgtggtgtctgagagcttcatcctgagcgccatggcctatgaccgctacgtggccatctgcaaccccctgctgtacacagtgaccatgagctgccaggtgtgcctgctgctgctgctgggcgcctacggcatgggctttgctggggccatggcccacacaggcagcatcatgaacctgaccttctgtgccgacaacctggtgaaccacttcatgtgtgacatcctgcccctgctggagctgagctgcaacagcagctacatgaatgagctggtggtgttcatcgtggtggccgtggatgtgggcatgcccatcgtgaccgtcttcatctcctatgccctgatcctgagcagcatcctgcacaacagcagcacagagggccgcagcaaggccttcagcacctgcagcagccacatcatcgtggtgtccctcttctttggaagtggggccttcatgtacctgaagcccctgagcatcctgcccctggagcagggcaaggtgagcagcctcttctacaccatcatcgtgcctgtgctgaaccccctcatctacagcctgaggaacaaggatgtgaaggtggccctgcggaggaccctgggcaggaagatcttctcctag

SEQ ID NO: 36626 - DNA, 942 bp, Artificial Sequence
  Description of Artificial Sequence: Synthetic coding sequence
atgctggccaggaacaacagcctggtgacagagttcatcctggccggcctgacagaccaccctgagttccggcagcccctcttcttcctgttcctggtgatctacatcgtgaccatggtgggcaacctgggcctcatcaccctgtttggcctgaacagccacctgcacacccccatgtactacttcctgttcaacctgtccttcatcgacctgtgctacagctctgtgttcacccccaagatgctgatgaactttgtgtccaagaagaacatcatcagcaatgtgggctgcatgaccaggctcttcttcttcctgttctttgtgatcagcgagtgctacatgctgacctccatggcctatgacagatatgtggccatctgcaaccccctgctgtacaaggtgaccatgagccaccaggtgtgcagcatgctgacctttgctgcctacatcatgggcctggccggggccacagcccacacaggctgcatgctgcggctgaccttctgcagcgccaacatcatcaaccactacctgtgtgacatcctgcccctgctgcagctgagctgcaccagcacctacgtgaatgaggtggtggtgctgattgtggtgggcaccaacatcaccgtgcccagctgcaccatcctgatctcctatgtgttcatcgtgaccagcatcctgcacatcaagagcacccagggccgcagcaaggccttcagcacctgcagcagccacgtgattgccctgagcctcttcttcggcagcgctgccttcatgtacatcaagtacagcagcggctccatggagcagggcaaggtgagcagcgtcttctacaccaacgtggtgcccatgctgaaccccctcatctacagcctgaggaacaaggatgtgaaggtggccctgaggaaggccctgatcaagatccagaggaggaacatcttctag

SEQ ID NO: 36627 - DNA, 942 bp, Artificial Sequence
  Description of Artificial Sequence: Synthetic coding sequence
atgctggccaggaacaacagcctggtgacagagttcatcctggccggcctgacagaccaccctgagttccagcagcccctcttcttcctgttcctggtggtgtacatcgtgaccatggtgggcaacctgggcctcatcatcctgtttggcctgaacagccacctgcacacccccatgtactacttcctgttcaacctgtccttcatcgacctgtgctacagctctgtgttcacccccaagatgctgatgaactttgtgtccaagaagaacatcatctcctatgtgggctgcatgacccagctgttcttcttcctgttctttgtgatcagcgagtgctacatgctgacctccatggcctatgacagatatgtggccatctgcaaccccctgctgtacaaggtgaccatgagccaccaggtgtgcagcatgctgacctttgctgcctacatcatgggcctggccggggccacagcccacacaggctgcatgctgcggctgaccttctgcagcgccaacatcatcaaccactacctgtgtgacatcctgcccctgctgcagctgagctgcaccagcacctacgtgaatgaggtggtggtgctgattgtggtgggcatcaacatcatggtgcccagctgcaccatcctgatctcctatgtgttcatcgtgaccagcatcctgcacatcaagagcacccagggccgcagcaaggccttcagcacctgcagcagccacgtgattgccctgagcctcttcttcggcagcgctgccttcatgtacatcaagtacagcagcggctccatggagcagggcaaggtgagcagcgtcttctacaccaacgtggtgcccatgctgaaccccctcatctacagcctgaggaacaaggatgtgaaggtggccctgaggaaggccctgatcaagatccagaggaggaacatcttctag

SEQ ID NO: 36628 - DNA, 930 bp, Artificial Sequence
  Description of Artificial Sequence: Synthetic coding sequence
atgaccctgaggaacagcagctctgtgacagagttcatcctggtgggcctgtctgagcagcctgagctgcagctgcccctcttcctgctcttcctgggcatctacgtgttcaccgtggtgggcaacctgggcctcatcaccctgattggcatcaaccccagcctgcacacccccatgtacttcttcctgttcaacctgtccttcatcgacctgtgctacagctgtgtgttcacccccaagatgctgaatgactttgtgtctgagagcatcatctcctatgtgggctgcatgacccagctgttcttcttctgcttctttgtgaacagcgagtgctacgtgctggtgtccatggcctatgaccgctacgtggccatctgcaaccccctgctgtacatggtgaccatgagcccccgggtgtgcttcctgctgatgtttggcagctatgtggtgggctttgctggggccatggcccacacaggctccatgctgcggctgaccttctgtgacagcaatgtgattgaccactacctgtgtgatgtgctgcccctgctgcagctgagctgcaccagcacccacgtgtctgagctggtgttcttcatcgtggtgggcgtcatcaccatgctgagcagcatcagcatcgtcatctcctatgccctgatcctgagcaacatcctgtgcatccccagcgctgagggccgcagcaaggccttcagcacctggggcagccacatcatcgctgtggccctcttctttggaagtggcaccttcacctacctgaccaccagcttccctggctccatgaaccacggccgctttgccagcgtcttctacaccaacgtggtgcccatgctgaaccccagcatctacagcctgaggaacaaggatgacaagctggccctgggcaagaccctgaagagggtgctcttctag

SEQ ID NO: 36629 - DNA, 936 bp, Artificial Sequence
  Description of Artificial Sequence: Synthetic coding sequence
atggctgctgagaacagcagctttgtgacccagttcatcctggccggcctgacagaccagcccggggtgcagatccccctcttcttcctgttcctgggcttctacgtggtgacagtggtgggcaacctgggcctcatcaccctcatccggctgaacagccacctgcacacccccatgtacttcttcctgtacaacctgtccttcatcgacttctgctacagcagcgtcatcacccccaagatgctgatgagctttgtgctgaagaagaacagcatctcctatgccggctgcatgacccagctgttcttcttcctgttctttgtggtgtctgagagcttcatcctgagcgccatggcctatgacagatatgtggccatctgcaaccccctgctgtacatggtgaccatgagcccccaggtgtgcttcctgctgctgctgggcgtgtatggcatgggctttgctggggccatggcccacacagcctgcatgatgggcgtgaccttctgtgccaacaacctggtgaaccactacatgtgtgacatcctgcccctgctggagtgtgcctgcaccagcacctacgtgaatgagctggtggtgtttgtggtggtgggcattgatattggagtgcccaccgtgaccatcttcatctcctatgccctgatcctgagcagcatcttccacatcgacagcacagagggccgcagcaaggccttcagcacctgcagcagccacatcatcgctgtgtccctcttcttcggcagcggggccttcatgtacctgaagcccttcagcctgctggccatgaaccagggcaaggtgagcagcctcttctacaccaccgtggtgcccatgctgaaccccctcatctacagcctgaggaacaaggatgtgaaggtggccctgaagaagatcctgaacaagaatgccttctcctag

SEQ ID NO: 36630 - DNA, 927 bp, Artificial Sequence
  Description of Artificial Sequence: Synthetic coding sequence
atgaccatggagaactacagcatggccgcccagtttgtgctggatggcctgacccagcaggccgagctgcagctgcccctcttcctgctcttcctgggcatctacgtggtgacagtggtgggcaacctgggcatgatcctgctgattgctgtgagccccctgctgcacacccccatgtactacttcctgagcagcctgagctttgtggacttctgctacagcagcgtcatcacccccaagatgctggtgaacttcctgggcaagaagaacaccatcctgtacagcgagtgcatggtgcagctgttcttctttgtggtgtttgtggtggccgagggctacctgctgacagccatggcctatgacagatatgtggccatctgcagccccctgctgtacaatgccatcatgagctcctgggtgtgcagcctgctggtgctggccgccttcttcctgggcttcctgagcgccctgacccacaccagcgccatgatgaagctgtccttctgcaagagccacatcatcaaccactacttctgtgatgtgctgcccctgctgaacctgagctgcagcaacacccacctgaatgagctgctgctcttcatcatcgccggcttcaacaccctggtgcccaccctggccgtggccgtgtcctatgccttcatcctgtacagcatcctgcacatccgcagcagcgagggccgcagcaaggccttcggcacctgcagcagccacctgatggctgtggtgatcttcttcggcagcatcaccttcatgtacttcaagccacccagcagcaacagcctggaccaggagaaggtgtcctctgtgttctacaccaccgtcatccccatgctgaaccccctcatctacagcctgaggaacaaggatgtgaagaaggccctgaggaaggtgctggtgggcaagtag

SEQ ID NO: 36631 - DNA, 936 bp, Artificial Sequence
  Description of Artificial Sequence: Synthetic coding sequence
atggccaccagcaaccacagcagcggggctgagttcatcctggccggcctgacccagaggcctgagctgcagctgcccctcttcctgctcttcctgggcatctacgtggtgacagtggtgggcaacctgggcatgatcttcctgattgccctgagcagccagctgtacccacctgtgtactacttcctgagccacctgtccttcatcgacctgtgctacagcagcgtcatcacccccaagatgctggtgaactttgtgcctgaggagaacatcatctccttcctggagtgcatcacccagctgtacttcttcctgatctttgtgattgctgagggctacctgctgacagccatggagtatgacagatatgtggccatctgccggcccctgctgtacaacatcgtgatgagccaccgggtgtgcagcatcatgatggctgtggtgtacagcctgggcttcctgtgggccaccgtgcacaccaccaggatgtctgtgctgtccttctgccgcagccacacagtgagccactacttctgtgacatcctgcccctgctgaccctgagctgcagcagcacccacatcaatgagatcctgctcttcatcatcggcggcgtgaacaccctggccaccaccctggccgtgctgatctcctatgccttcatcttcagcagcatcctgggcatccacagcacagagggccagagcaaggccttcggcacctgcagcagccacctgctggccgtgggcatcttcttcggcagcatcaccttcatgtacttcaagccacccagcagcaccaccatggagaaggagaaggtgtcctctgtgttctacatcaccatcatccccatgctgaaccccctcatctacagcctgaggaacaaggatgtgaagaatgccctgaagaagatgacccggggccggcagagcagctag

SEQ ID NO: 36632 - DNA, 945 bp, Artificial Sequence
  Description of Artificial Sequence: Synthetic coding sequence
atgggcgtgaagaaccacagcacagtgacagagttcctgctgagcggcctgacagagcaggccgagctgcagctgcccctcttctgcctcttcctgggcatctacacagtgacagtggtgggcaacctgtccatgatcagcatcatccggctgaaccggcagctgcacacccccatgtactacttcctgagcagcctgtccttcctggacttctgctacagcagcgtcatcacccccaagatgctgagcggcttcctgtgccgggacaggagcatctcctacagcggctgcatgatccagctgttcttcttctgtgtgtgtgtgatcagcgagtgctacatgctggccgccatggcctgtgacagatatgtggccatctgcagccccctgctgtacagagtcatcatgagcccccgggtgtgcagcctgctggtggccgctgtgttttctgtgggcttcacagatgctgtgattcatggaggctgcatcctgcggctgtccttctgtggcagcaacatcatcaagcactacttctgtgacatcgtgcccctcatcaagctgagctgcagcagcacctacattgatgagctgctgatcttcgtcatcggcggcttcaacatggtggccaccagcctgaccatcatcatctcctatgccttcatcctgaccagcatcctgcgcatccacagcaagaagggccgctgcaaggccttcagcacctgcagcagccacctgacagctgtgctgatgttctacggcagcctgatgtccatgtacctgaagccagccagcagcagcagcctgacccaggagaaggtgtcctctgtgttctacaccaccgtcatcctgatgctgaaccccctcatctacagcctgagaaataatgaggtgagaaatgccctgatgaagctgctgcggaggaagatcagcctgagccctggatag

SEQ ID NO: 36633 - DNA, 936 bp, Artificial Sequence
  Description of Artificial Sequence: Synthetic coding sequence
atgggcagaagaaacaacaccaacgtgcctgacttcatcctgaccggcctgagtgacagcgaggaggtgcagatggccctcttcatcctcttcctgctgatctacctgatcaccatgctgggcaatgtgggcatgatcctgatcatccggctggacctgcagctgcacacccccatgtacttcttcctgacccacctgtccttcatcgacctgagctacagcaccgtcatcacccccaagaccctggccaacctgctgaccagcaactacatctccttcatgggctgctttgcccagatgttcttctttgtgttcctgggcgctgctgagtgcttcctgctgagctccatggcctatgaccgctacgtggccatctgcagccccctgcgctaccctgtgatcatgagcaagaggctgtgctgtgccctggtgacaggcccctacgtgatctccttcatcaacagctttgtgaatgtggtgtggatgagccggctgcacttctgtgacagcaatgtggtgcgccacttcttctgtgacaccagccccatcctggccctgagctgcatggacacctatgacatcgagatcatgatccacatcctggccggcagcaccctgatggtgtccctcatcaccatcagcgccagctatgtgtccatcctgagcaccatcctgaagatcaacagcaccagcggcaagcagaaggccctgagcacctgtgccagccacctgctgggcgtgaccatcttctacggcaccatgatcttcacctacctgaagcccaggaagagctacagcctgggccgggaccaggtggccagcgtcttctacaccatcgtcatccccatgctgaaccccctcatctacagcctgaggaacaaggaggtgaagaatgccctgatccgggtgatgcagaggcggcaggacagcaggtag

SEQ ID NO: 36634 - DNA, 930 bp, Artificial Sequence
  Description of Artificial Sequence: Synthetic coding sequence
aacaacaccaacgtgcctgacttcatcctgaccggcctgagtgacagcgaggaggtgcagatggccctcttcatcctcttcctgctgatctacctgatcaccatgctgggcaatgtgggcatgatcctgatcatccggctggacctgcagctgcacacccccatgtacttcttcctgacccacctgtccttcatcgacctgagctacagcaccgtcatcacccccaagaccctggccaacctgctgaccagcaactacatctccttcatgggctgctttgcccagatgttcttctttgtgttcctgggcgctgctgagtgcttcctgctgagctccatggcctatgaccgctacgtggccatctgcagccccctgcgctaccctgtgatcatgagcaagaggctgtgctgtgccctggtgacaggcccctacgtgatctccttcatcaacagctttgtgaatgtggtgtggatgagccggctgcacttctgtgacagcaatgtggtgcgccacttcttctgtgacaccagccccatcctggccctgagctgcatggacacctatgacatcgagatcatgatccacatcctggccggcagcaccctgatggtgtccctcatcaccatcagcgccagctatgtgtccatcctgagcaccatcctgaagatcaacagcaccagcggcaagcagaaggccctgagcacctgtgccagccacctgctgggcgtgaccatcttctacggcaccatgatcttcacctacctgaagcccaggaagagctacagcctgggccgggaccaggtggccagcgtcttctacaccatcgtcatccccatgctgaaccccctcatctacagcctgaggaacaaggaggtgaagaatgccctgatccgggtgatgcagaggatctggtacgtgctgggcctgtag

SEQ ID NO: 36635 - DNA, 939 bp, Artificial Sequence
  Description of Artificial Sequence: Synthetic coding sequence
atgatgggcagaagaaacaacaccaacgtggccgacttcatcctgatgggcctgaccctgtctgaggagatccagatggccctcttcatgctgttcctgctgatctacctgatcaccatgctgggcaatgtgggcatgatcctgatcatccggctggacctgcagctgcacacccccatgtacttcttcctgacccacctgtccttcatcgacctgagctacagcacagtggtgacccccaagaccctggccaacctgctgaccagcaactacatctccttcaccggctgctttgcccagatgttcttctttgccttcctgggcacagctgagtgctacctgctgagctccatggcccatgacagatatgctgccatctgcagccccctgcactacaccgtcatcatgagcaagaggctgtgcctggccctgatcaccggcccctacgtgattggcttcatcgacagctttgtgaatgtggtgtccatgagccggctgcacttctatgacagcaatgtcatccaccacttcttctgtgacaccagccccatcctggccctgagctgcacagacacctacaacacagagatcctgatcttcatcatcgtgggcagcaccctgatggtgtccctcttcaccatcagcgccagctatgtgttcatcctcttcaccatcctgaagatcaacagcaccagcggcaagcagaaggccttcagcacctgtgtgagccacctgctgggcgtgaccatcttctacagcaccctcatcttcacctacctgaagcccaggaagagctacagcctgggccgggaccaggtggcctctgtgttctacaccatcgtcatccctgtgctgaaccccctcatctacagcctgaggaacaaggaggtgaagaatgctgtgatccgggtgatgcagaggcggcaggacagcaggtag

SEQ ID NO: 36636 - DNA, 939 bp, Artificial Sequence
  Description of Artificial Sequence: Synthetic coding sequence
atgatgggcagaagaaatgacaccaacgtggccgacttcatcctgaccggcctgagtgacagcgaggaggtgcagatggccctcttcatgctgttcctgctgatctacctgatcaccatgctgggcaatgtgggcatgctgctgatcatccggctggacctgcagctgcacacccccatgtacttcttcctgacccacctgtccttcatcgacctgagctacagcacagtggtgacccccaagaccctggccaacctgctgaccagcaactacatctccttcaccggctgctttgcccagatgttctgctttgtgttcctgggcacagctgagtgctacctgctgagctccatggcctatgacagatatgctgccatctgcagccccctgcactacaccgtcatcatgcccaagaggctgtgcctggccctgatcaccggcccctacgtgattggcttcatggacagctttgtgaatgtggtgtccatgagccggctgcacttctgtgacagcaacatcatccaccacttcttctgtgacaccagccccatcctggccctgagctgcacagacacagacaacacagagatgctgatcttcatcatcgccggcagcaccctgatggtgtccctcatcaccatcagcgccagctatgtgtccatcctgagcaccatcctgaagatcaacagcaccagcggcaagcagaaggccttcagcacctgtgtgagccacctgctgggcgtgaccatcttctacggcaccatgatcttcacctacctgaagcccaggaagagctacagcctgggccgggaccaggtggcccctgtgttctacaccatcgtcatccccatgctgaaccccctcatctacagcctgaggaaccgggaggtgaagaatgccctgatccgggtgatgcagaggcggcaggacagcaggtag

SEQ ID NO: 36637 - DNA, 933 bp, Artificial Sequence
  Description of Artificial Sequence: Synthetic coding sequence
atggccggcaacaacttcacagaggtgaccgtcttcatcctgagcggctttgccaaccaccctgagctgcaggtgtccctcttcctgatgttcctgttcatctacctgttcaccgtgctgggcaacctgggcctcatcaccctcatccgcatggacagccagctgcacacccccatgtacttcttcctgagcaacctggccttcatcgacatcttctacagcagcacagtgacccccaaggccctggtgaacttccagagcaacagaagaagcatcagctttgtgggctgctttgtgcagatgtacttctttgtgggcctggtgtgctgtgagtgcttcctgctgggctccatggcctacaaccgctacatcgccatctgcaaccccctgctgtacagcgtggtgatgagccagaaggtgagcaactggctgggcgtgatgccctacgtgattggcttcaccagcagcctcatctctgtgtgggtgatcagcagcctggccttctgtgacagcagcatcaaccacttcttctgtgacaccacagccctgctggccctgagctgtgtggacaccttcggcacagagatggtgtcctttgtgctggccggcttcaccctgctgagcagcctgctgatcatcaccgtgacctacatcatcatcatcagcgccatcctgcgcatccagagcgctgctggccggcagaaggccttcagcacctgtgccagccacctgatggctgtgaccatcttctacggcagcctcatcttcacctacctgcagcctgacaacaccagcagcctgacccaggcccaggtggccagcgtcttctacaccatcgtcatccccatgctgaaccccctcatctacagcctgaggaacaaggatgtgaagaatgccctgctgcgggtcatccacaggaagctgttcccctag

SEQ ID NO: 36638 - DNA, 951 bp, Artificial Sequence
  Description of Artificial Sequence: Synthetic coding sequence
atggcccctgagaacttcaccagggtgacagagttcatcctgactggagtgagcagctgcccagagctgcagatccccctcttcctggtgttcctggtgctgtatggcctgaccatggccggcaacctgggcatcatcaccctgacctctgtggacagccggctgcagacccccatgtacttcttcctgcagcacctggccctgatcaacctgggcaacagcacagtgattgcccccaagatgctgatcaacttcctggtgaagaagaagaccaccagcttctatgaatgtgccacccagctgggcggcttcctgttcttcatcgtgtctgaggtgatcatgctggccctgatggcctatgacagatatgtggccatctgcaaccccctgctgtacatggtggtggtgtcccggcggctgtgcctgctgctggtgtccctgacctacctgtatggcttcagcacagccatcgtggtgtcctcctatgtgttttctgtgtcctactgcagcagcaacatcatcaaccacttctactgtgacaacgtgcccctgctggccctgagctgcagcgacacctacctgcctgagaccgtggtgttcatctctgctgccaccaacgtggtgggcagcctcatcatcgtgctggtgtcctacttcaacatcgtgctgagcatcctgaagatctgcagcagcgagggcaggaagaaggccttcagcacctgtgccagccacatgatggctgtgaccatcttctacggcaccctgctcttcatgtatgtgcagcccaggagcaaccacagcctggacacagatgacaagatggccagcgtcttctacaccctggtgatccccatgctgaaccccctcatctacagcctgaggaacaaggatgtgaagacagccctgcagcgcttcatgaccaacctgtgctacagcttcaagaccatgtag

SEQ ID NO: 36639 - DNA, 948 bp, Artificial Sequence
  Description of Artificial Sequence: Synthetic coding sequence
atggcccctgagaacttcaccagggtgacagagttcatcctgactggagtgagcagctgcccagagctgcagatccccctcttcctggtgttcctggtgctgtatgtgctgaccatggccggcaacctgggcatcatcaccctgacctctgtggacagccggctgcagaaccccatgtacttcttcctgcggcacctggccatcatcaacctgggcaacagcacagtgattgcccccaagatgctgatgaacttcctggtgaagaagaagaccaccagcttctatgaatgtgccacccagctgggcggcttcctgttcttcatcgtgtctgaggtgatgatgctggccgtgatggcctatgacagatatgtggccatctgcaaccccctgctgtacatggtggtggtgtcccggcggctgtgcctgctgctggtgtccctgacctacctgtatggcttcagcacagccatcgtggtgagcccctgcatcttctctgtgtcctactgcagcagcaacatcatcaaccacttctactgtgacatcgcccccctgctggccctgagctgcagcgacacctacatccctgagaccatcgtgttcatctctgctgccaccaacctggtgttctccatgatcaccgtgctggtgtcctacttcaacatcgtgctgagcatcctgcgcatccgcagccctgagggcaggaagaaggccttcagcacctgtgccagccacatgattgctgtgacagtgttctacggcaccatgctgttcatgtacctgcagccccagaccaaccacagcctggacacagacaagatggcctctgtgttctacaccctggtgatccccatgctgaaccccctcatctacagcctgagaaataatgatgtgaatgtggccctgaagaagttcatggagaacccctgctacagcttcaagtccatgtag

SEQ ID NO: 36640 - DNA, 960 bp, Artificial Sequence
  Description of Artificial Sequence: Synthetic coding sequence
atgaaccacgtggtgaagcacaaccacacagctgtgaccaaggtgacagagttcatcctgatgggcatcacagacaaccctggcctgcaggcccccctgtttggcctcttcctgatcatctacctggtgaccgtcatcggcaacctgggcatggtgatcctgacctacctggacagcaagctgcacacccccatgtacttcttcctgcggcacctgagcatcacagacctgggctacagcacagtgattgcccccaagatgctggtgaacttcatcgtgcacaagaacaccatctcctacaactggtacgccacccagctggccttctttgagatcttcatcatcagcgagctgttcatcctgagcgccatggcctatgacagatatgtggccatctgcaagcccctgctgtatgtgatcatcatggccgagaaggtgctgtgggtgctggtgattgtgccctacctgtacagcacctttgtgtccctcttcctgaccatcaagctgttcaagctgtccttctgtggcagcaacatcatctcctacttctactgtgactgcatccccctgatgagcatcctgtgcagcgacaccaatgagctggagctgatcatcctgatcttcagcggctgcaacctgctcttcagcctgagcatcgtgctgatctcctacatgttcatcctggtggccatcctgaggatgaacagcaggaagggccgctacaaggccttcagcacctgcagcagccacctgactgtggtgatcatgttctacggcaccctgctcttcatctacctgcagcccaagagcagccacaccctggccatcgacaagatggcctctgtgttctacaccctgctgatccccatgctgaaccccctcatctacagcctgaggaacaaggaggtgaaggatgccctgaagaggaccctgaccaaccgcttcaagatccccatctag

SEQ ID NO: 36641 - DNA, 939 bp, Artificial Sequence
  Description of Artificial Sequence: Synthetic coding sequence
atggagcagcacaacctgaccaccgtgaatgagttcatcctgaccggcatcacagacattgctgagctgcaggcccccctgtttgccctcttcctgatgatctacgtgatctctgtgatgggcaacctgggcatgattgtgctgaccaagctggacagccggctgcagacccccatgtacttcttcctgcggcacctggccttcatggacctgggctacagcaccaccgtgggccccaagatgctggtgaactttgtggtggacaagaacatcatctcctactacttctgtgccacccagctggccttcttcctggtgttcatcggcagcgagctgttcatcctgagcgccatgtcctatgacctgtatgtggccatctgcaaccccctgctgtacaccgtcatcatgagccggcgggtgtgccaggtgctggtggccatcccctacctgtactgcaccttcatcagcctgctggtgaccatcaagatcttcaccctgtccttctgtggctacaacgtcatcagccacttctactgtgacagcctgcccctgctgcccctgctgtgcagcaacacccatgaaattgagctgatcatcctgatctttgctgccatcgacctgatcagcagcctgctgattgtgctgctgagctacctgctgatcctggtggccatcctgaggatgaacagcgctggccggcagaaggccttcagcacctgtggggcccacctgactgtggtgattgtgttctacggcaccctgctcttcatgtatgtgcagcccaagagcagccacagctttgacacagacaaggtggccagcatcttctacaccctggtgatccccatgctgaaccccctcatctacagcctgaggaacaaggatgtgaagtatgccctgcggaggacctggaacaacctgtgcaacatctttgtgtag

SEQ ID NO: 36642 - DNA, 924 bp, Artificial Sequence
  Description of Artificial Sequence: Synthetic coding sequence
atgggccagcacaacctgactgtgctgacagagttcatcctgatggagctgaccaggaggcctgagctgcagatccccctgtttggagtcttcctggtgatctacctgatcaccgtggtgggcaacctgaccatgatcatcctgaccaagctggacagccacctgcacacccccatgtacttcagcatccgccacctggcctttgtggacctgggcaacagcaccgtcatctgccccaaggtgctggccaactttgtggtggacaggaacaccatctcctactatgcctgtgccgcccagctggccttcttcctgatgttcatcatcagcgagttcttcatcctgagcgccatggcctatgacagatatgtggccatctgcaaccccctgctgtactacgtgatcatgagccagaggctgtgccacgtgctggtgggcatccagtacctgtacagcaccttccaggccctgatgttcaccatcaagatcttcaccctgaccttctgtggcagcaatgtcatcagccacttctactgtgatgatgtgcccctgctgcccatgctgtgcagcaatgcccaggagattgagctgctgagcatcctcttctctgtgttcaacctgatcagcagcttcctgattgtgctggtgtcctacatgctgatcctgctggccatctgccagatgcacagcgctgagggcaggaagaaggccttcagcacctgtggcagccacctgactgtggtggtggtgttctacggcagcctgctcttcatgtacatgcagcccaacagcacccacttctttgacacagacaagatggcctctgtgttctacaccctggtgatccccatgctgaaccccctcatctacagcctgagaaatgaggaggtgaagaatgccttctacaagctgtttgagaactag

SEQ ID NO: 36643 - DNA, 1080 bp, Artificial Sequence
  Description of Artificial Sequence: Synthetic coding sequence
atggccctgggcaaccacagcaccatcacagagttcctgctgctgggcctgtctgctgaccccaacatccgggccctgctgtttgtgctcttcctgggcatctacctgctgaccatcatggagaacctgatgctgctgctgatgatccgggctgacagctgcctgcacaagcccatgtacttcttcctgagccacctgagctttgtggacctgtgcttcagctctgtgattgtgcccaagatgctggagaacctgctgagccagaggaagaccatctctgtggagggctgcctggcccaggtgttctttgtgtttgtgacagctggaacagaggcctgcctgctgagcggcatggcctatgacagacatgctgccatctgccggcccctgctgtatggccagatcatgggcaagcagctgtacatgcacctggtgtggggctcctggggcctgggcttcctggatgccctgatcaacgtgctgctggccgtgaacatggtgttctgtgaggccaagatcatccaccactacagctatgagatgcccagcctgctgcccctgagctgcagcgacatcagccgcagcctgattgccctgctgtgcagcaccctgctgcacggcctgggcaacttcctgctggtgttcctgagctacacccgcatcatcagcaccatcctgagcatcagcagcaccagcggccgcagcaaggccttcagcacctgcagcgcccacctgacagctgtgaccctgtactacggcagcggcctgctgcggcacctgatgcccaacagcggcagccccatcgagctgatcttctctgtgcagtacacagtggtgacccccatgctgaacagcctcatctacagcctgaagaacaaggaggtgaagggggagaggagcctgcgggacagcagccacctgccccagctgcacaagggccaggcccgctggaagaggcctgccttcacagagggccggcgggagcccggccaccctgagctgagcatccctgtgaccccccagccccagggcgcctgtgcctgcagcgccctgcgggccgcccccacagccctgccctag

SEQ ID NO: 36644 - DNA, 930 bp, Artificial Sequence
  Description of Artificial Sequence: Synthetic coding sequence
atggcccacatcaactgcacccaggccacagagttcatcctggtgggcctgacagaccaccaggagctgaagatgcccctgtttgtgctcttcctgagcatctacctgttcaccgtggtgggcaacctgggcctcatcctgctgatccgggctgacaccagcctgaacacccccatgtacttcttcctgagcaacctggcctttgtggacttctgctacagcagcgtcatcacccccaagatgctgggcaacttcctgtacaagcagaatgtcatcagctttgatgcctgtgccacccagctgggctgcttcctgaccttcatgatcagcgagagcctgctgctggcctccatggcctatgacagatatgtggccatctgcaaccccctgctgtacatggtggtgatgaccccaggcatctgcatccagctggtggccgtgccctacagctacagcttcctgatggccctcttccacaccatcctgaccttccggctgagctactgccacagcaacatcgtgaaccacttctactgtgatgacatgcccctgctgcggctgacctgcagcgacacccgcttcaagcagctgtggatctttgcctgtgccggcatcatgttcatcagcagcctgctgattgtgtttgtgtcctacatgttcatcatcagcgccatcctgaggatgcacagcgctgagggccggcagaaggccttcagcacctgtggcagccacatgctggccgtgaccatcttctacggcaccctcatcttcatgtacctgcagcccagcagcagccacgccctggacacagacaagatggcctctgtgttctacaccgtcatcatccccatgctgaaccccctcatctacagcctgcagaacaaggaggtgaaggaggccctgaagaagatcatcatcaacaagaactag

SEQ ID NO: 36645 - DNA, 933 bp, Artificial Sequence
  Description of Artificial Sequence: Synthetic coding sequence
atgatggacaaccacagcagcgccacagagttccacctgctgggcttccctggcagccagggcctgcaccacatcctgtttgccatcttcttcttcttctacctggtgaccctgatgggcaacacagtcatcatcgtgattgtgtgtgtggacaagaggctgcagagccccatgtacttcttcctgagccacctgagcaccctggagatcctggtgaccaccatcatcgtgcccatgatgctgtggggcctgctcttcctgggctgccggcagtacctgagcctgcacgtgtccctgaacttcagctgtggcaccatggagtttgccctgctgggcgtgatggctgtggacagatatgtggccgtgtgcaaccccctgcgctacaacatcatcatgaacagcagcacctgcatctgggtggtgattgtgtcctgggtgtttggcttcctgtctgagatctggcccatctatgccaccttccagttcaccttcaggaagagcaacagcctggaccacttctactgtgaccggggccagctgctgaagctgagctgtgacaacaccctgctgacagagttcatcctcttcctgatggctgtgttcatcctgattggcagcctcatccccaccatcgtgtcctacacctacatcatcagcaccatcctgaagatccccagcgccagcggccgcaggaaggccttcagcacctttgccagccacttcacctgtgtggtgattggctacggcagctgcctcttcctgtatgtgaagcccaagcagacccagggcgtggagtacaacaagatcgtgtccctgctggtgtctgtgctgacccccttcctgaaccccttcatcttcaccctgagaaatgacaaggtgaaggaggccctgagagatggcatgaagcgctgctgccagctgctgaaggactag

SEQ ID NO: 36646 - DNA, 945 bp, Artificial Sequence
  Description of Artificial Sequence: Synthetic coding sequence
atgctgatgaactacagcagcgccacagagttctacctgctgggcttccctggcagcgaggagctgcaccacatcctgtttgccatcttcttcttcttctacctggtgaccctgatgggcaacacagtcatcatcatgattgtgtgtgtggacaagaggctgcagagccccatgtacttcttcctgggccacctgagcgccctggagatcctggtgaccaccatcatcgtgcctgtgatgctgtggggcctgctgctgcccggcatgcagaccatctacctgagcgcctgtgtggtgcagctgttcctgtacctggccgtgggcaccacagaatttgccctgctgggcgccatggctgtggacagatatgtggccgtgtgcaaccccctgcgctacaacatcatcatgaacagacacacctgcaactttgtggtgctggtgtcctgggtgtttggcttcctgttccagatctggcctgtgtatgtgatgttccagctgacctactgcaagagcaatgtggtgaacaacttcttctgtgaccggggccagctgctgaagctgagctgcaacaacaccctcttcacagagttcatcctcttcctgatggctgtgtttgtgctgtttggcagcctcatccccaccatcgtgtccaatgcctacatcatcagcaccatcctgaagatccccagcagcagcggccgcaggaagagcttcagcacctgtgccagccacttcacctgtgtggtgattggctacggcagctgcctcttcctgtatgtgaagcccaagcagacccaggccgctgactacaactgggtggtgtccctgatggtgtctgtggtgacccccttcctgaaccccttcatcttcaccctgagaaatgacaaggtgattgaggccctgagagatggagtgaagcgctgctgccagctgttcagaaattag

SEQ ID NO: 36647 - DNA, 918 bp, Artificial Sequence
  Description of Artificial Sequence: Synthetic coding sequence
atgcagaggagcaaccacacagtgacagagttcatcctgctgggcttcaccacagaccccggcatgcagctgggcctgtttgtggtgttcctgggcgtgtacagcctgactgtggtgggcaacagcaccctgattgtgctgatctgcaatgacagctgcctgcacacccccatgtacttcttcaccggcaacctgtccttcctggacctgtggtacagctctgtgtacacccccaagatcctggtgacctgcatcagcgaggacaagagcatcagctttgctggctgcctgtgccagttcttcttctctgctggcctggcctacagcgagtgctacctgctggccgctgtggcctatgaccgctacgtggccatcagcaagcccctgctgtatgcccaggccatgagcatcaagctgtgtgccctgctggtggccgtgtcctactgcggcggcttcatcaacagcagcatcatcaccaagaagaccttctccttcaacttctgccgggagaacatcattgatgacttcttctgtgacctgctgcccctggtggagctggcctgtggggagaagggcggctacaagatcatgatgtacttcctgctggccagcaatgtcatctgcccagctgtgctgatcctggccagctacctgttcatcatcacctctgtgctgcgcatcagcagcagcaagggctacctgaaggccttcagcacctgcagcagccacctgacctctgtgaccctgtactacggcagcatcctgtacatctatgccctgcccaggagcagctacagctttgacatggacaagatcgtgtccaccttctacacagtggtgttccccatgctgaacctgatgatctacagcctgaggaacaaggatgtgaaggaggccctgaagaagctgctgccctag

SEQ ID NO: 36648 - DNA, 984 bp, Artificial Sequence
  Description of Artificial Sequence: Synthetic coding sequence
atgatcttccccagccatgacagccaggccttcacctctgtggacatggaggtgggcaactgcaccatcctgacagagttcatcctgctgggcttctctgctgacagccagtggcagcccatcctgtttggagtcttcctgatgctgtacctgatcaccctgagcggcaacatgaccctggtgatcctgatcagaacagacagccacctgcacacccccatgtacttcttcatcggcaacctgtccttcctggacttctggtacacctctgtgtacacccccaagatcctggccagctgtgtgtctgaggacaagaggatcagcctggccggctgtggggcccagctgttcttcagctgtgtggtggcctacacagagtgctacctgctggccgccatggcctatgacagacatgctgccatctgcaaccccctgctgtacagcggcaccatgagcacagccctgtgcaccggcctggtggccggcagctacatcggcggcttcctgaatgccatcgcccacacagccaacaccttccggctgcacttctgtgggaagaacatcatcgaccacttcttctgtgatgccccacccctggtgaagatgagctgcaccaacaccagggtgtatgagaaggtgctgctgggcgtggtgggcttcaccgtgctgagcagcatcctggccatcctgatctcctatgtgaacatcctgctggccatcctgcgcatccacagcgccagcggccgccacaaggccttcagcacctgtgccagccacctgatctctgtgatgctgttctacggcagcctgctcttcatgtacagccggcccagcagcacctacagcctggagcgggacaaggtggccgccctcttctacaccgtcatcaaccccctgctgaaccccctcatctacagcctgaggaacaaggacatcaaggaggccttcaggaaggccacccagaccatccagccccagacctag

SEQ ID NO: 36649 - DNA, 945 bp, Artificial Sequence
  Description of Artificial Sequence: Synthetic coding sequence
atggccaagaacaacctgaccagggtgacagagttcatcctgatgggcttcatggaccaccccaagctggagatccccctcttcctggtgttcctgtccttctacctggtgaccctgctgggcaatgtgggcatgatcatgctgatccaggtggatgtgaagctgtacacccccatgtacttcttcctgagccacctgagcctgctggatgcctgctacaccagcgtcatcaccccccagatcctggccaccctggccaccgggaagacagtcatctcctatggccactgtgccgcccagttcttcctgttcaccatctgtgccggcacagagtgcttcctgctggccgtgatggcctatgacagatatgctgccatccggaaccccctgctgtacacagtggccatgaacccccggctgtgctggagcctggtggtgggcgcctacgtgtgtggggtgtctggggccatcctgcggaccacctgcaccttcaccctgtccttctgcaaggacaaccagatcaacttcttcttctgtgacctgccccccctgctgaagctggcctgcagcgacacagccaacattgaaattgtcatcatcttcttcggcaactttgtgatcctggccaatgccagcgtcatcctgatctcctacctgctgatcatcaagaccatcctgaaggtgaagagcagcggcggccgggccaagaccttcagcacctgtgccagccacatcacagctgtggccctcttcttcggggccctgatcttcatgtacctgcagagcggcagcggcaagagcctggaggaggacaaggtggtgtctgtgttctacacagtggtgatccccatgctgaaccccctcatctacagcctgaggaacaaggatgtgaaggatgccttcaggaaggtggcccggcggctgcaggtgtccctgtccatgtag

SEQ ID NO: 36650 - DNA, 1008 bp, Artificial Sequence
  Description of Artificial Sequence: Synthetic coding sequence
atgctgggcagcaagccccgggtgcacctgtacatcctgccctgtgccagccagcaggtgtccaccatgggagaccggggcaccagcaaccacagcgagatgacagacttcatcctggccggcttccgggtgcggcctgagctgcacatcctgctcttcctgctcttcctgtttgtgtatgccatgatcctgctgggcaatgtgggcatgatgaccatcatcatgacagacccccggctgaacacccccatgtacttcttcctgggcaacctgtccttcatcgacctcttctacagcagcgtcatcgagcccaaggccatgatcaacttctggagcgagaacaagagcatcagctttgctggctgtgtggcccagctgttcctgtttgccctgctgattgtgacagagggcttcctgctggccgccatggcctatgaccgcttcatcgccatctgcaaccccctgctgtacagcgtgcagatgagcacccggctgtgcacccagctggtggccggcagctacttctgtggctgcatcagcagcgtcatccagacctccatgaccttcaccctgtccttctgtgccagcagagctgtggaccacttctactgtgacagccggcccctgcagaggctgagctgcagcgacctcttcatccacaggatgatctccttcagcctgagctgcatcatcatcctgcccaccatcatcgtcatcatcgtgtcctacatgtacatcgtgtccacagtgctgaagatccacagcacagagggccacaagaaggccttcagcacctgcagcagccacctgggcgtggtgtctgtgctgtatggagctgtgttcttcatgtacctgaccccagaccgcttccctgagctgagcaaggtggccagcctgtgctacagcctggtgacccccatgctgaaccccctcatctacagcctgaggaacaaggatgtgcaggaggccctgaagaagttcctggagaagaagaacatcatcctgtag

SEQ ID NO: 36651 - DNA, 933 bp, Artificial Sequence
  Description of Artificial Sequence: Synthetic coding sequence
atggccgagatgaacctgaccctggtgacagagttcctgctgattgccttcacagagtacccagagtgggccctgcccctcttcctgctcttcctgttcatgtacctgatcaccgtgctgggcaacctggagatgatcatcctgatcctgatggaccaccagctgcacgcccccatgtacttcctgctgagccacctggccttcatggatgtgtgctacagcagcatcaccgtgccccagatgctggccgtgctgctggagcacggggccgccctgagctacacccgctgtgccgcccagttcttcctgttcaccttcttcggcagcattgactgctacctgctggccctgatggcctatgaccgctacctggccgtgtgccagcccctgctgtatgtgaccatcctgacccagcaggcccggctgagcctggtggccggggcctacgtggccggcctcatcagcgccctggtgaggacagtgtctgccttcaccctgtccttctgtggcaccagcgagattgacttcatcttctgtgacctgccccccctgctgaagctgacctgtggggagagctacacccaggaggtgctgatcatcatgtttgccatctttgtgatcccagcctccatggtggtgatcctggtgtcctacctgttcatcatcgtggccatcatgggcatcccagctggcagccaggccaagaccttcagcacctgcaccagccacctgacagctgtgtccctcttcttcggcaccctcatcttcatgtacctgcggggcaacagcgaccagagcagcgagaagaacagagtggtgtctgtgctgtacacagaggtgatccccatgctgaaccccctcatctacagcctgaggaacaaggaggtgaaggaggccctgaggaagatcctgaacagagccaagctgtcctag

SEQ ID NO: 36652 - DNA, 945 bp, Artificial Sequence
  Description of Artificial Sequence: Synthetic coding sequence
atggccgagaggaactacacagtggtgacagagttcttcctgacagccttcacagagcacctgcagtggagggtgcccctcttcctgatcttcctgtccttctacctggccaccatgctgggcaacacaggcatgatcctgctgatccggggggaccggcggctgcacacccccatgtacttcttcctgagccacctgagcctggtggacatctgctacagcagcgccatcatcccccagatgctggccgtgctgtgggagcacggcaccaccatcagccaggcccgctgtgccgcccagttcttcctgttcaccttctttgccagcattgactgctacctgctggccatcatggcctatgaccgctacacagctgtgtgccagcccctgctgtatgtgaccatcatcacagagaaggcccgctggggcctggtgactggagcctacgtggccggcttcttcagcgcctttgtgaggacagtgacagccttcaccctgtccttctgtggcaacaatgagatcaacttcatcttctgtgacctgccccccctgctgaagctgagctgtggggacagctacacccaggaggtggtgatcatcgtgtttgccctgtttgtgatgcctgcctgcatcctggtgatcctggtgtcctacctgttcatcatcgtggccatcctgcagatccacagcgctgggggccgggccaagaccttcagcacctgtgccagccacctgacagctgtggccctcttcttcggcaccctcatcttcatgtacctgcgggacaacacaggccagagcagcgagggggacagagtggtgtctgtgctgtacacagtggtgacccccatgctgaaccccctcatctacagcctgaggaacaaggaggtgaaggaggccaccaggaaggccctgagcaagagcaagccagcccggcggccctag

SEQ ID NO: 36653 - DNA, 426 bp, Artificial Sequence
  Description of Artificial Sequence: Synthetic coding sequence
atgtccttcagcctgaacttcaccctgcctgccaacaccaccagcagccctgtgactggaggcaaggagacagactgtggccccagcctgggcctggccgccggcatccccctgctggtggccacagccctgctggtggccctgctcttcaccctcatccacagaagaagaagcagcattgaggccatggaggagagtgaccggccctgtgagatcagcgagattgatgacaaccccaagatcagcgagaacccccggcgcagccccacccatgagaagaacaccatgggcgcccaggaggcccacatctacgtgaagacagtggccggcagcgaggagcctgtgcatgaccgctaccggcccaccatcgagatggagcggcggcggggcctgtggtggctggtgccccggctgagcctggagtag

SEQ ID NO: 36654 - DNA, 393 bp, Artificial Sequence
  Description of Artificial Sequence: Synthetic coding sequence
atgtccttcagcctgaacttcaccctgcctgccaacacagactgtggccccagcctgggcctggccgccggcatccccctgctggtggccacagccctgctggtggccctgctcttcaccctcatccacagaagaagaagcagcattgaggccatggaggagagtgaccggccctgtgagatcagcgagattgatgacaaccccaagatcagcgagaaccccaggaggagccccacccatgagaagaacaccatgggcgcccaggaggcccacatctacgtgaagacagtggccggcagcgaggagcctgtgcatgaccgctaccggcccaccatcgagatggagaggagaagaggcctgtggtggctggtgccccggctgagcctggagtag

SEQ ID NO: 36655 - DNA, 357 bp, Artificial Sequence
  Description of Artificial Sequence: Synthetic coding sequence
atggactgtggccccagcctgggcctggccgccggcatccccctgctggtggccacagccctgctggtggccctgctcttcaccctcatccacagaagaagaagcagcattgaggccatggaggagagtgaccggccctgtgagatcagcgagattgatgacaaccccaagatcagcgagaaccccaggaggagccccacccatgagaagaacaccatgggcgcccaggaggcccacatctacgtgaagacagtggccggcagcgaggagcctgtgcatgaccgctaccggcccaccatcgagatggagaggagaagaggcctgtggtggctggtgccccggctgagcctggagtag

SEQ ID NO: 36656 - DNA, 396 bp, Artificial Sequence
  Description of Artificial Sequence: Synthetic coding sequence
atgaggatgaccagcagccctgtgactggaggcaaggagacagactgtggccccagcctgggcctggccgccggcatccccctgctggtggccacagccctgctggtggccctgctcttcaccctcatccacagaagaagaagcagcattgaggccatggaggagagtgaccggccctgtgagatcagcgagattgatgacaaccccaagatcagcgagaacccccggcgcagccccacccatgagaagaacaccatgggcgcccaggaggcccacatctacgtgaagacagtggccggcagcgaggagcctgtgcatgaccgctaccggcccaccatcgagatggagcggcggcggggcctgtggtggctggtgccccggctgagcctggagtag

SEQ ID NO: 36657 - DNA, 396 bp, Artificial Sequence; identical to SEQ ID NO: 36656
  Description of Artificial Sequence: Synthetic coding sequence

SEQ ID NO: 36658 - DNA, 450 bp, Artificial Sequence
  Description of Artificial Sequence: Synthetic coding sequence
atggagaccctgtacagagtgcccttcctggtgctggagtgccccaacctgaagctgaagaagccaccctggctgcacatgcccagcgccatgacagtgtatgccctggtggtggtgtcctacttcctgatcactggaggcatcatctatgatgtgattgtggagccccccagcgtgggctccatgacagatgagcacggccaccagaggcctgtggccttcctggcctacagagtgaatggccagtacatcatggagggcctggccagcagcttcctgttcaccatgggcggcctgggcttcatcatcctggacaggagcaatgcccccaacatccccaagctgaaccgcttcctgctgctcttcatcggctttgtgtgtgtgctgctgtccttcttcatggcccgggtcttcatgaggatgaagctgcccggctacctgatgggctag

SEQ ID NO: 36659 - DNA, 516 bp, Artificial Sequence
  Description of Artificial Sequence: Synthetic coding sequence
atggagaccctgtacagagtgcccttcctggtgctggagtgccccaacctgaagctgaagaagccaccctggctgcacatgcccagcgccatgacagtgtatgccctggtggtggtgtcctacttcctgatcactggaggcatcatctatgatgtgattgtggagccccccagcgtgggctccatgacagatgagcacggccaccagaggcctgtggccttcctggcctacagagtgaatggccagtacatcatggagggcctggccagcagcttcctgttcaccatgggcggcctgggcttcatcatcctggacaggagcaatgcccccaacatccccaagctgaaccgcttcctgctgctcttcatcggctttgtgtgtgtgctgctgtccttcttcatggcccgggtcttcatgaggatgaagctgcccaggagcctggccctgctgccccggctggagtgcagcggggtcatcagcgcccactacaagctgtgcctgcccggggccatctag

SEQ ID NO: 36660 - DNA, 1461 bp, Artificial Sequence
  Description of Artificial Sequence: Synthetic coding sequence
atgtccttcatctgtggcctgcagagcgctgccaggaaccacgtgttcttccgcttcaacagcctgagcaactggaggaagtgcaacaccctggccagcaccagccggggctgccaccaggtgcaggtgaaccacatcgtgaacaagtaccagggcctgggcgtgaaccagtgtgaccgctggagcttcctgcccggcaacttccacttctacagcaccttcaacaacaagaggactggaggcctgagcagcaccaagagcaaggagatctggaggatcaccagcaagtgcaccgtgtggaatgatgccttcagccggcagctgctgatcaaggaggtgacagctgtgcccagcctgtctgtgctgcaccccctgagccctgccagcatccgggccatccggaacttccacaccagcccccgcttccaggccgcccctgtgcccctgctgctgatgatcctgaagcctgtgcagaagctgtttgccatcatcgtgggccggggcatcaggaagtggtggcaggccctgccccccaacaagaaggaggtggtgaaggagaacatcaggaagaacaagtggaagctgttcctgggcctgagcagctttggcctgctgtttgtggtgttctacttcacccacctggaggtgagccccatcaccggccgcagcaagctgctgctgctgggcaaggagcagttccggctgctgtctgagctggagtatgaggcctggatggaggagttcaagaatgacatgctgacagagaaggatgcccgctacctggccgtgaaggaggtgctgtgccacctgattgagtgcaacaaggatgtgcccggcatcagccagatcaactgggtgatccacgtggtggacagccccatcatcaatgcctttgtgctgcccaacggccagatgtttgtgttcaccggcttcctgaacagcgtgacagacatccaccagctgtccttcctgctgggccatgaaattgcccatgctgtgctgggccatgctgctgagaaggccggcatggtgcacctgctggacttcctgggcatgatcttcctgaccatgatctgggccatctgcccccgggacagcctggccctgctgtgccagtggatccagagcaagctgcaggagtacatgttcaaccggccctacagcaggaagctggaggccgaggccgacaagattggcctgctgctggccgccaaggcctgtgccgacatccgggccagcagcgtcttctggcagcagatggagtttgtggacagcctgcacggccagcccaagatgcctgagtggctgagcacccaccccagccacggcaacagagtggagtacctggacaggctcatcccccagctggtgcgggaggagaagttcatcgagcagcctgagcagattgctgagctgaccctgaacagcttcatccagaacacagagatctgccgctcctag

SEQ ID NO: 36661 - DNA, 1575 bp, Artificial Sequence
  Description of Artificial Sequence: Synthetic coding sequence
atgtccttcatctgtggcctgcagagcgctgccaggaaccacgtgttcttccgcttcaacagcctgagcaactggaggaagtgcaacaccctggccagcaccagccggggctgccaccaggtgcaggtgaaccacatcgtgaacaagtaccagggcctgggcgtgaaccagtgtgaccgctggagcttcctgcccggcaacttccacttctacagcaccttcaacaacaagaggactggaggcctgagcagcaccaagagcaaggagatctggaggatcaccagcaagtgcaccgtgtggaatgatgccttcagccggcagctgctgatcaaggaggtgacagctgtgcccagcctgtctgtgctgcaccccctgagccctgccagcatccgggccatccggaacttccacaccagcccccgcttccaggccgcccctgtgcccctgctgctgatgatcctgaagcctgtgcagaagctgtttgccatcatcgtgggccggggcatcaggaagtggtggcaggccctgccccccaacaagaaggaggtggtgaaggagaacatcaggaagaacaagtggaagctgttcctgggcctgagcagctttggcctgctgtttgtggtgttctacttcacccacctggaggtgagccccatcaccggccgcagcaagctgctgctgctgggcaaggagcagttccggctgctgtctgagctggagtatgaggcctggatggaggagttcaagaatgacatgctgacagagaaggatgcccgctacctggccgtgaaggaggtgctgtgccacctgattgagtgcaacaaggatgtgcccggcatcagccagatcaactgggtgatccacgtggtggacagccccatcatcaatgcctttgtgctgcccaacggccagatgtttgtgttcaccggcttcctgaacagcgtgacagacatccaccagctgtccttcctgctgggccatgaaattgcccatgctgtgctgggccatgctgctgagaaggccggcatggtgcacctgctggacttcctgggcatgatcttcctgaccatgatctgggccatctgcccccgggacagcctggccctgctgtgccagtggatccagagcaagctgcaggagtacatgttcaaccggccctacagcaggaagctggaggccgaggccgacaagattggcctgctgctggccgccaaggcctgtgccgacatccgggccagcagcgtcttctggcagcagatggagtttgtggacagcctgcacggccagcccaagatgcctgagtggctgagcacccaccccagccacggcaacagagtggagtacctggacaggctcatcccccaggccctgaagatccgggagatgtgcaactgcccccccctgagcaacccagacccccggctgctcttcaagctgagcaccaagcacttcctggaggagagcgagaaggaggacctgaacatcaccaagaagcagaagatggacaccctgcccatccagaagcaggagcagatccccctgacctacatcgtggagaagaggacaggcagctag

SEQ ID NO: 36662 - DNA, 768 bp, Artificial Sequence
  Description of Artificial Sequence: Synthetic coding sequence
atgtccttcatctgtggcctgcagagcgctgccaggaaccacgtgttcttccgcttcaacagcctgagcaactggaggaagtgcaacaccctggccagcaccagccggggctgccaccaggtgcaggtgaaccacatcgtgaacaagtaccagggcctgggcgtgaaccagtgtgaccgctggagcttcctgcccggcaacttccacttctacagcaccttcaacaacaagaggactggaggcctgagcagcaccaagagcaaggagatctggaggatcaccagcaagtgcaccgtgtggaatgatgccttcagccggcagctgctgatcaaggaggtgacagctgtgcccagcctgtctgtgctgcaccccctgagccctgccagcatccgggccatccggaacttccacaccagcccccgcttccaggccgcccctgtgcccctgctgctgatgatcctgaagcctgtgcagaagctgtttgccatcatcgtgggccggggcatcaggaagtggtggcaggccctgccccccaacaagaaggaggtggtgaaggagaacatcaggaagaacaagtggaagctgttcctgggcctgagcagctttggcctgctgtttgtggtgttctacttcacccacctggaggtgagccccatcaccggccgcagcaagctgctgctgctgggcaaggagcagttccggctgctgtctgagctggagtatgaggcctggatggaggagttcaagaatgacatgctgacagaatag

SEQ ID NO: 36663 - DNA, 987 bp, Artificial Sequence
  Description of Artificial Sequence: Synthetic coding sequence
tgactgtttgccatcatcgtgggccggggcatcaggaagtggtggcaggccctgccccccaacaagaaggaggtggtgaaggagaacatcaggaagaacaagtggaagctgttcctgggcctgagcagctttggcctgctgtttgtggtgttctacttcacccacctggaggtgagccccatcaccggccgcagcaagctgctgctgctgggcaaggagcagttccggctgctgtctgagctggagtatgaggcctggatggaggagttcaagaatgacatgctgacagagaaggatgcccgctacctggccgtgaaggaggtgctgtgccacctgattgagtgcaacaaggatgtgcccggcatcagccagatcaactgggtgatccacgtggtggacagccccatcatcaatgcctttgtgctgcccaacggccagatgtttgtgttcaccggcttcctgaacagcgtgacagacatccaccagctgtccttcctgctgggccatgaaattgcccatgctgtgctgggccatgctgctgagaaggccggcatggtgcacctgctggacttcctgggcatgatcttcctgaccatgatctgggccatctgcccccgggacagcctggccctgctgtgccagtggatccagagcaagctgcaggagtacatgttcaaccggccctacagcaggaagctggaggccgaggccgacaagattggcctgctgctggccgccaaggcctgtgccgacatccgggccagcagcgtcttctggcagcagatggagtttgtggacagcctgcacggccagcccaagatgcctgagtggctgagcacccaccccagccacggcaacagagtggagtacctggacaggctcatcccccagctggtgcgggaggagaagttcatcgagcagcctgagcagattgctgagctgaccctgaacagcttcatccagaacacagagatctgccgctcctag

SEQ ID NO: 36664 - DNA, 762 bp, Artificial Sequence
  Description of Artificial Sequence: Synthetic coding sequence
atgtccttcatctgtggcctgcagagcgctgccaggaaccacgtgttcttccgcttcaacagcctgagcaactggaggaagtgcaacaccctggccagcaccagccggggctgccaccaggtgcaggtgaaccacatcgtgaacaagtaccagggcctgggcgtgaaccagtgtgaccgctggagcttcctgcccggcaacttccacttctacagcaccttcaacaacaagaggactggaggcctgagcagcaccaagagcaaggagatctggaggatcaccagcaagtgcaccgtgtggaatgatgccttcagccggcagctgctgatcaaggaggtgacagctgtgcccagcctgtctgtgctgcaccccctgagccctgccagcatccgggccatccggaacttccacaccagcccccgcttccaggccgcccctgtgcccctgctgctgatgatcctgaagcctgtgcagaagctgtttgccatcatcgtgggccggggcatcaggaagtggtggcaggccctgccccccaacaagaaggaggtggtgaaggagaacatcaggaagaacaagtggaagctgttcctgggcctgagcagctttggcctgctgtttgtggtgttctacttcacccacctggaggtgagccccatcaccggccgcagcaagctgctgctgctgggcaaggagcagttccggctgctgtctgagctggagtatgaggcctggatggaggagttcaagaatgacatgctgtag

SEQ ID NO: 36665 - DNA, 555 bp, Artificial Sequence
  Description of Artificial Sequence: Synthetic coding sequence
atgtccttcatctgtggcctgcagagcgctgccaggaaccacgtgttcttccgcttcaacagcctgagcaactggaggaagtgcaacaccctggccagcaccagccggggctgccaccaggtgcaggtgaaccacatcgtgaacaagtaccagggcctgggcgtgaaccagtgtgaccgctggagcttcctgcccggcaacttccacttctacagcaccttcaacaacaagaggactggaggcctgagcagcaccaagagcaaggagatctggaggatcaccagcaagtgcaccgtgtggaatgatgccttcagccggcagctgctgatcaaggaggtgacagctgtgcccagcctgtctgtgctgcaccccctgagccctgccagcatccgggccatccggaacttccacaccagcccccgcttccaggccgcccctgtgcccctgctgctgatgatcctgaagcctgtgcagaagctgtttgccatcatcgtgggccggggcatcaggaagtggtggcaggccctgccccccaacaagaaggaggtggtgtag

SEQ ID NO: 36666 - DNA, 981 bp, Artificial Sequence
  Description of Artificial Sequence: Synthetic coding sequence
atgtccttcatctgtggcctgcagagcgctgccaggaaccacgtgttcttccgcttcaacagcctgagcaactggaggaagtgcaacaccctggccagcaccagccggggctgccaccaggtgcaggtgaaccacatcgtgaacaagtaccagggcctgggcgtgaaccagtgtgaccgctggagcttcctgcccggcaacttccacttctacagcaccttcaacaacaagaggactggaggcctgagcagcaccaagagcaaggagatctggaggatcaccagcaagtgcaccgtgtggaatgatgccttcagccggcagctgctgatcaaggaggtgacagctgtgcccagcctgtctgtgctgcaccccctgagccctgccagcatccgggccatccggaacttccacaccagcccccgcttccaggccgcccctgtgcccctgctgctgatgatcctgaagcctgtgcagaagctgtttgccatcatcgtgggccggggcatcaggaagtggtggcaggccctgccccccaacaagaaggaggtggtgaaggagaacatcaggaagaacaagtggaagctgttcctgggcctgagcagctttggcctgctgtttgtggtgttctacttcacccacctggaggtgagccccatcaccggccgcagcaagctgctgctgctgggcaaggagcagttccggctgctgtctgagctggagtatgaggcctggatggaggagttcaagaatgacatgctgacagagaaggatgcccgctacctggccgtgaaggaggtgctgtgccacctgattgagtgcaacaaggatgtgcccggcatcagccagatcaactgggtgatccacgtggtggacagccccatcatcaatgcctttgtgctgcccaacggccagatgtttgtgttcaccggcttcctgaacagcgtgacagacatccaccagctgtccttcctgctgggctag

SEQ ID NO: 36667 - DNA, 1086 bp, Artificial Sequence
  Description of Artificial Sequence: Synthetic coding sequence
atgagcccagaatgtgcccgggctgctggagatgcccccctgcggagcctggagcaggccaacagaacccgcttccccttcttcagtgatgtgaagggggaccaccggctggtgctggccgctgtggagaccaccgtgctggtgctgatctttgctgtgtccctgctgggcaatgtgtgtgccctggtgctggtggccaggagaagaagaagaggagccacagcctgcctggtgctgaacctcttctgtgccgacctgctcttcatcagcgccatccccctggtgctggccgtgcgctggacagaggcctggctgctgggccctgtggcctgccacctgctcttctacgtgatgaccctgagcggctctgtgaccatcctgaccctggccgctgtgtccctggagaggatggtgtgcatcgtgcacctgcagaggggcgtgcggggccctggccggcgggcccgggctgtgctgctggccctgatctggggctacagcgctgtggccgccctgcccctgtgtgtgttcttccgggtggtgccccagaggctgcctggagctgaccaggagatcagcatctgcaccctcatctggcccaccatccctggagagatctcctgggatgtgtcctttgtgaccctgaacttcctggtgcccggcctggtgattgtcatctcctacagcaagatcctgcagatcaccaaggccagcaggaagaggctgactgtgtccctggcctacagcgagagccaccagatccgggtgtcccagcaggacttccgcctcttccgcaccctcttcctgctgatggtgtccttcttcatcatgtggagccccatcatcatcaccatcctgctgatcctgatccagaacttcaagcaggacctggtgatctggcccagcctcttcttctgggtggtggccttcacctttgccaacagcgccctgaaccccatcctgtacaacatgaccctgtgcagaaatgagtggaagaagatcttctgctgcttctggttccctgagaagggggccatcctgacagacacctctgtgaagagaaatgacctgagcatcatcagcggctag

SEQ ID NO: 36668 - DNA, 1134 bp, Artificial Sequence
  Description of Artificial Sequence: Synthetic coding sequence
atgagcccagaatgtgcccgggctgctggagatgcccccctgcggagcctggagcaggccaacagaacccgcttccccttcttcagtgatgtgaagggggaccaccggctggtgctggccgctgtggagaccaccgtgctggtgctgatctttgctgtgtccctgctgggcaatgtgtgtgccctggtgctggtggccaggagaagaagaagaggagccacagcctgcctggtgctgaacctcttctgtgccgacctgctcttcatcagcgccatccccctggtgctggccgtgcgctggacagaggcctggctgctgggccctgtggcctgccacctgctcttctacgtgatgaccctgagcggctctgtgaccatcctgaccctggccgctgtgtccctggagaggatggtgtgcatcgtgcacctgcagaggggcgtgcggggccctggccggcgggcccgggctgtgctgctggccctgatctggggctacagcgctgtggccgccctgcccctgtgtgtgttcttccgggtggtgccccagaggctgcctggagctgaccaggagatcagcatctgcaccctcatctggcccaccatccctggagagatctcctgggatgtgtcctttgtgaccctgaacttcctggtgcccggcctggtgattgtcatctcctacagcaagatcctgcagaccagcgagcacctgctggatgcccgggctgtggtgacccacagcgagatcaccaaggccagcaggaagaggctgactgtgtccctggcctacagcgagagccaccagatccgggtgtcccagcaggacttccgcctcttccgcaccctcttcctgctgatggtgtccttcttcatcatgtggagccccatcatcatcaccatcctgctgatcctgatccagaacttcaagcaggacctggtgatctggcccagcctcttcttctgggtggtggccttcacctttgccaacagcgccctgaaccccatcctgtacaacatgaccctgtgcagaaatgagtggaagaagatcttctgctgcttctggttccctgagaagggggccatcctgacagacacctctgtgaagagaaatgacctgagcatcatcagcggctag

SEQ ID NO: 36669 - DNA, 1113 bp, Artificial Sequence
  Description of Artificial Sequence: Synthetic coding sequence
atggagcccctcttccctgcccccttctgggaggtgatctacggcagccacctgcagggcaacctgagcctgctgagccccaaccacagcctgctgcccccccacctgctgctgaatgccagccacggggccttcctgcccctgggcctgaaggtgaccatcgtgggcctgtacctggccgtgtgtgtgggcggcctgctgggcaactgcctggtgatgtatgtgatcctgcggcacaccaagatgaagacagccaccaacatctacatcttcaacctggccctggccgacaccctggtgctgctgaccctgcccttccagggcacagacatcctgctgggcttctggccctttggaaatgccctgtgcaagacagtgattgccatcgactactacaacatgttcaccagcaccttcaccctgacagccatgtctgtggacagatatgtggccatctgccaccccatccgggccctggatgtgaggaccagcagcaaggcccaggccgtgaatgtggccatctgggccctggcctctgtggtgggcgtgcctgtggccatcatgggcagcgcccaggtggaggatgaggagattgaatgtctggtggagatccccaccccccaggactactggggccctgtgtttgccatctgcatcttcctgttctccttcatcgtgcctgtgctggtgatctctgtgtgctacagcctgatgatccggcggctgcggggcgtgcggctgctgagcggcagccgggagaaggacaggaacctgcggcgcatcacccggctggtgctggtggtggtggccgtgtttgtgggctgctggacccctgtgcaggtgtttgtgctggcccagggcctgggcgtgcagcccagcagcgagacagctgtggccatcctgcgcttctgcacagccctgggctacgtgaacagctgcctgaaccccatcctgtatgccttcctggatgagaacttcaaggcctgcttcaggaagttctgctgtgccagcgccctgcggagagatgtgcaggtgtctgacagagtgcgcagcatcgccaaggatgtggccctggcctgcaagaccagcgagaccgtgcccaggcctgcctag

SEQ ID NO: 36670 - DNA, 1113 bp, Artificial Sequence; identical to SEQ ID NO: 36669
  Description of Artificial Sequence: Synthetic coding sequence

SEQ ID NO: 36671 - DNA, 1113 bp, Artificial Sequence; identical to SEQ ID NO: 36669
  Description of Artificial Sequence: Synthetic coding sequence

SEQ ID NO: 36672 - DNA, 495 bp, Artificial Sequence
  Description of Artificial Sequence: Synthetic coding sequence
atcaccggcctgtggagcctggccatcatctcctgggagcgctggctggtggtgtgcaagccctttggaaatgtgcgctttgatgccaagctggccatcgtgggcatcgccttctcctggatctggagcgctgtgtggacagccccacccatcttcggctggagccgctactggccccacggcctgaagaccagctgtggcccagatgtgttcagcggcagcagctacccaggagtgcagagctacatgattgtgctgatggtgacctgctgcatcatccccctggccatcatcatgctgtgctacctgcaggtgtggctggccatccgggctgtggccaagcagcagaaggagagcgagagcacccagaaggccgagaaggagttcaggaactgcatcctgcagctgtttgggaagaaggtggatgatggcagcgagctgagcagcgccagcaagacagaggtgtcctctgtgtcctctgtgtccccagcctag

SEQ ID NO: 36673 - DNA, 1095 bp, Artificial Sequence
  Description of Artificial Sequence: Synthetic coding sequence
atggcccagcagtggagcctgcagaggctggccggccgccacccccaggacagctatgaggacagcacccagagcagcatcttcacctacaccaacagcaacagcacccggggcccctttgagggccccaactaccacatcgccccccgctgggtgtaccacctgacctctgtgtggatgatctttgtggtgattgcctctgtgttcaccaacggcctggtgctggccgccaccatgaagttcaagaagctgcggcaccccctgaactggatcctggtgaacctggccgtggccgacctggccgagaccgtgattgccagcaccatctctgtggtgaaccaggtgtatggctactttgtgctgggccaccccatgtgtgtgctggagggctacacagtgtccctgtgtggcatcaccggcctgtggagcctggccatcatctcctgggagcgctggatggtggtgtgcaagccctttggaaatgtgcgctttgatgccaagctggccatcgtgggcatcgccttctcctggatctgggccgctgtgtggacagccccacccatcttcggctggagccgctactggccccacggcctgaagaccagctgtggcccagatgtgttttctggcagcagctacccaggagtgcagagctacatgattgtgctgatggtgacctgctgcatcacccccctgagcatcatcgtgctgtgctacctgcaggtgtggctggccatccgggctgtggccaagcagcagaaggagagcgagagcacccagaaggccgagaaggaggtgaccaggatggtggtggtgatggtgctggccttctgcttctgctggggcccctatgccttctttgcctgctttgctgctgccaaccctggctaccccttccaccccctgatggccgccctgcctgccttctttgccaagagcgccaccatctacaaccctgtgatctacgtgttcatgaaccggcagttcaggaactgcatcctgcagctgtttgggaagaaggtggatgatggcagcgagctgagcagcgccagcaagacagaggtgtcctctgtgtcctctgtgtccccagcctag

SEQ ID NO: 36674 - DNA, 1437 bp, Artificial Sequence
  Description of Artificial Sequence: Synthetic coding sequence
atgaaccccccatctggcccccgggtgccccccagccccacccaggagcccagctgcatggccaccccagcccctccttcctggtgggacagcagccagagcagcatcagcagcctgggccgcctgcccagcatcagccccacagcccctggcacctgggccgccgcctgggtgcccctgcccaccgtggatgtgcctgaccacgcccactacaccctgggcaccgtcatcctgctggtgggcctgaccggcatgctgggcaacctgaccgtcatctacaccttctgccgcagccgcagcctgcggaccccagccaacatgttcatcatcaacctggccgtgtctgacttcctgatgtccttcacccaggcccctgtgttcttcaccagcagcctgtacaagcagtggctgtttggagaaacaggctgtgagttctacgccttctgtggggccctgtttggcatcagctccatgatcaccctgacagccatcgccctggaccgctacctggtgatcacccggcccctggccacctttggagtggccagcaagagaagagctgcctttgtgctgctgggcgtgtggctgtatgccctggcctggagcctgccccccttcttcggctggagcgcctacgtgcctgagggcctgctgaccagctgctcctgggactacatgtccttcaccccagctgtgcgggcctacaccatgctgctgtgctgctttgtgttcttcctgcccctgctgatcatcatctactgctacatcttcatcttccgggccatccgggagaccggccgggccctgcagaccttcggggcctgcaagggaaatggagagagcctgtggcagaggcagaggctgcagagcgagtgcaagatggccaagatcatgctgctggtgatcctgctgtttgtgctgtcctgggccccctacagcgctgtggccctggtggcctttgctggctacgcccacgtgctgaccccctacatgagctctgtgcctgctgtgattgccaaggccagcgccatccacaaccccatcatctatgccatcacccaccccaagtacagagtggccatcgcccagcacctgccctgcctgggcgtgctgctgggcgtgagccgccgccacagccggccctaccccagctaccgcagcacccacaggagcaccctgaccagccacaccagcaacctgtcctggatcagcatcagaagacggcaggagagcctgggcagcgagagcgaggtgggctggacccacatggaggccgctgctgtgtggggcgccgcccagcaggccaacggccgcagcctgtatggccagggcctggaggacctggaggccaaggccccaccccggccccagggccatgaagctgagacccctgggaagaccaagggcctcatccccagccaggaccccaggatgtag

SEQ ID NO: 36675 - DNA, 1470 bp, Artificial Sequence
  Description of Artificial Sequence: Synthetic coding sequence
atgaaccccccatctggcccccgggtgccccccagccccacccaggagcccagctgcatggccaccccagcccctccttcctggtgggacagcagccagagcagcatcagcagcctgggccgcctgcccagcatcagccccacagcccctggcacctgggccgccgcctgggtgcccctgcccaccgtggatgtgcctgaccacgcccactacaccctgggcaccgtcatcctgctggtgggcctgaccggcatgctgggcaacctgaccgtcatctacaccttctgcagagctgtgctgcggggcgtgacagtgatgatgcagagccgcagcctgcggaccccagccaacatgttcatcatcaacctggccgtgtctgacttcctgatgtccttcacccaggcccctgtgttcttcaccagcagcctgtacaagcagtggctgtttggagagaccggctgtgagttctacgccttctgtggggccctgtttggcatcagctccatgatcaccctgacagccatcgccctggaccgctacctggtgatcacccggcccctggccaccttcggcgtggccagcaagaggcgggccgcctttgtgctgctgggcgtgtggctgtatgccctggcctggagcctgccccccttcttcggctggagcgcctacgtgcctgagggcctgctgaccagctgctcctgggactacatgtccttcaccccagctgtgcgggcctacaccatgctgctgtgctgctttgtgttcttcctgcccctgctgatcatcatctactgctacatcttcatcttccgggccatccgggagaccggccgggccctgcagacctttggagcctgcaagggaaatggagagagcctgtggcagaggcagaggctgcagagcgagtgcaagatggccaagatcatgctgctggtgatcctgctgtttgtgctgtcctgggccccctacagcgctgtggccctggtggcctttgctggctacgcccacgtgctgaccccctacatgagctctgtgcctgctgtgattgccaaggccagcgccatccacaaccccatcatctatgccatcacccaccccaagtacagagtggccatcgcccagcacctgccctgcctgggcgtgctgctgggcgtgtccagaagacacagccggccctaccccagctaccgcagcacccacaggagcaccctgaccagccacaccagcaacctgtcctggatcagcatcagaagacggcaggagagcctgggcagcgagagcgaggtgggctggacccacatggaggccgctgctgtgtggggcgccgcccagcaggccaacggccgcagcctgtatggccagggcctggaggacctggaggccaaggccccaccccggccccagggccacgaggccgagaccccaggcaagaccaagggcctcatccccagccaggaccccaggatgtag

SEQ ID NO: 36676 - DNA, 1488 bp, Artificial Sequence
  Description of Artificial Sequence: Synthetic coding sequence
atgaaccccccatctggcccccgggtgccccccagccccacccaggagcccagctgcatggccaccccagcccctccttcctggtgggacagcagccagagcagcatcagcagcctgggccgcctgcccagcatcagccccacagcccctggcacctgggccgccgcctgggtgcccctgcccaccgtggatgtgcctgaccacgcccactacaccctgggcaccgtcatcctgctggtgggcctgaccggcatgctgggcaacctgaccgtcatctacaccttctgcagagctgtgctgcggggcgtgacagtgatgatgcagagccgcagcctgcggaccccagccaacatgttcatcatcaacctggccgtgtctgacttcctgatgtccttcacccaggcccctgtgttcttcaccagcagcctgtacaagcagtggctgtttggagagaccggctgtgagttctacgccttctgtggggccctgtttggcatcagctccatgatcaccctgacagccatcgccctggaccgctacctggtgatcacccggcccctggccaccttcggcgtggccagcaagaggcgggccgcctttgtgctgctgggcgtgtggctgtatgccctggcctggagcctgccccccttcttcggctggagcgcctacgtgcctgagggcctgctgaccagctgctcctgggactacatgtccttcaccccagctgtgcgggcctacaccatgctgctgtgctgctttgtgttcttcctgcccctgctgatcatcatctactgctacatcttcatcttccgggccatccgggagaccggccgggccctgcagacctttggagcctgcaagggaaatggagagagcctgtggcagaggcagaggctgcagagcgagtgcaagatggccaagatcatgctgctggtgatcctgctgtttgtgctgtcctgggccccctacagcgctgtggccctggtggcctttgctggctacgcccacgtgctgaccccctacatgagctctgtgcctgctgtgattgccaaggccagcgccatccacaaccccatcatctatgccatcacccaccccaagtacagagtggccatcgcccagcacctgccctgcctgggcgtgctgctgggcgtgtccagaagacacagccggccctaccccagctaccgcagcacccacaggagcaccctgaccagccacaccagcaacctgtcctggatcagcatcagaagacggcaggagagcctgggcagcgagagcgaggtgggctggacccacatggaggccgctgctgtgtggggcgccgcccagcaggccaacggccgcagcctgtatggccagggcctggaggacctggaggccaaggccccaccccggccccagggccacgaggccgagaccccaggcaagaggcgggccagcagcggccgcagccagaggcctgagcggcagagagctgccccctag

SEQ ID NO: 36677 - DNA, 1065 bp, Artificial Sequence
  Description of Artificial Sequence: Synthetic coding sequence
atggccctgaaccacacagccctgccccaggatgagcggctgccccactacctgagagatggagacccctttgccagcaagctgtcctgggaggccgacctggtggccggcttctacctgaccatcatcggcatcctgagcacctttggaaatggctacgtgctgtacatgagcagcaggaggaagaagaagctgcggcctgctgagatcatgaccatcaacctggccgtgtgtgacctgggcatctctgtggtgggcaagcccttcaccatcatcagctgcttctgccaccgctgggtgtttggctggattggctgccgctggtacggctgggccggcttcttcttcggctgcggcagcctcatcaccatgacagctgtgtccctggaccgctacctgaagatctgctacctgtcctatggagtgtggctgaagaggaagcacgcctacatctgcctggccgccatctgggcctatgccagcttctggaccaccatgcccctggtgggcctgggggactatgtgcctgagcccttcggcaccagctgcaccctggactggtggctggcccaggcctctgtgggcggccaggtgttcatcctgaacatcctcttcttctgcctgctgctgcccacagctgtgattgtgttctcctatgtgaagatcatcgccaaggtgaagagcagcagcaaggaggtggcccactttgacagccgcatccacagcagccacgtgctggagatgaagctgaccaaggtggccatgctgatctgtgccggcttcctgattgcctggatcccctatgctgtggtgtctgtgtggagcgccttcggccgcccagacagcatccccatccagctgtctgtggtgcccaccctgctggccaagtctgctgccatgtacaaccccatcatctaccaggtgattgactacaagtttgcctgctgccagacaggaggcctgaaggccaccaagaagaagagcctggagggcttccggctgcacacagtgaccaccgtgaggaagagcagcgctgtgctggagatccacgaggagtgggagtag

SEQ ID NO: 36678 - DNA, 1140 bp, Artificial Sequence
  Description of Artificial Sequence: Synthetic coding sequence
atgtctgtgaggaccctgcccctgctcttcctgaacctgggcggggagatgctgtacatcctggaccagaggctgcgggcccagaacatccctggggacaaggccaggaaggtgctgaatgacatcatcagcaccatgttcaacaggaagttcatggaggagctgttcaagccccaggagctgtacagcaagaaggccctgaggacagtgtatgagcggctggcccacgccagcatcatgaagctgaaccaggcctccatggacaagctgtatgacctgatgaccatggccttcaagtaccaggtgctgctgtgcccccggcccaaggatgtgctgctggtgaccttcaaccacctggacaccatcaagggcttcatccgggacagccccaccatcctgcagcaggtggatgagaccctgcggcagctgacagagatctatggaggcctgtctgctggggagttccagctgatccggcagaccctgctgatcttcttccaggacctgcacatccgggtgtccatgttcctgaaggacaaggtgcagaacaacaacggccgctttgtgctgcctgtgtctggccctgtgccctggggcacagaggtgcccggcctcatccgcatgttcaacaacaagggggaggaggtgaagagaattgagttcaagcatggaggcaactacgtgcctgcccccaaggagggcagctttgagctgtatggagacagagtgctgaagctgggcaccaacatgtacagcgtgaaccagcctgtggagacccacgtgtctggcagcagcaagaacctggcctcctggacccaggagagcatcgcccccaaccccctggccaaggaggagctgaacttcctggcccggctgatgggcggcatggagatcaagaagcccagcggccctgagcccggcttccggctgaacctcttcaccacagatgaggaggaggagcaggccgccctgaccaggcctgaggagctgtcctatgaggtgatcaacatccaggccacccaggaccagcagaggtctgaggagctggcccgcatcatgggagaatttgagatcacagagcagccccggctgagcaccagcaaaggagatgacctgctggccatgatggatgagctgtag

SEQ ID NO: 36679 - DNA, 1020 bp, Artificial Sequence
  Description of Artificial Sequence: Synthetic coding sequence
atgtctgtgaggaccctgcccctgctcttcctgaacctgggcggggagatgctgtacatcctggaccagaggctgcgggcccagaacatccctggggacaaggccaggaaggatgagtggacagaggtggacaggaagagggtgctgaatgacatcatcagcaccatgttcaacaggaagttcatggaggagctgttcaagccccaggagctgtacagcaagaaggccctgaggacagtgtatgagcggctggcccacgccagcatcatgaagctgaaccaggcctccatggacaagctgtatgacctgatgaccatggccttcaagtaccaggtgctgctgtgcccccggcccaaggatgtgctgctggtgaccttcaaccacctggacaccatcaagggcttcatccgggacagccccaccatcctgcagcaggtggatgagaccctgcggcagctgacagagatctatggaggcctgtctgctggggagttccagctgatccggcagaccctgctgatcttcttccaggacctgcacatccgggtgtccatgttcctgaaggacaaggtgcagaacaacaacggccgctttgtgctgcctgtgtctggccctgtgccctggggcacagaggtgcccggcctcatccgcatgttcaacaacaagggggaggaggtgaagagaattgagttcaagcatggaggcaactacgtgcctgcccccaaggagggcagctttgagctgtatggagacagagtgctgaagctgggcaccaacatgtacagcgtgaaccagcctgtggagacccacgtgtctggcagcagcaagaacctggcctcctggacccaggagagcatcgcccccaaccccctggccaaggaggagctgaacttcctggcccggctgatgggcggcatggagatcaagaagcccagcggccctgagcccggcttccggctgaacctcttcaccacagatgaggagggagatgacctgctggccatgatggatgagctgtag

SEQ ID NO: 36680 - DNA, 672 bp, Artificial Sequence
  Description of Artificial Sequence: Synthetic coding sequence
atgtctgtgaggaccctgcccctgctcttcctgaacctgggcggggagatgctgtacatcctggaccagaggctgcgggcccagaacatccctggggacaaggccaggaaggtgctgaatgacatcatcagcaccatgttcaacaggaagttcatggaggagctgttcaagccccaggagctgtacagcaagaaggccctgaggacagtgtatgagcggctggcccacgccagcatcatgaagctgaaccaggcctccatggacaagctgtatgacctgatgaccatggccttcaagtaccaggtgctgctgtgcccccggcccaaggatgtgctgctggtgaccttcaaccacctggacaccatcaagggcttcatccgggacagccccaccatcctgcagcaggtggatgagaccctgcggcagctgacagagatctatggaggcctgtctgctggggagttccagctgatccggcagaccctgctgatcttcttccaggacctgcacatccggcgggagtgcttctggaagcacatgcaggagaccgtgcacagcgcccagtgctgcctgcccggggtgggcaactacatggaggacagaagaagaaggctgaccttccactacgtgtacccctttgagaactttgagttctgcacctgggccaagtag

SEQ ID NO: 36681 - DNA, 1170 bp, Artificial Sequence
  Description of Artificial Sequence: Synthetic coding sequence
atgtctgtgaggaccctgcccctgctcttcctgaacctgggcggggagatgctgtacatcctggaccagaggctgcgggcccagaacatccctggggacaaggccaggaaggatgagtggacagaggtggacaggaagagggtgctgaatgacatcatcagcaccatgttcaacaggaagttcatggaggagctgttcaagccccaggagctgtacagcaagaaggccctgaggacagtgtatgagcggctggcccacgccagcatcatgaagctgaaccaggcctccatggacaagctgtatgacctgatgaccatggccttcaagtaccaggtgctgctgtgcccccggcccaaggatgtgctgctggtgaccttcaaccacctggacaccatcaagggcttcatccgggacagccccaccatcctgcagcaggtggatgagaccctgcggcagctgacagagatctatggaggcctgtctgctggggagttccagctgatccggcagaccctgctgatcttcttccaggacctgcacatccgggtgtccatgttcctgaaggacaaggtgcagaacaacaacggccgctttgtgctgcctgtgtctggccctgtgccctggggcacagaggtgcccggcctcatccgcatgttcaacaacaagggggaggaggtgaagagaattgagttcaagcatggaggcaactacgtgcctgcccccaaggagggcagctttgagctgtatggagacagagtgctgaagctgggcaccaacatgtacagcgtgaaccagcctgtggagacccacgtgtctggcagcagcaagaacctggcctcctggacccaggagagcatcgcccccaaccccctggccaaggaggagctgaacttcctggcccggctgatgggcggcatggagatcaagaagcccagcggccctgagcccggcttccggctgaacctcttcaccacagatgaggaggaggagcaggccgccctgaccaggcctgaggagctgtcctatgaggtgatcaacatccaggccacccaggaccagcagaggtctgaggagctggcccgcatcatgggagaatttgagatcacagagcagccccggctgagcaccagcaaaggagatgacctgctggccatgatggatgagctgtag

SEQ ID NO: 36682 - DNA, 1023 bp, Artificial Sequence
  Description of Artificial Sequence: Synthetic coding sequence
atggagcccggccgcacccagatcaagctggacccccgctacacagctgacctgctggaggtgctgaagaccaactacggcatccccagcgcctgcttcagccagcccccaacagctgcccagctgctgcgggccctgggccctgtggagctggccctgaccagcatcctgaccctgctggccctgggcagcatcgccatcttcctggaggatgctgtgtacctgtacaagaacaccctgtgccccatcaagaggaggaccctgctgtggaagagcagcgcccccaccgtggtgtctgtgctgtgctgcttcggcctgtggatccccaggagcctggtgctggtggagatgaccatcaccagcttctatgctgtgtgcttctacctgctgatgctggtgatggtggagggctttggaggcaaggaggccgtgctgcggaccctgcgggacacccccatgatggtgcacacaggcccctgctgctgctgctgcccctgctgcccccggctgctgctgaccaggaagaagctgcagctgctgatgctgggccccttccagtatgccttcctgaagatcaccctgaccctggtgggcctcttcctggtgcctgatggcatctatgaccctgctgacatcagcgagggcagcacagccctgtggatcaacaccttcctgggcgtgtccaccctgctggccctgtggaccctgggcatcatcagccggcaggcccggctgcacctgggggagcagaacatgggcgccaagtttgccctcttccaggtgctgctgatcctgacagccctgcagcccagcatcttctctgtgctggccaacggcggccagatcgcctgcagccccccctacagcagcaagaccaggagccaggtgatgaactgccacctgctgatcctggagaccttcctgatgacagtgctgaccaggatgtactacagaaggaaggaccacaaggtgggctatgagaccttcagcagcccagacctggacctgaacctgaaggcctag

SEQ ID NO: 36683 - DNA, 387 bp, Artificial Sequence
  Description of Artificial Sequence: Synthetic coding sequence
atggagcacagcgagggcgcccctggggaccctgctggcaccgtggtgccccaggagctgctggaggagatgctgtggttcttccgggtggaggatgccagcccctggaaccacagcatcctggccctggccgctgtggtggtgatcatctccatggtgctgctgggccgcagcatccaggccagcaggaaggagaagatgcagcccccagagaaggagaccccagaggtgctgcacctggatgaggccaaggaccacaacagcctgaacaacctgcgggagaccctgctgtctgagaagcccaacctggcccaggtggagctggagctgaaggagagagatgtgctgtctgtgttcctgcctgatgtgcctgagacagagagctag

SEQ ID NO: 36684 - DNA, 1245 bp, Artificial Sequence
  Description of Artificial Sequence: Synthetic coding sequence
atgctgatcctgaccaagacagctggggtcttcttcaagcccagcaagaggaaggtgtatgagttcctgcgctccttcaacttccaccctggcaccctcttcctgcacaagatcgtgctgggcatcgagaccagctgtgatgacacagctgctgctgtggtggatgaaacaggaaatgtgctgggggaggccatccacagccagacagaggtgcacctgaagacaggaggcatcgtgcccccagctgcccagcagctgcaccgggagaacatccagagaattgtgcaggaggccctgagcgccagcggcgtgagccccagcgacctgagcgccatcgccaccaccatcaagccaggcctggccctgagcctgggcgtgggcctgtccttcagcctgcagctggtgggccagctgaagaagcccttcatccccatccaccacatggaggcccacgccctgaccatccggctgaccaacaaggtggagttccccttcctggtgctgctgatcagcggcggccactgcctgctggccctggtgcagggcgtgtctgacttcctgctgctgggcaagagcctggacatcgcccctggggacatgctggacaaggtggcccggcggctgagcctcatcaagcacccagaatgttccaccatgtctgggggcaaggccatcgagcacctggccaagcagggcaaccgcttccactttgacatcaagccacccctgcaccacgccaagaactgtgacttctccttcaccggcctgcagcacgtgacagacaagatcatcatgaagaaggagaaggaggagggcatcgagaagggccagatcctgagcagcgctgctgacattgctgccaccgtgcagcacaccatggcctgccacctggtgaagaggacccaccgggccatcctcttctgcaagcagagggacctgctgccccagaacaatgctgtgctggtggccagcggcggcgtggccagcaacttctacatccggcgggccctggagatcctgaccaatgccacccagtgcaccctgctgtgccccccaccccggctgtgcacagacaatggcatcatgattgcctggaatggcatcgagcggctgcgggccggcctgggcatcctgcatgacatcgagggcatccgctatgagcccaagtgccccctgggcgtggacatcagcaaggaggtgggggaggccagcatcaaggtgccccagctgaagatggagatctag

SEQ ID NO: 36685 - DNA, 669 bp, Artificial Sequence
  Description of Artificial Sequence: Synthetic coding sequence
atgctgatcctgaccaagacagctggggtcttcttcaagcccagcaagaggaaggtgtatgagttcctgcgctccttcaacttccaccctggcaccctcttcctgcacaagatcgtgctgggcatcgagaccagctgtgatgacacagctgctgctgtggtggatgaaacaggaaatgtgctgggggaggccatccacagccagacagaggtgcacctgaagacaggaggcatcgtgcccccagctgcccagcagctgcaccgggagaacatccagagaattgtgcaggaggccctgagcgccagcggcgtgagccccagcgacctgagcgccatcgccaccaccatcaagccaggcctggccctgagcctgggcgtgggcctgtccttcagcctgcagctggtgggccagctgaagaagcccttcatccccatccaccacatggaggcccacgccctgaccatccggctgaccaacaaggtggagttccccttcctggtgctgctgatcagcggcggccactgcctgctggccctggtgcagggcgtgtctgacttcctgctgctgggcaagagcctggacatcgcccctggggacatgctggacaaggtggcccggcggctgagcctcatcaagcacccagaatgttccaccatgtctgggggctag

SEQ ID NO: 36686 - DNA, 612 bp, Artificial Sequence
  Description of Artificial Sequence: Synthetic coding sequence
atgctgatcctgaccaagacagctggggtcttcttcaagcccagcaagaggaaggtgtatgagttcctgcgctccttcaacttccaccctggcaccctcttcctgcacaagatcgtgctgggcatcgagaccagctgtgatgacacagctgctgctgtggtggatgaaacaggaaatgtgctgggggaggccatccacagccagacagaggtgcacctgaagacaggaggcatcgtgcccccagctgcccagcagctgcaccgggagaacatccagagaattgtgcaggaggccctgagcgccagcggcgtgagccccagcgacctgagcgccatcgccaccaccatcaagccaggcctggccctgagcctgggcgtgggcctgtccttcagcctgcagctggtgggccagctgaagaagcccttcatccccatccaccacatggaggcccacgccctgaccatccggctgaccaacaaggtggagttccccttcctggtgctgctgatcagcggcggccactgcctgctggccctggtgcagggcgtgtctgacttcctgctgctgggcaagagcctggacatcgcccctggggacatgctggacaagtag

SEQ ID NO: 36687 - DNA, 1245 bp, Artificial Sequence; identical to SEQ ID NO: 36684
  Description of Artificial Sequence: Synthetic coding sequence

SEQ ID NO: 36688 - DNA, 1689 bp, Artificial Sequence
  Description of Artificial Sequence: Synthetic coding sequence
atgtctgaggagctggcccagggccccaaggagagccccccagccccccgggccggcccccgggaggtgtggaagaagggcggccgcctgctgtctgtgctgctggccgtgaatgtgctgctgctggcctgcaccctcatcagcggcggggccttcaacaaggtggccgtgtatgacacagatgtgtttgccctgctgacagccatgatgctgctggccaccctgtggatcctcttctacctgctgaggacagtgcgctgcccctgtgctgtgccctacagagatgcccacgccggccccatctggctgcggggcggcctggtgctgtttggcatctgcaccctcatcatggatgtgttcaagacaggctactacagcagcttctttgagtgccagagcgccatcaagatcctgcaccccctcatccaggccgtgtttgtgatcatccagacctacttcctgtgggtgtctgccaaggactgtgtgcacgtgcacctggacctgacctggtgtggcctgatgttcaccctgaccaccaacctggccatctggatggctgctgtggtggatgagagcgtgcaccagagccacagctacagcagcagccacagcaatgccagccacgcccggctcatcagtgaccagcacgccgacaaccctgtgggcggggacagctgcctgtgcagcacagctgtgtgccagatcttccagcagggctacttctacctgtaccccttcaacatcgagtacagcctgtttgccagcaccatgctgtatgtgatgtggaagaatgtgggccgcttcctggccagcaccccaggccacagccacacccccacccctgtgtccctcttccgggagaccttctttgctggccctgtgctgggcctgctgctgtttgtggtgggcctggccgtgttcatcatctatgaggtgcaggtgtctggagatggcagcaggacccggcaggccctggtgatctactacagcttcaacatcgtgtgcctgggcctgaccaccctggtgtccctgagcggcagcatcatctacagatttgaccggcgggccatggaccaccacaagaaccccaccaggaccctggatgtggccctgctgatgggcgccgccctgggccagtatgccatctcctactacagcatcgtggccgtggtggccggcaccccccaggacctgctggccggcctgaacctgacccacgccctgctgatgattgcccagcacaccttccagaacatgttcatcatcgagagcctgcaccggggccccccaggagctgagccccacagcacccaccccaaggagccctgccaggacctgaccttcaccaacctggatgccctgcacaccctgagcgcctgcccccccaaccctggcctggtgagccccagccccagcgaccagcgggaggccgtggccatcgtgtccacccccaggagccagtggaggcggcagtgcctgaaggacatcagcctcttcctgctgctgtgcaacgtcatcctgtggatcatgcctgcctttggagcccggccccacttcagcaacacagtggaggtggacttctacggctacagcctgtgggccgtcatcgtgaacatctgcctgcccttcggcatcttctacaggatgcatgctgtgagcagcctgctggaggtgtatgtgctgtcctag

SEQ ID NO: 36689 - DNA, 1791 bp, Artificial Sequence
  Description of Artificial Sequence: Synthetic coding sequence
atgggccgcggggcccgggctgctgctgcccagagccgctggggccgggccagccgggcctctgtgtccccaggccgcaccatccgcagcgccccagctgtgggggaggcccaggagacagaggccgcccctgagaaggaaaatagagtggatgtgggcgctgaggagagagctgctgccacccggccccggcagaagtcctggctggtgcgccacttcagcctgctgctgcggcgggaccggcaggcccagaaggccggccagctgttcagcggcctgctggccctgaatgtggtgttcctgggcggggccttcatctgcagcatgatcttcaacaaggtggccgtgaccctgggagatgtgtggatcctgctggccaccctgaaggtgctgagcctgctgtggctgctgtactacgtggccagcaccacccggcggccccatgctgtgctgtaccaggacccccatgctggccccctgtgggtgcggggcagcctggtgctgtttggcagctgcaccttctgcctgaacatcttccgggtgggctatgatgtgagccacatccgctgcaagagccagctggacctggtgttttctgtgattgagatggtgttcatcggcgtgcagacctgggtgctgtggaagcactgcaaggactgtgtgcgggtgcagaccaacttcacccgctgtggcctgatgctgaccctggccaccaacctgctgctgtgggtgctggccgtgaccaatgacagcatgcaccgggagattgaggccgagctgggcatcctgatggagaagagcactggaaatgagaccaacacctgcctgtgcctgaatgccacagcctgtgaggccttcagaagaggcttcctgatgctgtaccccttcagcacagagtactgcctgatctgctgtgctgtgctgtttgtgatgtggaagaatgtgggccgccacgtggccccccacatgggcgcccacccagccacagcccccttccacctgcatggagccatcttcggccccctgctgggcctgctggtgctgctggccggcgtgtgtgtgtttgtgctcttccagatcgaggccagcggccctgccatcgcctgccagtacttcaccctgtactatgccttctacgtggccgtgctgcccaccatgagcctggcctgcctggccggcacagccatccacggcctggaggagcgggagctggacacagtgaagaaccccaccaggagcctggatgtggtgctgctgatgggcgccgccctgggccagatgggcatcgcctacttcagcatcgtggccatcgtggccaagaggcctcatgagctgctgaacagactcatcctggcctacagcctgctgctgatcctgcagcacatcgcccagaacctcttcatcatcgagggcctgcaccggcggcccctgtgggagaccgtgcctgagggcctggccggcaagcaggaggccgagcccccaagaagaggcagcctgctggagctgggccagggcctgcagagggccagcctggcctacatccacagctacagccacctgaactggaagaggcgggccctgaaggagatcagcctcttcctgatcctgtgcaacatcaccctgtggatgatgcctgccttcggcatccaccctgagtttgaaaatggcctggagaaggacttctacggctaccagatctggtttgccatcgtgaactttggcctgcccctgggcgtcttctacaggatgcacagcgtgggcggcctggtggaggtgtacctgggcgcctag

SEQ ID NO: 36690 - DNA, 939 bp, Artificial Sequence
  Description of Artificial Sequence: Synthetic coding sequence
atggcctgtgccgctgtgatgatccctggcctgctgcgctgcagcgtgggcgccatcagaattgaagctgccagcctgcggctgaccctgagcaccctgcggcacctgaccctgaccagcatcatgaagagcaagaggaagacagaccacatggagaggacagcctctgtgctgcggcgggagatcgtgtctgctgccaaggtgtgtggggccgccagcgagagccccagcgtgaagagcctgcggctgctggtggccgaccaggacttctccttcaaggccggccagtgggtggacttcttcatccctggggtgtctgtggtgggcggcttcagcatctgcagcagcccccggctgctggagcaggagagggtcatcgagctggccgtgaagtacaccaaccaccccccagccctgtgggtgcacaacacctgcaccctggactgtgaggtggccgtgcgggtgggcggggagttcttctttgacccccagcctgcagatgccagcaggaacctggtgctgattgctgggggcgtgggcatcaaccccctgctgagcatcctgcggcatgctgctgacctgctgcgggagcaggccaacaagagaaatggctatgaaattggcaccatcaagctgttctacagcgccaagaacaccagcgagctgctcttcaagaagaacatcctggacctggtgaatgagttccctgagaagatcgcctgcagcctgcacgtgaccaagcagaccacccagatcaatgctgagctgaagccctacatcacagagggccgcatcacagagaaggagatccgggaccacatcagcaaggagaccctcttctacatctgtggccccccacccatgacagacttcttcagcaagcagctggagaacaaccacgtgcccaaggagcacatctgctttgagaagtggtggtag

SEQ ID NO: 36691 - DNA, 486 bp, Artificial Sequence
  Description of Artificial Sequence: Synthetic coding sequence
atggcctgtgccgctgtgatgatccctggcctgctgcgctgcagcgtgggcgccatcagaattgaagctgccagcctgcggctgaccctgagcaccctgcggcacctgaccctgaccagcatcatgaagagcaagaggaagacagaccacatggagaggacagcctctgtgctgcggcgggagatcgtgtctgctgccaaggtgtgtggggccgccagcgagagccccagcgtgaagagcctgcggctgctggtggccgaccaggacttctccttcaaggccggccagtgggtggacttcttcatccctggggtgtctgtggtgggcggcttcagcatctgcagcagcccccggctgctggagcaggagagggtcatcgagctggccgtgaagtacaccaaccaccccccagccctgtgggtgcacaacacctgcaccctggactgtgaggtggccgtgcgggtgggcggggagttcttcttctag

SEQ ID NO: 36692 - DNA, 993 bp, Artificial Sequence
  Description of Artificial Sequence: Synthetic coding sequence
atgacccccaagatctcctggaccagcaagttctctgtgtgcccagagagcgccatggcctgtgccgctgtgatgatccctggcctgctgcgctgcagcgtgggcgccatcagaattgaagctgccagcctgcggctgaccctgagcaccctgcggcacctgaccctgaccagcatcatgaagagcaagaggaagacagaccacatggagaggacagcctctgtgctgcggcgggagatcgtgtctgctgccaaggtgtgtggggccgccagcgagagccccagcgtgaagagcctgcggctgctggtggccgaccaggacttctccttcaaggccggccagtgggtggacttcttcatccctggggtgtctgtggtgggcggcttcagcatctgcagcagcccccggctgctggagcaggagagggtcatcgagctggccgtgaagtacaccaaccaccccccagccctgtgggtgcacaacacctgcaccctggactgtgaggtggccgtgcgggtgggcggggagttcttctttgacccccagcctgcagatgccagcaggaacctggtgctgattgctgggggcgtgggcatcaaccccctgctgagcatcctgcggcatgctgctgacctgctgcgggagcaggccaacaagagaaatggctatgaaattggcaccatcaagctgttctacagcgccaagaacaccagcgagctgctcttcaagaagaacatcctggacctggtgaatgagttccctgagaagatcgcctgcagcctgcacgtgaccaagcagaccacccagatcaatgctgagctgaagccctacatcacagagggccgcatcacagagaaggagatccgggaccacatcagcaaggagaccctcttctacatctgtggccccccacccatgacagacttcttcagcaagcagctggagaacaaccacgtgcccaaggagcacatctgctttgagaagtggtggtag

SEQ ID NO: 36693 - DNA, 1272 bp, Artificial Sequence
  Description of Artificial Sequence: Synthetic coding sequence
atgctgtgccaccggggcggccagctgattgtgcccatcatccccctgtgcccagagcacagctgccggggccgccgcctgcagaacctgctgagcggcccctggcccaagcagcccatggagctgcacaacctgagcagccccagccccagcctgagcagctctgtgctgccccccagcttcagccccagccccagcagcgcccccagcgccttcaccaccgtgggcggcagcagcggcggcccctgccaccccaccagcagcagcctggtgtctgccttcctggcccccatcctggccctggagtttgtgctgggcctggtgggcaacagcctggccctcttcatcttctgcatccacacccggccctggaccagcaacacagtgttcctggtgtccctggtggccgctgacttcctgctgatcagcaacctgcccctgcgggtggactactacctgctgcacgagacctggaggtttggagctgctgcctgcaaggtgaacctcttcatgctgagcaccaacagaacagcctctgtggtgttcctgacagccatcgccctgaaccgctacctgaaggtggtgcagccccaccacgtgctgagccgggcctctgtgggcgctgctgcccgggtggccggcggcctgtgggtgggcatcctgctgctgaatggccacctgctgctgagcaccttcagcggccccagctgcctgagctacagagtgggcaccaagcccagcgccagcctgcgctggcaccaggccctgtacctgctggagttcttcctgcccctggccctgatcctgtttgccatcgtgtccatcggcctgaccatccggaacagaggcctgggcggccaggccggcccccagagggccatgagggtgctggccatggtggtggccgtgtacaccatctgcttcctgcccagcatcatcttcggcatggcctccatggtggccttctggctgagcgcctgccgcagcctggacctgtgcacccagctgttccacggcagcctggccttcacctacctgaacagcgtgctggaccctgtgctgtactgcttcagcagccccaacttcctgcaccagagccgggccctgctgggcctgacccggggccggcagggccctgtgtctgatgagagcagctaccagcccagccggcagtggagataccgggaggccagcaggaaggccgaggccatcggcaagctgaaggtgcagggcgaggtgtccctggagaaggagggcagcagccagggctag

SEQ ID NO: 36694 - DNA, 1014 bp, Artificial Sequence
  Description of Artificial Sequence: Synthetic coding sequence
atgaatgagcccctggactacctggccaatgccagtgacttcccagactatgctgctgcctttggaaactgcacagatgagaacatccccctgaagatgcactacctgcctgtgatctacggcatcatcttcctggtgggcttccctggaaatgctgtggtgatcagcacctacatcttcaagatgaggccctggaagagcagcaccatcatcatgctgaacctggcctgcacagacctgctgtacctgaccagcctgcccttcctgatccactactatgccagcggggagaactggatctttggagacttcatgtgcaagttcatccgcttctccttccacttcaacctgtacagcagcatcctcttcctgacctgcttcagcatcttccgctactgtgtgatcatccaccccatgagctgcttcagcatccacaagacccgctgtgctgtggtggcctgtgctgtggtgtggatcatcagcctggtggccgtcatccccatgaccttcctgatcaccagcaccaacagaaccaacagaagtgcctgcctggacctgaccagcagtgatgagctgaacaccatcaagtggtacaacctgatcctgacagccaccaccttctgcctgcccctggtgattgtgaccctgtgctacaccaccatcatccacaccctgacccacggcctgcagacagacagctgcctgaagcagaaggcccggcggctgaccatcctgctgctgctggccttctacgtgtgcttcctgcccttccacatcctgcgggtcatcagaattgagagccggctgctgagcatcagctgcagcattgagaaccagatccacgaggcctacatcgtgtcccggcccctggccgccctgaacaccttcggcaacctgctgctgtatgtggtggtgtctgacaacttccagcaggccgtgtgcagcacagtgcgctgcaaggtgtctggcaacctggagcaggccaagaagatctcctacagcaacaacccctag

SEQ ID NO: 36695 - DNA, 189 bp, Artificial Sequence
  Description of Artificial Sequence: Synthetic coding sequence
atgaatgagcccctggactacctggccaatgccagtgacttcccagactatgctgctgcctttggaaactgcacagatgagaacatccccctgaagatgcactacctgcctgtgatctacggcatcatcttcctggtgggcttccctggaaatgctgtggtgatcagcacctacatcttcaagatgtag

SEQ ID NO: 36696 - DNA, 210 bp, Artificial Sequence
  Description of Artificial Sequence: Synthetic coding sequence
atgaatgagcccctggactacctggccaatgccagtgacttcccagactatgctgctgcctttggaaactgcacagatgagaacatccccctgaagatgcactacctgcctgtgatctacggcatcatcttcctggtgggcttccctggaaatgctgtggtgatcagcacctacatcttcaagatgaggccctggaagagcagcacctag

SEQ ID NO: 36697 - DNA, 1014 bp, Artificial Sequence; identical to SEQ ID NO: 36694
  Description of Artificial Sequence: Synthetic coding sequence

SEQ ID NO: 36698 - DNA, 3033 bp, Artificial Sequence
  Description of Artificial Sequence: Synthetic coding sequence
atgagccagctgcggctgctgcccagccggctgggcgtgcaggccgcccggctgctggccgcccatgatgtgcctgtgtttggctggaggagccgcagcagcggccccccagccaccttccccagcagcaagggcggcggcggcagcagctacatggaggagatgtactttgcctggctggagaacccccagagcgtgcacaagtcctgggacagcttcttccgggaggccagcgaggaggccttcagcggcagcgcccagccccggccccccagcgtggtgcatgagagccgctctgctgtgagcagcaggaccaagaccagcaagctggtggaggaccacctggccgtgcagagcctcatccgggcctaccagatccggggccaccacgtggcccagctggaccccctgggcatcctggatgctgacctggacagctttgtgcccagcgacctgatcaccaccatcgacaagctggccttctatgacctgcaggaggccgacctggacaaggagttccagctgcccaccaccaccttcatcggcggcagcgagaacaccctgagcctgcgggagatcatccggcggctggagaacacctactgccagcacatcggcctggagttcatgttcatcaatgatgtggagcagtgccagtggatccggcagaagtttgagaccccaggagtgatgcagttcagcagcgaggagaagaggaccctgctggcccggctggtgcgctccatgagatttgaggacttcctggccaggaagtggagcagcgagaagagatttggcctggagggctgtgaggtgatgatcccagccctgaagaccatcatcgacaagagcagcgagatgggcattgaaaatgtcatcctgggcatgccccaccggggccgcctgaatgtgctggccaacgtcatcaggaaggacctggagcagatcttctgccagtttgaccccaagctggaggccgcagatgagggcagcggagatgtgaagtaccacctgggcatgtaccacgagcgcatcaacagagtgaccaacagaaacatcaccctgagcctggtggccaaccccagccacctggaggccgtggaccctgtggtgcagggcaagaccaaggccgagcagttctacagaggagatgcccagggcaagaaggtgatgagcatcctggtgcatggagatgctgcctttgctggccagggcgtggtgtatgagaccttccacctgagtgacctgcccagctacaccaccaacggcaccgtgcacgtggtggtgaacaaccagatcggcttcaccacagaccccaggatggcccggagcagcccctaccccacagatgtggcccgggtggtgaatgcccccatcttccacgtgaatgctgatgatcctgaggccgtcatctacgtgtgcagcgtggccgctgagtggaggaacaccttcaacaaggatgtggtggtggacctggtgtgctacagaagaagaggccacaatgagatggatgagcccatgttcacccagcccctgatgtacaagcagatccaccggcaggtgcctgtgctgaagaagtatgctgacaagctgattgctgagggcaccgtgaccctgcaggagtttgaggaggagatcgccaagtatgaccgcatctgtgaggaggcctacggccgcagcaaggacaagaagatcctgcacatcaagcactggctggacagcccctggccaggcttcttcaacgtggatggagagcccaagtccatgacctgcccagccaccggcatccctgaggacatgctgacccacatcggctctgtggccagctctgtgcccctggaggacttcaagatccacacaggcctgagccgcatcctgcggggccgggctgacatgaccaagaacagaacagtggactgggccctggccgagtacatggccttcggcagcctgctgaaggagggcatccacgtgcggctgagcggccaggatgtggagcggggcaccttcagccaccgccaccacgtgctgcatgaccaggaggtggacaggaggacctgtgtgcccatgaaccacctgtggccagaccaggccccctacacagtgtgcaacagcagcctgtctgaatatggagtgctgggctttgagctgggctacgccatggccagccccaatgccctggtgctgtgggaggcccagtttggagacttccacaacacagcccagtgcatcatcgaccagttcatcagcacaggccaggccaagtgggtgcgccacaacggcatcgtgctgctgctgccccacggcatggagggcatgggccctgagcacagcagcgcccggcctgagcgcttcctgcagatgagcaatgatgacagtgatgcctacccagccttcaccaaggactttgaggtgtcccagctgtatgactgcaactggatcgtggtgaactgcagcaccccagccaactacttccacgtgctgcggcggcagatcctgctgcccttcaggaagcccctcatcatcttcacccccaagagcctgctgcggcaccctgaggccaagagcagctttgaccagatggtgtctggcaccagcttccagagggtcatcccagaagatggagctgctgcccgggcccctgagcaggtgcagaggctcatcttctgcaccgggaaggtgtactatgacctggtgaaggagaggagcagccaggacctggaggagaaggtggccatcacccggctggagcagatcagccccttcccctttgacctgatcaagcaggaggccgagaagtacccaggagctgagctggcctggtgccaggaggagcacaagaacatgggctactatgactacatcagcccccgcttcatgaccatcctgcggcgggcccggcccatctggtacgtgggccgggaccctgctgctgccccagccaccggcaacagaaacacccacctggtgtccctgaagaagttcctggacacagccttcaacctgcaggcctttgagggcaagaccttctag

SEQ ID NO: 36699 - DNA, 2862 bp, Artificial Sequence
  Description of Artificial Sequence: Synthetic coding sequence
atgagccagctgcggctgctgcccagccggctgggcgtgcaggccgcccggctgctggccgcccatgatgtgcctgtgtttggctggaggagccgcagcagcggccccccagccaccttccccagcagcaagggcggcggcggcagcagctacatggaggagatgtactttgcctggctggagaacccccagagcgtgcacaagatccggggccaccacgtggcccagctggaccccctgggcatcctggatgctgacctggacagctttgtgcccagcgacctgatcaccaccatcgacaagctggccttctatgacctgcaggaggccgacctggacaaggagttccagctgcccaccaccaccttcatcggcggcagcgagaacaccctgagcctgcgggagatcatccggcggctggagaacacctactgccagcacatcggcctggagttcatgttcatcaatgatgtggagcagtgccagtggatccggcagaagtttgagaccccaggagtgatgcagttcagcagcgaggagaagaggaccctgctggcccggctggtgcgctccatgagatttgaggacttcctggccaggaagtggagcagcgagaagcgcttcggcctggagggctgtgaggtgatgatcccagccctgaagaccatcatcgacaagagcagcgagatgggcattgaaaatgtcatcctgggcatgccccaccggggccgcctgaatgtgctggccaacgtcatcaggaaggacctggagcagatcttctgccagtttgaccccaagctggaggccgcagatgagggcagcggagatgtgaagtaccacctgggcatgtaccacgagcgcatcaacagagtgaccaacagaaacatcaccctgagcctggtggccaaccccagccacctggaggccgtggaccctgtggtgcagggcaagaccaaggccgagcagttctacagaggagatgcccagggcaagaaggtgatgagcatcctggtgcatggagatgctgcctttgctggccagggcgtggtgtatgagaccttccacctgagtgacctgcccagctacaccaccaatggaacagtgcacgtggtggtgaacaaccagatcggcttcaccacagaccccaggatggcccggagcagcccctaccccacagatgtggcccgggtggtgaatgcccccatcttccacgtgaatgctgatgatcctgaggccgtcatctacgtgtgcagcgtggccgctgagtggaggaacaccttcaacaaggatgtggtggtggacctggtgtgctacagaagaagaggccacaatgagatggatgagcccatgttcacccagcccctgatgtacaagcagatccaccggcaggtgcctgtgctgaagaagtatgctgacaagctgattgctgagggcaccgtgaccctgcaggagtttgaggaggagatcgccaagtatgaccgcatctgtgaggaggcctacggccgcagcaaggacaagaagatcctgcacatcaagcactggctggacagcccctggccaggcttcttcaacgtggatggagagcccaagtccatgacctgcccagccaccggcatccctgaggacatgctgacccacatcggctctgtggccagctctgtgcccctggaggacttcaagatccacacaggcctgagccgcatcctgcggggccgggctgacatgaccaagaacagaacagtggactgggccctggccgagtacatggccttcggcagcctgctgaaggagggcatccacgtgcggctgagcggccaggatgtggagcggggcaccttcagccaccgccaccacgtgctgcatgaccaggaggtggacaggaggacctgtgtgcccatgaaccacctgtggccagaccaggccccctacacagtgtgcaacagcagcctgtctgaatatggagtgctgggctttgagctgggctacgccatggccagccccaatgccctggtgctgtgggaggcccagtttggagacttccacaacacagcccagtgcatcatcgaccagttcatcagcacaggccaggccaagtgggtgcgccacaatggaattgtgctgctgctgccccacggcatggagggcatgggccctgagcacagcagcgcccggcctgagcgcttcctgcagatgagcaatgatgacagtgatgcctacccagccttcaccaaggactttgaggtgtcccagctgtatgactgcaactggatcgtggtgaactgcagcaccccagccaactacttccacgtgctgcggcggcagatcctgctgcccttcaggaagcccctcatcatcttcacccccaagagcctgctgcggcaccctgaggccaagagcagctttgaccagatggtgtctggcaccagcttccagagggtcatcccagaagatggagctgctgcccgggcccctgagcaggtgcagaggctcatcttctgcaccgggaaggtgtactatgacctggtgaaggagaggagcagccaggacctggaggagaaggtggccatcacccggctggagcagatcagccccttcccctttgacctgatcaagcaggaggccgagaagtacccaggagctgagctggcctggtgccaggaggagcacaagaacatgggctactatgactacatcagcccccgcttcatgaccatcctgcggcgggcccggcccatctggtacgtgggccgggaccctgctgctgccccagccactggaaacagaaacacccacctggtgtccctgaagaagttcctggacacagccttcaacctgcaggcctttgagggcaagaccttctag

SEQ ID NO: 36700 - DNA, 2406 bp, Artificial Sequence
  Description of Artificial Sequence: Synthetic coding sequence
atgttcatcaatgatgtggagcagtgccagtggatccggcagaagtttgagaccccaggagtgatgcagttcagcagcgaggagaagaggaccctgctggcccggctggtgcgctccatgagatttgaggacttcctggccaggaagtggagcagcgagaagcgcttcggcctggagggctgtgaggtgatgatcccagccctgaagaccatcatcgacaagagcagcgagatgggcattgaaaatgtcatcctgggcatgccccaccggggccgcctgaatgtgctggccaacgtcatcaggaaggacctggagcagatcttctgccagtttgaccccaagctggaggccgcagatgagggcagcggagatgtgaagtaccacctgggcatgtaccacgagcgcatcaacagagtgaccaacagaaacatcaccctgagcctggtggccaaccccagccacctggaggccgtggaccctgtggtgcagggcaagaccaaggccgagcagttctacagaggagatgcccagggcaagaaggtgatgagcatcctggtgcatggagatgctgcctttgctggccagggcgtggtgtatgagaccttccacctgagtgacctgcccagctacaccaccaatggaacagtgcacgtggtggtgaacaaccagatcggcttcaccacagaccccaggatggcccggagcagcccctaccccacagatgtggcccgggtggtgaatgcccccatcttccacgtgaatgctgatgatcctgaggccgtcatctacgtgtgcagcgtggccgctgagtggaggaacaccttcaacaaggatgtggtggtggacctggtgtgctacagaagaagaggccacaatgagatggatgagcccatgttcacccagcccctgatgtacaagcagatccaccggcaggtgcctgtgctgaagaagtatgctgacaagctgattgctgagggcaccgtgaccctgcaggagtttgaggaggagatcgccaagtatgaccgcatctgtgaggaggcctacggccgcagcaaggacaagaagatcctgcacatcaagcactggctggacagcccctggccaggcttcttcaacgtggatggagagcccaagtccatgacctgcccagccaccggcatccctgaggacatgctgacccacatcggctctgtggccagctctgtgcccctggaggacttcaagatccacacaggcctgagccgcatcctgcggggccgggctgacatgaccaagaacagaacagtggactgggccctggccgagtacatggccttcggcagcctgctgaaggagggcatccacgtgcggctgagcggccaggatgtggagcggggcaccttcagccaccgccaccacgtgctgcatgaccaggaggtggacaggaggacctgtgtgcccatgaaccacctgtggccagaccaggccccctacacagtgtgcaacagcagcctgtctgaatatggagtgctgggctttgagctgggctacgccatggccagccccaatgccctggtgctgtgggaggcccagtttggagacttccacaacacagcccagtgcatcatcgaccagttcatcagcacaggccaggccaagtgggtgcgccacaatggaattgtgctgctgctgccccacggcatggagggcatgggccctgagcacagcagcgcccggcctgagcgcttcctgcagatgagcaatgatgacagtgatgcctacccagccttcaccaaggactttgaggtgtcccagctgtatgactgcaactggatcgtggtgaactgcagcaccccagccaactacttccacgtgctgcggcggcagatcctgctgcccttcaggaagcccctcatcatcttcacccccaagagcctgctgcggcaccctgaggccaagagcagctttgaccagatggtgtctggcaccagcttccagagggtcatcccagaagatggagctgctgcccgggcccctgagcaggtgcagaggctcatcttctgcaccgggaaggtgtactatgacctggtgaaggagaggagcagccaggacctggaggagaaggtggccatcacccggctggagcagatcagccccttcccctttgacctgatcaagcaggaggccgagaagtacccaggagctgagctggcctggtgccaggaggagcacaagaacatgggctactatgactacatcagcccccgcttcatgaccatcctgcggcgggcccggcccatctggtacgtgggccgggaccctgctgctgccccagccactggaaacagaaacacccacctggtgtccctgaagaagttcctggacacagccttcaacctgcaggcctttgagggcaagaccttctag

SEQ ID NO: 36701 - DNA, 2160 bp, Artificial Sequence
  Description of Artificial Sequence: Synthetic coding sequence
atgtttgggaagaagaagaagaagattgagatcagcggccccagcaactttgagcaccgggtgcacactggatttgacccccaggagcagaagttcaccggcctgccccagcagtggcacagcctgctggccgacacagccaaccggcccaagcccatggtggaccccagctgcatcacccccatccagctggcccccatgaagaccatcgtgcggggcaacaagccctgcaaggagaccagcatcaatggcctgctggaggactttgacaacatctctgtgaccaggagcaacagcctgaggaaggagagcccccccaccccagaccagggcgccagcagccacggccctggccacgccgaggagaatggcttcatcaccttcagccagtacagcagcgagagtgacaccacagctgactacaccacagagaagtaccgggagaagagcctgtatggagatgacctggacccctactaccggggcagccatgctgccaagcagaatggacatgtgatgaagatgaagcatggagaggcctactacagcgaggtgaagcccctgaagagtgactttgcccgcttctctgctgactaccacagccacctggacagcctgagcaagcccagcgagtacagcgacctgaagtgggagtaccagagggccagcagcagcagccccctggactacagcttccagttcacccccagcaggacagctggcaccagcggctgcagcaaggagagcctggcctacagcgagagcgagtggggccccagcctggatgattatgaccggcggcccaagagcagctacctgaaccagaccagcccccagcccaccatgaggcagaggagccgcagcggcagcggcctgcaggagcccatgatgccctttggagccagcgccttcaagacccacccccagggccacagctacaacagctacacctacccccggctgtctgagcccaccatgtgcatccccaaggtggactatgaccgggcccagatggtgctgagcccccccctgagcggcagtgacacctacccccggggccctgccaagctgccccagagccagagcaagagcggctacagcagcagcagccaccagtaccccagcggctaccacaaggccaccctgtaccaccaccccagcctgcagagcagcagccagtacatcagcacagccagctacctgagcagcctgagcctgagcagcagcacctacccacctccttcctggggcagcagcagtgaccagcagcccagccgggtgtcccatgagcagttccgggccgccctgcagctggtggtgtcccctggggacccccgggagtacctggccaacttcatcaagattggagagggcagcacaggcatcgtgtgcatcgccacagagaagcacacaggcaagcaggtggccgtgaagaagatggacctgaggaagcagcagaggcgggagctgctcttcaatgaggtggtgatcatgagggactaccaccacgacaacgtggtggacatgtacagcagctacctggtgggagatgagctgtgggtggtgatggagttcctggagggcggggccctgacagacatcgtgacccacaccaggatgaatgaggagcagatcgccaccgtgtgcctgtctgtgctgcgggccctgagctacctgcacaaccagggcgtcatccaccgggacatcaagagtgacagcatcctgctgaccagtgatggccgcatcaagctgagtgactttggcttctgtgcccaggtgtccaaggaggtgcccaagaggaagagcctggtgggcaccccctactggatggcccctgaggtgatcagccggctgccctacggcacagaggtggacatctggagcctgggcatcatggtgattgagatgattgatggagagcccccctacttcaatgaaccacccctgcaggccatgaggcgcatccgggacagcctgcccccccgggtgaaggacctgcacaaggtgtcctctgtgctgcggggcttcctggacctgatgctggtgcgggagcccagccagagggccacagcccaggagctgctgggccaccccttcctgaagctggccggcccccccagctgcatcgtgcccctgatgaggcagtaccgccaccactag

SEQ ID NO: 36702 - DNA, 2160 bp, Artificial Sequence; identical to SEQ ID NO: 36701
  Description of Artificial Sequence: Synthetic coding sequence

SEQ ID NO: 36703 - DNA, 2160 bp, Artificial Sequence; identical to SEQ ID NO: 36701
  Description of Artificial Sequence: Synthetic coding sequence

SEQ ID NO: 36704 - DNA, 1743 bp, Artificial Sequence
  Description of Artificial Sequence: Synthetic coding sequence
atggtggaccccagctgcatcacccccatccagctggcccccatgaagaccatcgtgcggggcaacaagccctgcaaggagaccagcatcaatggcctgctggaggactttgacaacatctctgtgaccaggagcaacagcctgaggaaggagagcccccccaccccagaccagggcgccagcagccacggccctggccacgccgaggagaatggcttcatcaccttcagccagtacagcagcgagagtgacaccacagctgactacaccacagagaagtaccgggagaagagcctgtatggagatgacctggacccctactaccggggcagccatgctgccaagcagaatggacatgtgatgaagatgaagcatggagaggcctactacagcgaggtgaagcccctgaagagtgactttgcccgcttctctgctgactaccacagccacctggacagcctgagcaagcccagcgagtacagcgacctgaagtgggagtaccagagggccagcagcagcagccccctggactacagcttccagttcacccccagcaggacagctggcaccagcggctgcagcaaggagagcctggcctacagcgagagcgagtggggccccagcctggatgattatgaccggcggcccaagagcagctacctgaaccagaccagcccccagcccaccatgaggcagaggagccgcagcggcagcggcctgcaggagcccatgatgccctttggagccagcgccttcaagacccacccccagggccacagctacaacagctacacctacccccggctgtctgagcccaccatgtgcatccccaaggtggactatgaccgggcccagatggtgctgagcccccccctgagcggcagtgacacctacccccggggccctgccaagctgccccagagccagagcaagagcggctacagcagcagcagccaccagtaccccagcggctaccacaaggccaccctgtaccaccaccccagcctgcagagcagcagccagtacatcagcacagccagctacctgagcagcctgagcctgagcagcagcacctacccacctccttcctggggcagcagcagtgaccagcagcccagccgggtgtcccatgagcagttccgggccgccctgcagctggtggtgtcccctggggacccccgggagtacctggccaacttcatcaagattggagagggcagcacaggcatcgtgtgcatcgccacagagaagcacacaggcaagcaggtggccgtgaagaagatggacctgaggaagcagcagaggcgggagctgctcttcaatgaggtggtgatcatgagggactaccaccacgacaacgtggtggacatgtacagcagctacctggtgggagatgagctgtgggtggtgatggagttcctggagggcggggccctgacagacatcgtgacccacaccaggatgaatgaggagcagatcgccaccgtgtgcctgtctgtgctgcgggccctgagctacctgcacaaccagggcgtcatccaccgggacatcaagagtgacagcatcctgctgaccagtgatggccgggtgtcctctgtgctgcggggcttcctggacctgatgctggtgcgggagcccagccagagggccacagcccaggagctgctgggccaccccttcctgaagctggccggcccccccagctgcatcgtgcccctgatgaggcagtaccgccaccactag

SEQ ID NO: 36705 - DNA, 366 bp, Artificial Sequence
  Description of Artificial Sequence: Synthetic coding sequence
atgagcaccctcttccccagcctcttcccccgggtgacagagaccctgtggttcaacctggaccggccctgtgtggaggagacagagctgcagcagcaggagcagcagcaccaggcctggctgcagagcattgctgagaaggacaacaacctggtgcccatcggcaagccagccagcgagcactatgatgatgaggaggaggaggatgatgaagatgatgaggacagcgaggaggacagtgaagatgatgaggacatgcaggacatggatgagatgaatgactacaatgaatctccagatgatggagaggtgaatgaggtggacatggagggcaatgagcaggaccaggaccagtggatgatctag

SEQ ID NO: 36706 - DNA, 1269 bp, Artificial Sequence
  Description of Artificial Sequence: Synthetic coding sequence
atggccatcgcccagctggccacagaatatgtgttcagtgacttcctgctgaaggagcccacagagcccaagttcaagggcctgcggctggagctggccgtggacaagatggtgacctgcatcgctgtgggcctgcccctgctgctgatcagcctggcctttgcccaggagatcagcatcggcacccagatcagctgcttcagccccagcagcttctcctggaggcaggccgcctttgtggacagctactgctgggccgctgtgcagcagaagaacagcctgcagagcgagagcggcaacctgcccctgtggctgcacaagttcttcccctacatcctgctgctgtttgccatcctgctgtacctgcccccactcttctggaggtttgctgctgccccccacatctgcagcgacctgaagttcatcatggaggagctggacaaggtgtacaacagagccatcaaggccgccaagagcgcccgggacctggacatgagagatggagcctgcagcgtgcctggggtgacagagaacctgggccagagcctgtgggaggtgtctgagagccacttcaagtaccccatcgtggagcagtacctgaagaccaagaagaacagcaacaacctgatcatcaagtacatcagctgccgcctgctgaccctcatcatcatcctgctggcctgcatctacctgggctactacttcagcctgagcagcctgagtgatgaatttgtgtgcagcatcaagagcggcatcctgagaaatgacagcacagtgcctgaccagttccagtgcaagctgattgctgtgggcatcttccagctgctgagcgtcatcaacctggtggtgtatgtgctgctggcccctgtggtggtgtacaccctgtttgtgcccttccggcagaagacagatgtgctgaaggtgtatgagatcctgcccacctttgatgtgctgcacttcaagtctgagggctacaatgacctgagcctgtacaacctcttcctggaggagaacatcagcgaggtgaagagctacaagtgcctgaaggtgctggagaacatcaagagcagcggccagggcatcgaccccatgctgctgctgaccaacctgggcatgatcaagatggatgtggtggatggcaagacccccatgtctgctgagatgagggaggagcagggcaaccagacagctgagctgcaggacagcgagaccaaggccaacaacggggagaagaatgcccggcagaggctgctggacagcagctgctag

SEQ ID NO: 36707 - DNA, 2034 bp, Artificial Sequence
  Description of Artificial Sequence: Synthetic coding sequence
atgcaccacctgctggagcagagcgctgacatggccacagccctgctggccggggagaagctgcgggagctgatcctgcccggggcccaggatgacaaggccggggccctggccgccctgctgctgcagctgaagctggagctgccctttgacagagtggtgaccatcggcaccgtgctggtgcccatcctgctggtgaccctggtgttcaccaagaactttgctgaggagcccatctactgctacaccccccacaacttcacccgggaccaggccctgtatgcccggggctactgctggacagagctgagagatgccctgcccggggtggatgccagcctgtggcccagcctgtttgagcacaagttcctgccctatgccctgctggcctttgctgccatcatgtatgtgcctgccctgggctgggagttcctggccagcacccggctgaccagcgagctgaacttcctgctgcaggagattgacaactgctaccacagagctgctgagggccgggcccccaagattgagaagcagatccagagcaaaggacctggcatcacagagcgggagaagcgggagatcattgaaaatgctgagaaggagaagagccctgagcagaacctgtttgagaagtacctggagcggcggggccgcagcaacttcctggccaagctgtacctggcccggcacgtgctgatcctgctgctgtctgctgtgcccatctcctacctgtgcacctactatgccacccagaagcagaatgagttcacctgtgccctgggcgccagcccagatggagctgctggagctggccctgctgtgcgggtgtcctgcaagctgcccagcgtgcagctgcagaggatcatcgccggcgtggacatcgtgctgctgtgtgtgatgaacctgatcatcctggtgaacctgatccacctgttcatcttcaggaagagcaacttcatctttgacaagctgcacaaggtgggcatcaagacccggcggcagtggaggaggagccagttctgtgacatcaacatcctggccatgttctgcaatgaaaatagagaccacatcaagagcctgaaccggctggacttcatcaccaatgaaagtgacctgatgtatgacaacgtggtgcggcagctgctggccgccctggcccagagcaaccatgatgccacccccaccgtgcgggacagcggcgtgcagacagtggaccccagcgccaacccagctgagccagatggagctgctgagccccctgtggtgaagaggcccaggaagaagatgaagtggatccccaccagcaaccccctgccccagcccttcaaggagcccctggccatcatgagggtggagaacagcaaggccgagaagcccaagccagcccggaggaagacagccacagacaccctgattgcccccctgctggacagaagtgcccaccactacaagggcggcggcggggaccccggccctggccctgccccagccccagcccctcctccagccccagacaagaagcacgcccggcacttcagcctggatgtgcacccctacatcctgggcaccaagaaggccaaggccgaggccgtgcctgctgccctgcctgccagccgcagccaggagggcggcttcctgagccaggccgaggactgtggcctgggcctggccccagcccccatcaaggatgcccccctgcctgagaaggagatcccctaccccacagagcccgcccgggccggcctgcccagcggcggccccttccacgtgcgcagccccccagctgccccagctgtggcccccctgaccccagccagcctgggcaaggccgagcccctgaccatcctgagcagaaatgccacccaccccctgctgcacatcaacaccctgtatgaggcccgggaggaggaggatggcggcccccggctgccccaggatgtgggggacctgattgccatcccagccccccagcagatcctgattgccacctttgatgagcccaggacagtggtgtccacagtggagttctag

SEQ ID NO: 36708 - DNA, 1065 bp, Artificial Sequence
  Description of Artificial Sequence: Synthetic coding sequence
atgaacctgatcatcctggtgaacctgatccacctgttcatcttcaggaagagcaacttcatctttgacaagctgcacaaggtgggcatcaagacccggcggcagtggaggaggagccagttctgtgacatcaacatcctggccatgttctgcaatgaaaatagagaccacatcaagagcctgaaccggctggacttcatcaccaatgaaagtgacctgatgtatgacaacgtggtgcggcagctgctggccgccctggcccagagcaaccatgatgccacccccaccgtgcgggacagcggcgtgcagacagtggaccccagcgccaacccagctgagccagatggagctgctgagccccctgtggtgaagaggcccaggaagaagatgaagtggatccccaccagcaaccccctgccccagcccttcaaggagcccctggccatcatgagggtggagaacagcaaggccgagaagcccaagccagcccggaggaagacagccacagacaccctgattgcccccctgctggacagaagtgccccagacaagaagcacgcccggcacttcagcctggatgtgcacccctacatcctgggcaccaagaaggccaaggccgaggccgtgcctgctgccctgcctgccagccgcagccaggagggcggcttcctgagccaggccgaggactgtggcctgggcctggccccagcccccatcaaggatgcccccctgcctgagaaggagatcccctaccccacagagcccgcccgggccggcctgcccagcggcggccccttccacgtgcgcagccccccagctgccccagctgtggcccccctgaccccagccagcctgggcaaggccgagcccctgaccatcctgagcagaaatgccacccaccccctgctgcacatcaacaccctgtatgaggcccgggaggaggaggatggcggcccccggctgccccaggatgtgggggacctgattgccatcccagccccccagcagatcctgattgccacctttgatgagcccaggacagtggtgtccacagtggagttctag

SEQ ID NO: 36709 - DNA, 1179 bp, Artificial Sequence
  Description of Artificial Sequence: Synthetic coding sequence
atgagcctggcccacacagctgctgagtacatgctgagtgatgccctgctgcctgaccggcggggcccccggctgaagggcctgcggctggagctgcccctggacagaattgtgaagtttgtggccgtgggcagccccctgctgctgatgagcctggcctttgcccaggagttcagcagcggcagccccatcagctgcttcagccccagcaacttcagcatccggcaggccgcctacgtggacagcagctgctgggacagcctgctgcaccacaagcaggacggccctggccaggacaagatgaagagcctgtggccccacaaggccctgccctacagcctgctggccctggccctgctgatgtacctgcctgtgctgctgtggcagtatgctgctgtgcctgccctgagcagtgacctgctcttcatcatcagcgagctggacaagagctacaacagaagcatccggctggtgcagcacatgctgaagatccggcagaagagcagtgacccctacgtgttctggaatgagctggagaaggccaggaaggagcgctactttgagttccccctgctggagcgctacctggcctgcaagcagaggagccacagcctggtggccacctacctgctgaggaacagcctgctgctgatcttcaccagcgccacctacctgtacctgggccacttccacctggatgtgttcttccaggaggagttcagctgcagcatcaagacaggcctgctgagtgatgagacccacgtgcccaacctgatcacctgccgcctgaccagcctgagcatcttccagatcgtgtccctgagctctgtggccatctacaccatcctggtgcctgtgatcatctacaacctgacccggctgtgccgctgggacaagaggctgctgtctgtgtatgagatgctgcctgcctttgacctgctgagcaggaagatgctgggctgccccatcaatgacctgaatgtcatcctgctcttcctgcgggccaacatcagcgagctgatctccttctcctggctgtctgtgctgtgtgtgctgaaggacaccaccacccagaagcacaacatcgacacagtggtggacttcatgaccctgctggccggcctggagcccagcaagcccaagcacctgaccaacagcgcctgtgatgagcacccctag

SEQ ID NO: 36710 - DNA, 309 bp, Artificial Sequence
  Description of Artificial Sequence: Synthetic coding sequence
atgagatatggctttgtgaggaagaagcaccggggcctcttcctgaccaccgtggccgccctgcccatctggaaccccatcagcgagtttgtgaagtggtacaagagccacaagctgagccagcactgcatccgcatctgtggccacctgtgccagaagcacctggacatgttcctgagcgtcatcggccagcgctggcccattgatgtgttcagctctgtgtttgaccaccaggtgtctgccatcggcagtgacatcatctggtggttcctgaagctgttcctggtgtccttcttcttcttcttctag

SEQ ID NO: 36711 - DNA, 3315 bp, Artificial Sequence
  Description of Artificial Sequence: Synthetic coding sequence
atgaaggtgacagtgtgctttggaagaacaggcatcgtggtgccctgcaaggagggccagctgcgggtgggggagctgacccagcaggccctgcagcgctacctgaagacccgggagaagggccctggctactgggtgaagatccaccacctggagtacacagatggcggcatcctggaccctgatgatgtgctggctgatgtggtggaggacaaggacaagctgattgctgtgtttgaggagcaggagcccctgcacaagattgagagccccagcggcaacccagctgaccggcagagcccagatgcctttgaaacagaggtggccgcccagctggccgccttcaagcccatcggcggggagattgaggtgaccccatctgccctgaagctgggcacccccctgctggtgcggcgcagcagtgaccctgtgcccggccccccagctgacacccagcccagcgccagccaccctgggggccagagcctgaagctggtggtgcctgacagcacccagaacctggaggaccgggaggtgctgaatggagtgcagacagagctgctgaccagccccaggaccaaggacaccctgagtgacatgaccaggacagtggagatctctggagagggcggccccctgggcatccacgtggtgcccttcttcagcagcctgagcggccgcatcctgggcctcttcatccggggcatcgaggacaacagccgcagcaagcgggagggcctcttccatgaaaatgaatgcatcgtgaagatcaacaacgtggacctggtggacaagacctttgcccaggcccaggatgtgttccggcaggccatgaagagccccagcgtgctgctgcacgtgctgcccccccagaaccgggagcagtatgagaagtctgtgattggcagcctgaacatctttggaaataatgatggagtgctgaagaccaaggtgcccccacctgtgcacggcaagagcggcctgaagacagccaacctgaccggcacagacagccctgagacagatgccagcgccagcctgcagcagaacaagagcccccgggtgccccggctgggcggcaagcccagcagccccagcctgagccccctgatgggcttcggcagcaacaagaatgccaagaagatcaagattgacctgaagaagggccctgagggcctgggcttcaccgtggtgacccgggacagcagcatccacggccctggccccatctttgtgaagaacatcctgcccaagggggccgccatcaaggatggccgcctgcagagcggggaccgcatcctggaggtgaatggaagagatgtgacaggccgcacccaggaggagctggtggccatgctgcggagcaccaagcagggcgagacagccagcctggtgattgcccggcaggagggccacttcctgccccgggagctgaagggggagccagactgctgtgccctgagcctggagaccagcgagcagctgacctttgagatccccctgaatgacagcggcagcgctggcctgggcgtgtccctgaagggcaacaagagccgggagactggaacagacctgggcatcttcatcaagagcatcatccacggcggggccgccttcaaggatggccgcctgaggatgaatgaccagctgattgctgtgaatggagagagcctgctgggcaagagcaaccacgaggccatggagaccctgcggcgctccatgtccatggagggcaacatccggggcatgatccagctggtgatcctgcggcggcctgagcggcccatggaggaccctgcagaatgtggggccttcagcaagccctgctttgagaactgccagaatgctgtgaccaccagcagaagaaatgacaacagcatcctgcaccccctgggcacctgcagcccccaggacaagcagaagggcctgctgctgcccaatgatggctgggccgagagcgaggtgccccccagccccaccccccacagcgccctgggcctgggcctggaggactacagccacagcagcggcgtggacagcgctgtgtacttcccagaccagcacatcaacttccgctctgtgaccccagcccggcagcctgagagcatcaacctgaaggccagcaagtccatggacctggtgcctgatgagagcaaggtgcacagcctggccggccagaagtctgagagccccagcaaggactttggccccaccctgggcctgaagaagagcagcagcctggagagcctgcagacagctgtggccgaggtgaggaagaatgacctgcccttccaccggccccggccccacatggtgcggggccggggctgcaatgaaagcttccgggccgccatcgacaagagctatgatggccctgaggagattgaagcagatggcctgagtgacaagagcagccacagcggccagggcgccctgaactgtgagagcgccccccagggcaacagcgagctggaggacatggagaacaaggccaggaaggtgaagaagaccaaggagaaggagaagaagaaggagaagggcaagctgaaggtgaaggagaagaagaggaaggaggagaatgaagatcctgagaggaagatcaagaagaagggctttggagccatgctgcgctttgggaagaagaaggaggacaagggcggcaaggccgagcagaagggcaccctgaagcatggaggcctgcgggaggaggagctggagaagatgaaggaggagcgggagagcggccggcccaccggcggcagcacagaccgcatccagaagctgaggaaggagtactaccaggcccggcgggagggcttccccctgtatgaagatgatgagggccgggcccggcccagtgaatatgacctgctgtgggtgcccggccggggcccagatggaaatgcccacaacctgcgctttgagggcatggagcggcagtatgccagcctgccccggggcggccctgctgaccctgtggactacctgcctgctgccccccggggcctgtacaaggagcgggagctgccctactacccaggggcccaccccatgcacccccccaagggcagctacccccggcccacagagctgcgggtggccgacctgcgctacccccagcactacccacctcctccagccccccagcacaagggccccttccggcaggatgtgccccccagccccccccagcaccagaggatgcctgcctaccaggagaccggccggcccggcccccggggcggcagcccagaccagtacccctaccgcacccaggacagccggcagaagaaccccatgacagctgctgtgtag

SEQ ID NO: 36712 - DNA, 3411 bp, Artificial Sequence
  Description of Artificial Sequence: Synthetic coding sequence
atgaaggtgacagtgtgctttggaagaacaggcatcgtggtgccctgcaaggagggccagctgcgggtgggggagctgacccagcaggccctgcagcgctacctgaagacccgggagaagggccctggctactgggtgaagatccaccacctggagtacacagatggcggcatcctggaccctgatgatgtgctggctgatgtggtggaggacaaggacaagctgattgctgtgtttgaggagcaggagcccctgcacaagattgagagccccagcggcaacccagctgaccggcagagcccagatgcctttgaaacagaggtggccgcccagctggccgccttcaagcccatcggcggggagattgaggtgaccccatctgccctgaagctgggcacccccctgctggtgcggcgcagcagtgaccctgtgcccggccccccagctgacacccagcccagcgccagccaccctgggggccagagcctgaagctggtggtgcctgacagcacccagaacctggaggaccgggaggtgctgaatggagtgcagacagagctgctgaccagccccaggaccaaggacaccctgagtgacatgaccaggacagtggagatctctggagagggcggccccctgggcatccacgtggtgcccttcttcagcagcctgagcggccgcatcctgggcctcttcatccggggcatcgaggacaacagccgcagcaagcgggagggcctcttccatgaaaatgaatgcatcgtgaagatcaacaacgtggacctggtggacaagacctttgcccaggcccaggatgtgttccggcaggccatgaagagccccagcgtgctgctgcacgtgctgcccccccagaaccgggagcagtatgagaagtctgtgattggcagcctgaacatctttggaaataatgatggagtgctgaagaccaaggtgcccccacctgtgcacggcaagagcggcctgaagacagccaacctgaccggcacagacagccctgagacagatgccagcgccagcctgcagcagaacaagagcccccgggtgccccggctgggcggcaagcccagcagccccagcctgagccccctgatgggcttcggcagcaacaagaatgccaagaagatcaagattgacctgaagaagggccctgagggcctgggcttcaccgtggtgacccgggacagcagcatccacggccctggccccatctttgtgaagaacatcctgcccaagggggccgccatcaaggatggccgcctgcagagcggggaccgcatcctggaggtgaatggaagagatgtgacaggccgcacccaggaggagctggtggccatgctgcggagcaccaagcagggcgagacagccagcctggtgattgcccggcaggagggccacttcctgccccgggagctgaagggggagccagactgctgtgccctgagcctggagaccagcgagcagctgacctttgagatccccctgaatgacagcggcagcgctggcctgggcgtgtccctgaagggcaacaagagccgggagactggaacagacctgggcatcttcatcaagagcatcatccacggcggggccgccttcaaggatggccgcctgaggatgaatgaccagctgattgctgtgaatggagagagcctgctgggcaagagcaaccacgaggccatggagaccctgcggcgctccatgtccatggagggcaacatccggggcatgatccagctggtgatcctgcggcggcctgagcggcccatggaggaccctgcagaatgtggggccttcagcaagccctgctttgagaactgccagaatgctgtgaccaccagcagaagaaatgacaacagcatcctgcaccccctgggcacctgcagcccccaggacaagcagaagggcctgctgctgcccaatgatggctgggccgagagcgaggtgccccccagccccaccccccacagcgccctgggcctgggcctggaggactacagccacagcagcggcgtggacagcgctgtgtacttcccagaccagcacatcaacttccgctctgtgaccccagcccggcagcctgagagcatcaacctgaaggccagcaagtccatggacctggtgcctgatgagagcaaggtgcacagcctggccggccagaagagtgatggcctgagtgacaagagcagccacagcggccagggcgccctgaactgtgagagcgccccccagggcaacagcgagctggaggacatggagaacaaggccaggaaggtgaagaagaccaaggagaaggagaagaagaaggagaagggcaagctgaaggtgaaggagaagaagaggaaggaggagaatgaagatcctgagaggaagatcaagaagaagggctttggagccatgctgcgctttgggaagaagaaggaggacaagggcggcaaggccgagcagaagggcaccctgaagcacggcggcctgcgggaggaggagctggagaagatgaaggaggagcgggagcgcatcggggccaagcaccaggagctgcgggagaagcaggcccggggcctgctggactatgccaccggggccatcggctctgtgtatgacatggatgatgatgagatggaccccaactatgcccgggtgaaccacttccgggagccctgcaccagcgccaacgtgttccgcagccccagccccccccgggccggccccttcggctaccccagagatggccaccccctgagccctgagcgggaccacctggagggcctgtatgccaaggtgaacaagccctaccaccccctggtgcctgctgacagcggccggcccaccggcggcagcacagaccgcatccagaagctgaggaaggagtactaccaggcccggcgggagggcttccccctgtatgaagatgatgagggccgggcccggcccagtgaatatgacctgctgtgggtgcccggccggggcccagatggaaatgcccacaacctgcgctttgagggcatggagcggcagtatgccagcctgccccggggcggccctgctgaccctgtggactacctgcctgctgccccccggggcctgtacaaggagcgggagctgccctactacccaggggcccaccccatgcacccccccaagggcagctacccccggcccacagagctgcgggtggccgacctgcgctacccccagcactacccacctcctccagccccccagcacaagggccccttccggcaggatgtgccccccagccccccccagcaccagaggatgcctgcctaccaggagaccggccggcccggcccccggggcggcagcccagaccagtacccctaccgcacccaggacagccggcagaagaaccccatgacagctgctgtgtag

SEQ ID NO: 36713 - DNA, 3432 bp, Artificial Sequence
  Description of Artificial Sequence: Synthetic coding sequence
atgaaggtgacagtgtgctttggaagaacaggcatcgtggtgccctgcaaggagggccagctgcgggtgggggagctgacccagcaggccctgcagcgctacctgaagacccgggagaagggccctggctactgggtgaagatccaccacctggagtacacagatggcggcatcctggaccctgatgatgtgctggctgatgtggtggaggacaaggacaagctgattgctgtgtttgaggagcaggagcccctgcacaagattgagagccccagcggcaacccagctgaccggcagagcccagatgcctttgaaacagaggtggccgcccagctggccgccttcaagcccatcggcggggagattgaggtgaccccatctgccctgaagctgggcacccccctgctggtgcggcgcagcagtgaccctgtgcccggccccccagctgacacccagcccagcgccagccaccctgggggccagagcctgaagctggtggtgcctgacagcacccagaacctggaggaccgggaggtgctgaatggagtgcagacagagctgctgaccagccccaggaccaaggacaccctgagtgacatgaccaggacagtggagatctctggagagggcggccccctgggcatccacgtggtgcccttcttcagcagcctgagcggccgcatcctgggcctcttcatccggggcatcgaggacaacagccgcagcaagcgggagggcctcttccatgaaaatgaatgcatcgtgaagatcaacaacgtggacctggtggacaagacctttgcccaggcccaggatgtgttccggcaggccatgaagagccccagcgtgctgctgcacgtgctgcccccccagaaccgggagcagtatgagaagtctgtgattggcagcctgaacatctttggaaataatgatggagtgctgaagaccaaggtgcccccacctgtgcacggcaagagcggcctgaagacagccaacctgaccggcacagacagccctgagacagatgccagcgccagcctgcagcagaacaagagcccccgggtgccccggctgggcggcaagcccagcagccccagcctgagccccctgatgggcttcggcagcaacaagaatgccaagaagatcaagattgacctgaagaagggccctgagggcctgggcttcaccgtggtgacccgggacagcagcatccacggccctggccccatctttgtgaagaacatcctgcccaagggggccgccatcaaggatggccgcctgcagagcggggaccgcatcctggaggtgaatggaagagatgtgacaggccgcacccaggaggagctggtggccatgctgcggagcaccaagcagggcgagacagccagcctggtgattgcccggcaggagggccacttcctgccccgggagctggatggccgcctgaggatgaatgaccagctgattgctgtgaatggagagagcctgctgggcaagagcaaccacgaggccatggagaccctgcggcgctccatgtccatggagggcaacatccggggcatgatccagctggtgatcctgcggcggcctgagcggcccatggaggaccctgcagaatgtggggccttcagcaagccctgctttgagaactgccagaatgctgtgaccaccagcagaagaaatgacaacagcatcctgcaccccctgggcacctgcagcccccaggacaagcagaagggcctgctgctgcccaatgatggctgggccgagagcgaggtgccccccagccccaccccccacagcgccctgggcctgggcctggaggactacagccacagcagcggcgtggacagcgctgtgtacttcccagaccagcacatcaacttccgctctgtgaccccagcccggcagcctgagagcatcaacctgaaggccagcaagtccatggacctggtgcctgatgagagcaaggtgcacagcctggccggccagaagtctgagagccccagcaaggactttggccccaccctgggcctgaagaagagcagcagcctggagagcctgcagacagctgtggccgaggtgaggaagaatgacctgcccttccaccggccccggccccacatggtgcggggccggggctgcaatgaaagcttccgggccgccatcgacaagagctatgatggccctgaggagattgaagcagatggcctgagtgacaagagcagccacagcggccagggcgccctgaactgtgagagcgccccccagggcaacagcgagctggaggacatggagaacaaggccaggaaggtgaagaagaccaaggagaaggagaagaagaaggagaagggcaagctgaaggtgaaggagaagaagaggaaggaggagaatgaagatcctgagaggaagatcaagaagaagggctttggagccatgctgcgctttgggaagaagaaggaggacaagggcggcaaggccgagcagaagggcaccctgaagcatggaggcctgcgggaggaggagctggagaagatgaaggaggagcgggagagaattggagccaagcaccaggagctgcgggagaagcaggcccggggcctgctggactatgccactggagccatcggctctgtgtatgacatggatgatgatgagatggaccccaactatgcccgggtgaaccacttccgggagccctgcaccagcgccaacgtgttccgcagccccagcccccccagggctggccccttcggctaccccagagatggccaccccctgagccctgagcgggaccacctggagggcctgtatgccaaggtgaacaagccctaccaccccctggtgcctgctgacagcggccggcccactggaggcagcacagaccgcatccagaagctgaggaaggagtactaccaggcccggcgggagggcttccccctgtatgaagatgatgagggccgggcccggcccagtgaatatgacctgctgtgggtgcccggccggggcccagatggaaatgcccacaacctgcgctttgagggcatggagcggcagtatgccagcctgccccggggcggccctgctgaccctgtggactacctgcctgctgccccccggggcctgtacaaggagcgggagctgccctactacccaggggcccaccccatgcacccccccaagggcagctacccccggcccacagagctgcgggtggccgacctgcgctacccccagcactacccacctcctccagccccccagcacaagggccccttccggcaggatgtgccccccagccccccccagcaccagaggatgcctgcctaccaggagaccggccggcccggcccccggggcggcagcccagaccagtacccctaccgcacccaggacagccggcagaagaaccccatgacagctgctgtgtag

SEQ ID NO: 36714 - DNA, 3618 bp, Artificial Sequence
  Description of Artificial Sequence: Synthetic coding sequence
atgaaggtgacagtgtgctttggaagaacaggcatcgtggtgccctgcaaggagggccagctgcgggtgggggagctgacccagcaggccctgcagcgctacctgaagacccgggagaagggccctggctactgggtgaagatccaccacctggagtacacagatggcggcatcctggaccctgatgatgtgctggctgatgtggtggaggacaaggacaagctgattgctgtgtttgaggagcaggagcccctgcacaagattgagagccccagcggcaacccagctgaccggcagagcccagatgcctttgaaacagaggtggccgcccagctggccgccttcaagcccatcggcggggagattgaggtgaccccatctgccctgaagctgggcacccccctgctggtgcggcgcagcagtgaccctgtgcccggccccccagctgacacccagcccagcgccagccaccctgggggccagagcctgaagctggtggtgcctgacagcacccagaacctggaggaccgggaggtgctgaatggagtgcagacagagctgctgaccagccccaggaccaaggacaccctgagtgacatgaccaggacagtggagatctctggagagggcggccccctgggcatccacgtggtgcccttcttcagcagcctgagcggccgcatcctgggcctcttcatccggggcatcgaggacaacagccgcagcaagcgggagggcctcttccatgaaaatgaatgcatcgtgaagatcaacaacgtggacctggtggacaagacctttgcccaggcccaggatgtgttccggcaggccatgaagagccccagcgtgctgctgcacgtgctgcccccccagaaccgggagcagtatgagaagtctgtgattggcagcctgaacatctttggaaataatgatggagtgctgaagaccaaggtgcccccacctgtgcacggcaagagcggcctgaagacagccaacctgaccggcacagacagccctgagacagatgccagcgccagcctgcagcagaacaagagcccccgggtgccccggctgggcggcaagcccagcagccccagcctgagccccctgatgggcttcggcagcaacaagaatgccaagaagatcaagattgacctgaagaagggccctgagggcctgggcttcaccgtggtgacccgggacagcagcatccacggccctggccccatctttgtgaagaacatcctgcccaagggggccgccatcaaggatggccgcctgcagagcggggaccgcatcctggaggtgaatggaagagatgtgacaggccgcacccaggaggagctggtggccatgctgcggagcaccaagcagggcgagacagccagcctggtgattgcccggcaggagggccacttcctgccccgggagctgaagggggagccagactgctgtgccctgagcctggagaccagcgagcagctgacctttgagatccccctgaatgacagcggcagcgctggcctgggcgtgtccctgaagggcaacaagagccgggagactggaacagacctgggcatcttcatcaagagcatcatccacggcggggccgccttcaaggatggccgcctgaggatgaatgaccagctgattgctgtgaatggagagagcctgctgggcaagagcaaccacgaggccatggagaccctgcggcgctccatgtccatggagggcaacatccggggcatgatccagctggtgatcctgcggcggcctgagcggcccatggaggaccctgcagaatgtggggccttcagcaagccctgctttgagaactgccagaatgctgtgaccaccagcagaagaaatgacaacagcatcctgcaccccctgggcacctgcagcccccaggacaagcagaagggcctgctgctgcccaatgatggctgggccgagagcgaggtgccccccagccccaccccccacagcgccctgggcctgggcctggaggactacagccacagcagcggcgtggacagcgctgtgtacttcccagaccagcacatcaacttccgctctgtgaccccagcccggcagcctgagagcatcaacctgaaggccagcaagtccatggacctggtgcctgatgagagcaaggtgcacagcctggccggccagaagtctgagagccccagcaaggactttggccccaccctgggcctgaagaagagcagcagcctggagagcctgcagacagctgtggccgaggtgaggaagaatgacctgcccttccaccggccccggccccacatggtgcggggccggggctgcaatgaaagcttccgggccgccatcgacaagagctatgatggccctgaggagattgaagcagatggcctgagtgacaagagcagccacagcggccagggcgccctgaactgtgagagcgccccccagggcaacagcgagctggaggacatggagaacaaggccaggaaggtgaagaagaccaaggagaaggagaagaagaaggagaagggcaagctgaaggtgaaggagaagaagaggaaggaggagaatgaagatcctgagaggaagatcaagaagaagggctttggagccatgctgcgctttgggaagaagaaggaggacaagggcggcaaggccgagcagaagggcaccctgaagcatggaggcctgcgggaggaggagctggagaagatgaaggaggagcgggagagaattggagccaagcaccaggagctgcgggagaagcaggcccggggcctgctggactatgccactggagccatcggctctgtgtatgacatggatgatgatgagatggaccccaactatgcccgggtgaaccacttccgggagccctgcaccagcgccaacgtgttccgcagccccagcccccccagggctggccccttcggctaccccagagatggccaccccctgagccctgagcgggaccacctggagggcctgtatgccaaggtgaacaagccctaccaccccctggtgcctgctgacagcggccggcccactggaggcagcacagaccgcatccagaagctgaggaaggagtactaccaggcccggcgggagggcttccccctgtatgaagatgatgagggccgggcccggcccagtgaatatgacctgctgtgggtgcccggccggggcccagatggaaatgcccacaacctgcgctttgagggcatggagcggcagtatgccagcctgccccggggcggccctgctgaccctgtggactacctgcctgctgccccccggggcctgtacaaggagcgggagctgccctactacccaggggcccaccccatgcacccccccaagggcagctacccccggcccacagagctgcgggtggccgacctgcgctacccccagcactacccacctcctccagccccccagcacaagggccccttccggcaggatgtgccccccagccccccccagcaccagaggatgcctgcctaccaggagaccggccggcccggcccccggggcggcagcccagaccagtacccctaccgcacccaggacagccggcagaagaaccccatgacagctgctgtgtag

SEQ ID NO: 36715 - DNA, 828 bp, Artificial Sequence
  Description of Artificial Sequence: Synthetic coding sequence
atgccctatgccaaccagcccaccgtgcgcatcacagagctgacagatgaaaatgtgaagttcatcatcgagaacacagacctggccgtggccaacagcatcagaagagtcttcatcgccgaggtgcccatcatcgccatcgactgggtgcagattgatgccaacagctctgtgctgcatgatgagttcatcgcccaccggctgggcctcatccccctcatcagtgatgacatcgtggacaagctgcagtacagccgggactgcacctgtgaggagttctgcccagagtgcagcgtggagttcaccctggatgtgcgctgcaatgaagaccagaccaggcatgtgaccagccgggacctgatcagcaacagccccagggtcatccctgtgaccagcaggaacagagacaatgaccccaatgactatgtggagcaggatgacatcctgattgtgaagctgaggaagggccaggagctgcggctgcgggcctatgccaagaagggctttgggaaggagcacgccaagtggaaccccacagctggggtggcctttgaatatgaccctgacaatgccctgcggcacacagtgtaccccaagccagaggagtggcccaagtctgagtacagcgagctggatgaagatgagagccaggccccctatgaccccaacgggaagccagagcgcttctactacaacgtggagagctgtggcagcctgcggcctgagaccatcgtgctgagcgccctgagcggcctgaagaagaagctgagtgacctgcagacccagctgagccatgagatccagagtgatgtgctgaccatcaactag

SEQ ID NO: 36716 - DNA, 1038 bp, Artificial Sequence
  Description of Artificial Sequence: Synthetic coding sequence
atggcccggccccagaggaccccagcccggagcccagacagcatcgtggaggtgaagagcaagtttgatgctgagttcagaagatttgccctgccccgggcctctgtgtctggcttccaggagttcagccggctgctgcgggctgtgcaccagatccctggcctggatgtgctgctgggctacacagatgcccatggagacctgctgcccctgaccaatgatgacagcctgcaccgggccctggccagcggccccccacccctgcggctgctggtgcagaagcgggaggccgacagcagcggcctggcctttgccagcaacagcctgcagaggaggaagaagggcctgctgctgcggcctgtggcccccctgcggacccggccccccctgctgatcagcctgccccaggacttccggcaggtgtcctctgtgattgatgtggacctgctgcctgagacccacagaagagtgcggctgcacaagcacggcagtgaccggcccctgggcttctacatcagagatggcatgtctgtgcgggtggccccccagggcctggagcgggtgcccggcatcttcatcagccggctggtgcggggcggcctggccgagagcacaggcctgctggccgtgtctgatgagatcctggaggtgaatggcatcgaggtggccggcaagaccctggaccaggtgacagacatgatggtggccaacagccacaacctgattgtgacagtgaagccagccaaccagagaaataatgtggtgcggggggccagcggccgcctgactggacctccttctgctggccctggccctgctgagccagacagtgatgatgacagcagtgacctggtgattgaaaatcggcagccccccagcagcaatggcctgagccagggccccccctgctgggacctgcaccctggctgccgccaccctggcaccaggagcagcctgcccagcctggatgaccaggagcaggccagcagcggctggggcagccgcatcagaggagatggcagcggcttcagcctgtag

SEQ ID NO: 36717 - DNA, 1032 bp, Artificial Sequence
  Description of Artificial Sequence: Synthetic coding sequence
atggaggtgctggccgctgagaccaccagccagcaggagcggctgcaggccatcgccgagaagaggaagaggcaggccgagattgagaacaagaggcggcagctggaggatgaaagacggcagctgcagcacctgaagagcaaggccctgcgggagcgctggctgctggagggcacccccagcagcgcctctgaaggagatgaggacctgcggcggcagatgcaggatgatgagcagaagacccggctgctggaggacagcgtgtcccggctggagaaggagattgaggtgctggagcggggggacagcgccccagccacagccaaggaaaatgctgctgcccccagccctgtgcgggccccagcccccagccctgccaaggaggagaggaagacagaggtggtgatgaacagccagcagacccctgtgggcacccccaaggacaagagggtgagcaacacccccctgaggacagtggatggcagccccatgatgaaggctgtggtgcatgctgtggatggaacagcagaaaatggcatccaccccctgagcagcagcgaggtggatgagctgatccacaaggcagatgaggtgaccctgtctgaggccggcagcacagctggagctgctgagaccagaggagctgtggagggcgccgcccggaccacccccagccggcgggagatcaccggggtgcaggcccagcccggggaggccaccagcggccccccaggcatccagcccggccaggagccccctgtgaccatgatcttcatgggctaccagaatgtggaggatgaggccgagaccaagaaggtgctgggcctgcaggacaccatcacagctgagctggtggtgattgaagatgctgctgagcccaaggagcccgccccacccaacggcagcgctgctgagcccccaacagaggccgccagccgggaggagaaccaggccggccctgaggccaccaccagtgacccccaggacctggacatgaagaagcaccgctgcaagtgctgcagcatcatgtag

SEQ ID NO: 36718 - DNA, 1164 bp, Artificial Sequence
  Description of Artificial Sequence: Synthetic coding sequence
atggaggtgctggccgctgagaccaccagccagcaggagcggctgcaggccatcgccgagaagaggaagaggcaggccgagattgagaacaagaggcggcagctggaggatgaaagacggcagctgcagcacctgaagagcaaggccctgcgggagcgctggctgctggagggcacccccagcagcgcctctgaaggagatgaggacctgcggcggcagatgcaggatgatgagcagaagacccggctgctggaggacagcgtgtcccggctggagaaggagattgaggtgctggagcggggggacagcgccccagccacagccaaggaaaatgctgctgcccccagccctgtgcgggccccagcccccagccctgccaaggaggagaggaagacagaggtggtgatgaacagccagcagacccctgtgggcacccccaaggacaagagggtgagcaacacccccctgaggacagtggatggcagccccatgatgaaggccgccatgtacagcgtggagatcaccgtggagaaggacaaggtgactggagagaccagggtgctgagcagcaccaccctgctgccccggcagcccctgcccctgggcatcaaggtgtatgaagatgagaccaaggtggtgcatgctgtggatggaacagcagaaaatggcatccaccccctgagcagcagcgaggtggatgagctgatccacaaggcagatgaggtgaccctgtctgaggccggcagcacagctggagctgctgagaccagaggagctgtggagggcgccgcccggaccacccccagccggcgggagatcaccggggtgcaggcccagcccggggaggccaccagcggccccccaggcatccagcccggccaggagccccctgtgaccatgatcttcatgggctaccagaatgtggaggatgaggccgagaccaagaaggtgctgggcctgcaggacaccatcacagctgagctggtggtgattgaagatgctgctgagcccaaggagcccgccccacccaacggcagcgctgctgagcccccaacagaggccgccagccgggaggagaaccaggccggccctgaggccaccaccagtgacccccaggacctggacatgaagaagcaccgctgcaagtgctgcagcatcatgtag

SEQ ID NO: 36719 - DNA, 759 bp, Artificial Sequence
  Description of Artificial Sequence: Synthetic coding sequence
atgaacagccagcagacccctgtgggcacccccaaggacaagagggtgagcaacacccccctgaggacagtggatggcagccccatgatgaaggccgccatgtacagcgtggagatcaccgtggagaaggacaaggtgactggagagaccagggtgctgagcagcaccaccctgctgccccggcagcccctgcccctgggcatcaaggtgtatgaagatgagaccaaggtggtgcatgctgtggatggaacagcagaaaatggcatccaccccctgagcagcagcgaggtggatgagctgatccacaaggcagatgaggtgaccctgtctgaggccggcagcacagctggagctgctgagaccagaggagctgtggagggcgccgcccggaccacccccagcagaagagagatcactggagtgcaggcccagcctggagaggccaccagcggccccccaggcatccagcccggccaggagccccctgtgaccatgatcttcatgggctaccagaatgtggaggatgaagctgagaccaagaaggtgctgggcctgcaggacaccatcacagctgagctggtggtgattgaagatgctgctgagcccaaggagcccgcccccccaaatggatctgctgctgagcccccaacagaagctgccagccgggaggagaaccaggccggccctgaggccaccaccagtgacccccaggacctggacatgaagaagcaccgctgcaagtgctgcagcatcatgtag

SEQ ID NO: 36720 - DNA, 1062 bp, Artificial Sequence
  Description of Artificial Sequence: Synthetic coding sequence
atggccatgaccctgctggaggactggtgccggggcatggatgtgaacagccagagggccctgctggtgtggggcatccctgtgaactgtgatgaagctgagattgaggagaccctgcaggccgccatgccccaggtgtcctacaggatgctgggccgcatgttctggagagaagaaaatgccaaggccgccctgctggagctgactggagctgtggactatgctgccatcccccgggagatgcctgggaagggcggcgtgtggaaggtgctcttcaagccacccaccagtgatgctgagttcctggagcggctgcacctgttcctggcccgggagggctggacagtgcaggatgtggcccgggtgctgggcttccagaaccccacccccaccccaggccctgagatgcctgctgagatgctgaactacatcctggacaacgtcatccagcccctggtggagagcatctggtacaagaggctgaccctcttcagcggccgggacatccctggccctggagaggagacctttgacccctggctggagcacaccaatgaggtgctggaggagtggcaggtgtctgatgtggagaagagaagaaggctgatggagagcctgcggggccctgctgctgatgtgatccgcatcctgaagagcaacaacccagccatcaccacagctgagtgcctgaaggccctggagcaggtgtttggatctgtggagagcagcagagatgcccagatcaagttcctgaacacctaccagaaccctggagagaagctgagcgcctacgtgatccggctggagcccctgctgcagaaggtggtggagaagggggccatcgacaaggacaacgtgaaccaggcccggctggagcaggtgattgctggggccaaccacagcggggccatccggcggcagctgtggctgactggagctggggagggccctgcccccaacctcttccagctgctggtgcagatccgggaggaggaggccaaggaggaggaggaggaggccgaggccaccctgctgcagctgggcctggagggccacttctag

SEQ ID NO: 36721 - DNA, 1782 bp, Artificial Sequence
  Description of Artificial Sequence: Synthetic coding sequence
atgggcacagcccgcatcgcccctggcctggccctgctgctgtgctgccctgtgctgagcagcgcctatgccctggtggatgctgatgatgtgatgaccaaggaggagcagatcttcctgctgcaccgggcccaggcccagtgtgagaagaggctgaaggaggtgctgcagaggcctgccagcatcatggagagtgacaagggctggaccagcgccagcaccagcggcaagcccaggaaggacaaggccagcggcaagctgtacccagagagcgaggaggacaaggaggcccccaccggcagccgctaccggggccggccctgcctgcctgagtgggaccacatcctgtgctggcccctgggcgcccctggagaggtggtggccgtgccctgcccagactacatctatgacttcaaccacaagggccacgcctaccgccgctgtgacagaaatggctcctgggagctggtgcccggccacaacagaacctgggccaactacagtgaatgtgtgaagttcctgaccaatgagacccgggagcgggaggtgtttgaccggctgggcatgatctacacagtgggctacagcgtgtccctggccagcctgactgtggccgtgctgatcctggcctacttccggcggctgcactgcaccaggaactacatccacatgcacctgttcctgtccttcatgctgcgggctgtgtccatctttgtgaaggatgctgtgctgtacagcggggccaccctggatgaagctgagcggctgacagaggaggagctgcgggccatcgcccaggcccctcctcctccagccacagctgctgctggctacgccggctgccgggtggccgtgaccttcttcctgtacttcctggccaccaactactactggatcctggtggagggcctgtacctgcacagcctcatcttcatggccttcttcagcgagaagaagtacctgtggggcttcaccgtgtttggctggggcctgcctgctgtgtttgtggccgtgtgggtgtctgtgcgggccaccctggccaacacaggctgctgggacctgagcagcggcaacaagaagtggatcatccaggtgcccatcctggccagcatcgtgctgaacttcatcctcttcatcaacatcgtgcgggtgctggccaccaagctgcgggagaccaatgccggccgctgtgacacccggcagcagtacaggaagctgctgaagagcaccctggtgctgatgcccctgtttggagtgcactacatcgtgttcatggccaccccctacacagaggtgtctggcaccctgtggcaggtgcagatgcactatgagatgctgttcaacagcttccagggcttctttgtggccatcatctactgcttctgcaatggagaggtgcaggccgagatcaagaagtcctggagccgctggaccctggccctggacttcaagaggaaggcccggagcggcagcagcagctacagctatggccccatggtgagccacacctctgtgaccaacgtgggcccccgggtgggcctgggcctgcccctgagcccccggctgctgcccacagccaccaccaacggccacccccagctgcccggccacgccaagccaggcaccccagccctggagaccctggagaccaccccaccagccatggccgcccccaaggatgatggcttcctgaatggcagctgcagcggcctggatgaggaggccagcggccctgagcggcccccagccctgctgcaggaggagtgggagaccgtgatgtag

SEQ ID NO: 36722 - DNA, 1782 bp, Artificial Sequence; identical to SEQ ID NO: 36721
  Description of Artificial Sequence: Synthetic coding sequence

SEQ ID NO: 36723 - DNA, 1584 bp, Artificial Sequence
  Description of Artificial Sequence: Synthetic coding sequence
atgggcacagcccgcatcgcccctggcctggccctgctgctgtgctgccctgtgctgagcagcgcctatgccctggtggatgctgatgatgtgatgaccaaggaggagcagatcttcctgctgcaccgggcccaggcccagtgtgagaagaggctgaaggaggtgctgcagaggcctgccagcatcatggagagtgacaagggctggaccagcgccagcaccagcggcaagcccaggaaggacaaggccagcggcaagctgtacccagagagcgaggaggacaaggaggcccccaccggcagccgctaccggggccggccctgcctgcctgagtgggaccacatcctgtgctggcccctgggcgcccctggagaggtggtggccgtgccctgcccagactacatctatgacttcaaccacaagggccacgcctaccgccgctgtgacagaaatggctcctgggagctggtgcccggccacaacagaacctgggccaactacagtgaatgtgtgaagttcctgaccaatgagacccgggagcgggaggtgtttgaccggctgggcatgatctacacagtgggctacagcgtgtccctggccagcctgactgtggccgtgctgatcctggcctacttccggcggctgcactgcaccaggaactacatccacatgcacctgttcctgtccttcatgctgcgggctgtgtccatctttgtgaaggatgctgtgctgtacagcggggccaccctggatgaagctgagcggctgacagaggaggagctgcgggccatcgcccaggcccctcctcctccagccacagctgctgctggctacgccggctgccgggtggccgtgaccttcttcctgtacttcctggccaccaactactactggatcctggtggagggcctgtacctgcacagcctcatcttcatggccttcttcagcgagaagaagtacctgtggggcttcaccgtgtttggctggggcctgcctgctgtgtttgtggccgtgtgggtgtctgtgcgggccaccctggccaacacaggctgctgggacctgagcagcggcaacaagaagtggatcatccaggtgcccatcctggccagcatcgtgctgaacttcatcctcttcatcaacatcgtgcgggtgctggccaccaagctgcgggagaccaatgccggccgctgtgacacccggcagcagtacaggaagctgctgaagagcaccctggtgctgatgcccctgtttggagtgcactacatcgtgttcatggccaccccctacacagaggtgtctggcaccctgtggcaggtgcagatgcactatgagatgctgttcaacagcttccagggcttctttgtggccatcatctactgcttctgcaatggagaggtgcaggccgagatcaagaagtcctggagccgctggaccctggccctggacttcaagaggaaggcccggagcggcagcagcagctacagctatggccccatggtgagccacacctctgtgaccaacgtgggcccccgggtgggcctgggcctgcccctgagcccccggctgctgcccacagccacctag

SEQ ID NO: 36724 - DNA, 1002 bp, Artificial Sequence
  Description of Artificial Sequence: Synthetic coding sequence
atgggcacagcccgcatcgcccctggcctggccctgctgctgtgctgccctgtgctgagcagcgcctatgccctggtggatgctgatgatgtgatgaccaaggaggagcagatcttcctgctgcaccgggcccaggcccagtgtgagaagaggctgaaggaggtgctgcagaggcctgccagcatcatggagagtgacaagggctggaccagcgccagcaccagcggcaagcccaggaaggacaaggccagcggcaagctgtacccagagagcgaggaggacaaggaggcccccaccggcagccgctaccggggccggccctgcctgcctgagtgggaccacatcctgtgctggcccctgggcgcccctggagaggtggtggccgtgccctgcccagactacatctatgacttcaaccacaagggccacgcctaccgccgctgtgacagaaatggctcctgggagctggtgcccggccacaacagaacctgggccaactacagtgaatgtgtgaagttcctgaccaatgagacccgggagcgggaggtgtttgaccggctgggcatgatctacacagtgggctacagcgtgtccctggccagcctgactgtggccgtgctgatcctggcctacttccggcggctgcactgcaccaggaactacatccacatgcacctgttcctgtccttcatgctgcgggctgtgtccatctttgtgaaggatgctgtgctgtacagcggggccaccctggatgaagctgagcggctgacagaggaggagctgcgggccatcgcccaggcccctcctcctccagccacagctgctgctggctacgccggctgccgggtggccgtgaccttcttcctgtacttcctggccaccaactactactggatcctggtggagggcctgtacctgcacagcctcatcttcatggccttcttcagcgagaagaagtacctgtggggcttcaccgtgtttggctggggcgccggcacctag

SEQ ID NO: 36725 - DNA, 1782 bp, Artificial Sequence; identical to SEQ ID NO: 36721
  Description of Artificial Sequence: Synthetic coding sequence

SEQ ID NO: 36726 - DNA, 1782 bp, Artificial Sequence; identical to SEQ ID NO: 36721
  Description of Artificial Sequence: Synthetic coding sequence

SEQ ID NO: 36727 - DNA, 1653 bp, Artificial Sequence
  Description of Artificial Sequence: Synthetic coding sequence
atggccggcctgggcgccagcctgcacgtgtggggctggctgatgctgggcagctgcctgctggcccgggcccagctggacagtgatggcaccatcaccatcgaggagcagatcgtgctggtgctgaaggccaaggtgcagtgtgagctgaacatcacagcccagctgcaggagggggagggcaactgcttccctgagtgggatggcctcatctgctggccccggggcaccgtgggcaagatctctgctgtgccctgccccccctacatctatgacttcaaccacaagggcgtggccttccgccactgcaaccccaacggcacctgggacttcatgcacagcctgaacaagacctgggccaactacagcgactgcctgcgcttcctgcagcctgacatcagcatcggcaagcaggagttctttgagcggctgtatgtgatgtacacagtgggctacagcatcagctttggcagcctggccgtggccatcctgatcatcggctacttccggcggctgcactgcaccaggaactacatccacatgcacctgtttgtgtccttcatgctgcgggccaccagcatctttgtgaaggacagagtggtgcacgcccacatcggcgtgaaggagctggagagcctcatcatgcaggatgacccccagaacagcattgaggccacctctgtggacaagagccagtacatcggctgcaagattgctgtggtgatgttcatctacttcctggccaccaactactactggatcctggtggagggcctgtacctgcacaacctgatctttgtggccttcttcagtgacaccaagtacctgtggggcttcatcctgattggctggggcttccctgctgcctttgtggccgcctgggccgtggcccgggccaccctggctgatgcccgctgctgggagctgtctgctggggacatcaagtggatctaccaggcccccatcctggccgccatcggcctgaacttcatcctcttcctgaacacagtgcgggtgctggccaccaagatctgggagaccaatgctgtgggccatgacaccaggaagcagtacaggaagctggccaagagcaccctggtgctggtgctggtgtttggagtgcactacatcgtgtttgtgtgcctgccccacagcttcaccggcctgggctgggagatccgcatgcactgtgagctgttcttcaacagcttccagggcttctttgtgtccatcatctactgctactgcaatggagaggtgcaggccgaggtgaagaagatgtggagccgctggaacctgtctgtggactggaagaggaccccaccctgtggcagccgccgctgtggctctgtgctgaccaccgtgacccacagcaccagcagccagagccaggtggccgccagcaccaggatggtgctgatcagcggcaaggccgccaagatcgccagccggcagcctgacagccacatcaccctgcccggctacgtgtggagcaacagcgagcaggactgcctgccccacagcttccacgaggagaccaaggaggacagcggccggcagggagatgacatcctgatggagaagcccagccggcccatggagagcaacccagacacagagggctgccagggcgagacagaagatgtgctgtag

SEQ ID NO: 36728 - DNA, 345 bp, Artificial Sequence
  Description of Artificial Sequence: Synthetic coding sequence
atgtctgccctgagcctgctgatcctgggcctgctgacagctgtgcccccagccagctgccagcagggcctgggcaacctgcagccctggatgcagggcctgattgctgtggccgtgttcctggtgctggtggccatcgcctttgctgtgaaccacttctggtgccaggaggagcctgagcccgcccacatgatcctgactgtgggcaacaaggcagatggagtgctggtgggcacagatggccgctacagctccatggccgccagcttccgcagcagcgagcatgaaaatgcctatgaaaatgtgcctgaggaggagggcaaggtgcgcagcacccccatgtag

SEQ ID NO: 36729 - DNA, 345 bp, Artificial Sequence; identical to SEQ ID NO: 36728
  Description of Artificial Sequence: Synthetic coding sequence

SEQ ID NO: 36730 - DNA, 6810 bp, Artificial Sequence
  Description of Artificial Sequence: Synthetic coding sequence
atgggcagccagaccctgcagatcctgcggcagggcgtgtgggccgccctgagcggcggctggtactatgacccccaccaggccacctttgtgaatgccctgcacctgtacctgtggctgttcctgctgggcctgcccttcaccctgtacatggccctgcccagcaccatgatcatcgtggccgtgtactgccctgtgattgctgctgtgttcatcgtgctgaagatggtgaactaccgcctgcaccgggccctggatgctggggaggtggtggacagaacagccaatgagttcacagaccagaggaccaaggccgagcagggcaactgcagcaccaggaggaaggacagcaatggccccagcgaccccggcggcggcatcgagatgtctgagttcatccgggaggccaccccacctgtgggctgcagcagcagaaattcctatgccggcctggaccccagcaaccagatcggcagcggcagcagccggctgggcacagctgccaccatcaagggggacacagacacagccaagaccagtgatgacatcagcctgagcctgggccagagcagcagcctgtgcaaggagggcagcgaggagcaggacctggccgctgacaggaagctgttccggctggtgtccaatgacagcttcatcagcatccagcccagcctgagcagctgtggccaggacctgccccgggacttcagtgacaaggtgaacctgcccagccacaaccaccaccaccacgtggaccagagcctgagcagcgcctgtgacacagaggtggccagcctggtgcccctgcacagccacagctacaggaaggaccaccggccccggggcgtgcccaggaccagcagcagcgctgtggccttcccagacaccagcctgaatgacttccccctgtaccagcagaggcggggcctggaccctgtgtctgagctggagagcagcaagcccctgagcggcagcaaggagagcctggtggagaacagcggcctgagcggggagttccagctggccggggacctgaagatcaacaccagccagccccccaccaagagcggcaagagcaagcccctgaaggccgagaagtccatggacagcctgcggagcctgagcaccaggagcagcggcagcacagagagctactgcagcggcacagaccgggacaccaacagcacagtgtcctcctacaagtctgagcagaccagcagcacccacatcgagagcatcctgtctgaacatgaggagagccccaaggccggcaccaagagcggcaggaagaaggagtgctgtgccggccctgaggagaagaacagctgtgccagtgacaagaggaccagcagcgagaagatcgccatggaggccagcaccaacagcggcgtgcatgaggccaaggaccccacccccagtgatgagatgcacaaccagaggggcctgagcaccagcgccagcgaggaggccaacaagaacccccacgccaatgagttcaccagccagggcgaccggcccccaggcaacacagctgagaacaaggaggagaagagtgacaagtctgctgtgtctgtggacagcaaggtgaggaaggatgtgggcggcaagcagaaggagggagatgtgcggcccaagagcagcagcgtcatccacaggacagccagcgcccacaagtctggaagaagaagaacaggcaagaagagggccagcagctttgacagcagccgccaccgggactatgtgtgcttccggggcgtgtctggcaccaagccccacagcgccatcttctgccatgatgaggacagcagtgaccagagcgacctgagccgggccagctctgtgcagagcgcccaccagttcagcagtgacagcagcagcagcaccaccagccacagctgccagagccctgagggccgctacagcgccctgaagaccaagcacacccacaaggagcggggcacagacagcgagcacacccacaaggcccacctggtgcctgagggcaccagcaagaagagggccaccaggaggaccagcagcaccaacagcgccaagacccgggcccgggtgctgagcctggacagcggcaccgtggcctgcctgaatgacagcaaccggctgatggcccctgagagcatcaagcccctgaccaccagcaagagtgacctggaggccaaggagggggaggtgctggatgagctgagcctgctgggccgggccagccagctggagaccgtgaccaggagcaggaacagcctgcccaaccaggtggccttccctgagggggaggagcaggatgctgtgtctggagctgcccaggccagcgaggaggccgtgtccttccggcgggagaggagcaccttccggcggcaggccgtgagaagaagacacaatgccggcagcaaccccaccccacccaccctgctgattggcagccccctgagcctgcaggacggccagcagggccagcagagcacagcccaggtgaaggtgcagagcaggcctcccagccaggccgctgtgctgagcgccagcgccagcctgctggtgagaaatggatctgtgcacctggaggccagccatgacaatgccagcgctgtgggcggcagcagcctgcatgatgagctgggcaagttcagcagcaccctgtatgagaccggcggctgtgacatgagcctggtgaactttgagcctgctgcccggcgggccagcaacatctgtgacacagacagccacgtgagcagcagcacctctgtgcgcttctacccccatgatgtgctgagcctgccccagatccggctgaaccggctgctgaccatcgacacagacctgctggagcagcaggacatcgacctgagcccagacctggccgccacctacggccccacagaggaggccgcccagaaggtgaagcactactaccgcttctggatcctgccccagctgtggattggcatcaactttgaccggctgaccctgctggccctgtttgacaggaaccgggagatcctggagaatgtgctggccgtcatcctggccatcctggtggccttcctgggcagcatcctgctgatccagggcttcttccgggacatctgggtgttccagttctgcctggtgattgccagctgccagtacagcctgctgaagtctgtgcagcctgacagcagcagccccaggcatggccacaaccgcatcatcgcctacagcaggcctgtgtacttctgcatctgctgcggcctcatctggctgctggactatggcagcaggaacctgacagccaccaagttcaagctgtatggcatcaccttcaccaaccccctggtgttcatcagcgcccgggacctggtgattgtgttcaccctgtgcttccccatcgtgttcttcatcggcctgctgccccaggtgaacacctttgtgatgtacctgtgtgagcagctggacatccacatctttggaggaaatgccaccaccagcctgctggccgccctgtacagcttcatctgcagcatcgtggccgtggccctgctgtatggcctgtgctacggggccctgaaggacagctgggatggccagcacatccctgtgctcttcagcatcttctgtggcctgctggtggccgtgtcctaccacctgagccggcagagcagtgaccccagcgtgctcttcagcctggtgcagagcaagatcttccccaagacagaggagaagaaccctgaggaccccctgtctgaggtgaaggaccccctgcctgagaagctgagaaattctgtgtctgagcggctgcagagcgacctggtggtgtgcatcgtcatcggcgtgctgtactttgccatccacgtgtccacagtgttcaccgtgctgcagcctgccctgaagtatgtgctgtacaccctggtgggctttgtgggctttgtgacccactacgtgctgccccaggtgaggaagcagctgccctggcactgcttcagccaccccctgctgaagaccctggagtacaaccagtatgaggtgagaaatgctgccaccatgatgtggtttgagaagctgcacgtgtggctgctgtttgtggagaagaacatcatctaccccctcatcgtgctgaatgagctgagcagcagcgctgagaccatcgccagccccaagaagctgaacacagagctgggcgccctgatgatcaccgtggccggcctgaagctgctgcggagcagcttcagcagccccacctaccagtatgtgaccgtcatcttcaccgtgctcttcttcaagtttgattatgaggccttcagcgagaccatgctgctggacctcttcttcatgagcatcctcttcaacaagctgtgggagctgctgtacaagctgcagtttgtgtacacctacatcgccccctggcagatcacctggggcagcgccttccacgcctttgcccagccctttgctgtgccccacagcgccatgctgttcatccaggccgctgtgtctgccttcttcagcacccccctgaaccccttcctgggcagcgccatcttcatcaccagctatgtgcggcctgtgaagttctgggagcgggactacaacaccaagagggtggaccacagcaacacccggctggccagccagctggacagaaatcctggcacctactgccagcagcgggaggtggaggccatcacagagggcgtggaggaggatgagggcttctgctgctgtgagcccggccacatcccccacatgctgtccttcaatgctgccttcagccagcgctggctggcctgggaggtgattgtgaccaagtacatcctggagggctacagcatcacagacaacagcgctgcctccatgctgcaggtgtttgacctgaggaaggtgctgaccacctactacgtgaagggcatcatctactacgtgaccaccagcagcaagctggaggagtggctggccaatgagaccatgcaggagggcctgcggctgtgtgccgacagaaattatgtggatgtggaccccaccttcaaccccaacattgatgaggactatgaccaccggctggccggcatcagccgggagagcttctgtgtgatctacctgaactggattgagtactgcagcagccggcgggccaagcctgtggatgtggacaaggacagcagcctggtgaccctgtgctacggcctgtgtgtgctgggcagaagagccctgggcacagccagccaccacatgagcagcaacctggagagcttcctgtatggcctgcacgccctcttcaagggggacttccgcatcagcagcatcagagatgagtggatctttgctgacatggagctgctgaggaaggtggtggtgcccggcatccgcatgagcatcaagctgcaccaggaccacttcaccagcccagatgaatatgatgaccccaccgtgctgtatgaggccatcgtgtcccatgagaagaacctggtgattgcccatgaaggagaccctgcctggaggtctgctgtgctggccaacagccccagcctgctggccctgcggcacgtgatggatgatggcaccaatgagtacaagatcatcatgctgaacagacgctacctgtccttccgggtcatcaaggtgaacaaggaatgtgtgcggggcctgtgggccggccagcagcaggagctggtgttcctgaggaacagaaatcctgagcggggcagcatccagaatgccaagcaggccctgaggaacatgatcaacagcagctgtgaccagcccatcggctaccccatctttgtgagccccctgaccaccagctacagcgacagccatgagcagctgaaggacatcctgggcggccccatcagcctgggcaacatccggaacttcatcgtgtccacctggcaccggctgaggaagggctgtggggccggctgcaacagcggcggcaacatcgaggacagcgacaccggcggcggcaccagctgcaccggcaacaatgccaccacagccaacaacccccacagcaatgtgacccagggcagcatcggcaaccctggccagggcagcggcaccggcctgcacccccctgtgaccagctacccacccaccctgggcaccagccacagcagccacagcgtgcagagcggcctggtgcggcagagccctgcccgggcctctgtggccagccagagcagctactgctacagcagccgccacagcagcctgaggatgagcaccactggatttgtgccctgcagaagaagcagcaccagccagatcagcctgaggaacctgcccagcagcatccagagccggctgtccatggtgaaccagatggagcccagcggccagagcggcctggcctgtgtgcagcacggcctgcccagcagcagcagcagcagccagagcatcccagcctgcaagcaccacaccctggtgggcttcctggccacagagggcggccagagcagcgccacagatgcccagcccggcaacaccctgagccctgccaacaacagccacagcaggaaggccgaggtgatctacagagtgcagatcgtggaccccagccagatcctggagggcatcaacctgagcaagaggaaggagctgcagtggccagatgagggcatccggctgaaggccggcaggaacagctggaaggactggagcccccaggagggcatggagggccacgtgatccaccgctgggtgccctgcagccgggaccccggcaccaggagccacatcgacaaggctgtgctgctggtgcagattgatgacaagtatgtgaccgtcatcgagaccggggtgctggagctgggcgctgaggtgtag

SEQ ID NO: 36731 - DNA, 7026 bp, Artificial Sequence
  Description of Artificial Sequence: Synthetic coding sequence
atgggcagccagaccctgcagatcctgcggcagggcgtgtgggccgccctgagcggcggctggtactatgacccccaccaggccacctttgtgaatgccctgcacctgtacctgtggctgttcctgctgggcctgcccttcaccctgtacatggccctgcccagcaccatgatcatcgtggccgtgtactgccctgtgattgctgctgtgttcatcgtgctgaagatggtgaactaccgcctgcaccgggccctggatgctggggaggtggtggacagaacagccaatgagttcacagaccagaggaccaaggccgagcagggcaactgcagcaccaggaggaaggacagcaatggccccagcgaccccggcggcggcatcgagatgtctgagttcatccgggaggccaccccacctgtgggctgcagcagcagaaattcctatgccggcctggaccccagcaaccagatcggcagcggcagcagccggctgggcacagctgccaccatcaagggggacacagacacagccaagaccagtgatgacatcagcctgagcctgggccagagcagcagcctgtgcaaggagggcagcgaggagcaggacctggccgctgacaggaagctgttccggctggtgtccaatgacagcttcatcagcatccagcccagcctgagcagctgtggccaggacctgccccgggacttcagtgacaaggtgaacctgcccagccacaaccaccaccaccacgtggaccagagcctgagcagcgcctgtgacacagaggtggccagcctggtgcccctgcacagccacagctacaggaaggaccaccggccccggggcgtgcccaggaccagcagcagcgctgtggccttcccagacaccagcctgaatgacttccccctgtaccagcagaggcggggcctggaccctgtgtctgagctggagagcagcaagcccctgagcggcagcaaggagagcctggtggagaacagcggcctgagcggggagttccagctggccggggacctgaagatcaacaccagccagccccccaccaagagcggcaagagcaagcccctgaaggccgagaagtccatggacagcctgcggagcctgagcaccaggagcagcggcagcacagagagctactgcagcggcacagaccgggacaccaacagcacagtgtcctcctacaagtctgagcagaccagcagcacccacatcgagagcatcctgtctgaacatgaggagagccccaaggccggcaccaagagcggcaggaagaaggagtgctgtgccggccctgaggagaagaacagctgtgccagtgacaagaggaccagcagcgagaagatcgccatggaggccagcaccaacagcggcgtgcatgaggccaaggaccccacccccagtgatgagatgcacaaccagaggggcctgagcaccagcgccagcgaggaggccaacaagaacccccacgccaatgagttcaccagccagggcgaccggcccccaggcaacacagctgagaacaaggaggagaagagtgacaagtctgctgtgtctgtggacagcaaggtgaggaaggatgtgggcggcaagcagaaggagggagatgtgcggcccaagagcagcagcgtcatccacaggacagccagcgcccacaagtctggaagaagaagaacaggcaagaagagggccagcagctttgacagcagccgccaccgggactatgtgtgcttccggggcgtgtctggcaccaagccccacagcgccatcttctgccatgatgaggacagcagtgaccagagcgacctgagccgggccagctctgtgcagagcgcccaccagttcagcagtgacagcagcagcagcaccaccagccacagctgccagagccctgagggccgctacagcgccctgaagaccaagcacacccacaaggagcggggcacagacagcgagcacacccacaaggcccacctggtgcctgagggcaccagcaagaagagggccaccaggaggaccagcagcaccaacagcgccaagacccgggcccgggtgctgagcctggacagcggcaccgtggcctgcctgaatgacagcaaccggctgatggcccctgagagcatcaagcccctgaccaccagcaagagtgacctggaggccaaggagggggaggtgctggatgagctgagcctgctgggccgggccagccagctggagaccgtgaccaggagcaggaacagcctgcccaaccaggtggccttccctgagggggaggagcaggatgctgtgtctggagctgcccaggccagcgaggaggccgtgtccttccggcgggagaggagcaccttccggcggcaggccgtgagaagaagacacaatgccggcagcaaccccaccccacccaccctgctgattggcagccccctgagcctgcaggacggccagcagggccagcagagcacagcccaggtgaaggtgcagagcaggcctcccagccaggccgctgtgctgagcgccagcgccagcctgctggtgagaaatggatctgtgcacctggaggccagccatgacaatgccagcgctgtgggcggcagcagcctgcatgatgagctgggcaagttcagcagcaccctgtatgagaccggcggctgtgacatgagcctggtgaactttgagcctgctgcccggcgggccagcaacatctgtgacacagacagccacgtgagcagcagcacctctgtgcgcttctacccccatgatgtgctgagcctgccccagatccggctgaaccggctgctgaccatcgacacagacctgctggagcagcaggacatcgacctgagcccagacctggccgccacctacggccccacagaggaggccgcccagaaggtgaagcactactaccgcttctggatcctgccccagctgtggattggcatcaactttgaccggctgaccctgctggccctgtttgacaggaaccgggagatcctggagaatgtgctggccgtcatcctggccatcctggtggccttcctgggcagcatcctgctgatccagggcttcttccgggacatctgggtgttccagttctgcctggtgattgccagctgccagtacagcctgctgaagtctgtgcagcctgacagcagcagccccaggcatggccacaaccgcatcatcgcctacagcaggcctgtgtacttctgcatctgctgcggcctcatctggctgctggactatggcagcaggaacctgacagccaccaagttcaagctgtatggcatcaccttcaccaaccccctggtgttcatcagcgcccgggacctggtgattgtgttcaccctgtgcttccccatcgtgttcttcatcggcctgctgccccaggtgaacacctttgtgatgtacctgtgtgagcagctggacatccacatctttggaggaaatgccaccaccagcctgctggccgccctgtacagcttcatctgcagcatcgtggccgtggccctgctgtatggcctgtgctacggggccctgaaggacagctgggatggccagcacatccctgtgctcttcagcatcttctgtggcctgctggtggccgtgtcctaccacctgagccggcagagcagtgaccccagcgtgctcttcagcctggtgcagagcaagatcttccccaagacagaggagaagaaccctgaggaccccctgtctgaggtgaaggaccccctgcctgagaagctgagaaattctgtgtctgagcggctgcagagcgacctggtggtgtgcatcgtcatcggcgtgctgtactttgccatccacgtgtccacagtgttcaccgtgctgcagcctgccctgaagtatgtgctgtacaccctggtgggctttgtgggctttgtgacccactacgtgctgccccaggtgaggaagcagctgccctggcactgcttcagccaccccctgctgaagaccctggagtacaaccagtatgaggtgagaaatgctgccaccatgatgtggtttgagaagctgcacgtgtggctgctgtttgtggagaagaacatcatctaccccctcatcgtgctgaatgagctgagcagcagcgctgagaccatcgccagccccaagaagctgaacacagagctgggcgccctgatgatcaccgtggccggcctgaagctgctgcggagcagcttcagcagccccacctaccagtatgtgaccgtcatcttcaccgtgctcttcttcaagtttgattatgaggccttcagcgagaccatgctgctggacctcttcttcatgagcatcctcttcaacaagctgtgggagctgctgtacaagctgcagtttgtgtacacctacatcgccccctggcagatcacctggggcagcgccttccacgcctttgcccagccctttgctgtgccccacagcgccatgctgttcatccaggccgctgtgtctgccttcttcagcacccccctgaaccccttcctgggcagcgccatcttcatcaccagctatgtgcggcctgtgaagttctgggagcgggactacaacaccaagagggtggaccacagcaacacccggctggccagccagctggacagaaatcctggcagtgatgacaacaacctgaacagcatcttctatgagcacctgaccaggagcctgcagcacagcctgtgtggggacctgctgctgggccgctggggcaactacagcactggagactgcttcatcctggccagtgactacctgaatgccctggtgcacctgattgaaattggaaatggcctggtgaccttccagctgcggggcctggagttccggggcacctactgccagcagcgggaggtggaggccatcacagagggcgtggaggaggatgagggcttctgctgctgtgagcccggccacatcccccacatgctgtccttcaatgctgccttcagccagcgctggctggcctgggaggtgattgtgaccaagtacatcctggagggctacagcatcacagacaacagcgctgcctccatgctgcaggtgtttgacctgaggaaggtgctgaccacctactacgtgaagggcatcatctactacgtgaccaccagcagcaagctggaggagtggctggccaatgagaccatgcaggagggcctgcggctgtgtgccgacagaaattatgtggatgtggaccccaccttcaaccccaacattgatgaggactatgaccaccggctggccggcatcagccgggagagcttctgtgtgatctacctgaactggattgagtactgcagcagccggcgggccaagcctgtggatgtggacaaggacagcagcctggtgaccctgtgctacggcctgtgtgtgctgggcagaagagccctgggcacagccagccaccacatgagcagcaacctggagagcttcctgtatggcctgcacgccctcttcaagggggacttccgcatcagcagcatcagagatgagtggatctttgctgacatggagctgctgaggaaggtggtggtgcccggcatccgcatgagcatcaagctgcaccaggaccacttcaccagcccagatgaatatgatgaccccaccgtgctgtatgaggccatcgtgtcccatgagaagaacctggtgattgcccatgaaggagaccctgcctggaggtctgctgtgctggccaacagccccagcctgctggccctgcggcacgtgatggatgatggcaccaatgagtacaagatcatcatgctgaacagacgctacctgtccttccgggtcatcaaggtgaacaaggaatgtgtgcggggcctgtgggccggccagcagcaggagctggtgttcctgaggaacagaaatcctgagcggggcagcatccagaatgccaagcaggccctgaggaacatgatcaacagcagctgtgaccagcccatcggctaccccatctttgtgagccccctgaccaccagctacagcgacagccatgagcagctgaaggacatcctgggcggccccatcagcctgggcaacatccggaacttcatcgtgtccacctggcaccggctgaggaagggctgtggggccggctgcaacagcggcggcaacatcgaggacagcgacaccggcggcggcaccagctgcaccggcaacaatgccaccacagccaacaacccccacagcaatgtgacccagggcagcatcggcaaccctggccagggcagcggcaccggcctgcacccccctgtgaccagctacccacccaccctgggcaccagccacagcagccacagcgtgcagagcggcctggtgcggcagagccctgcccgggcctctgtggccagccagagcagctactgctacagcagccgccacagcagcctgaggatgagcaccactggatttgtgccctgcagaagaagcagcaccagccagatcagcctgaggaacctgcccagcagcatccagagccggctgtccatggtgaaccagatggagcccagcggccagagcggcctggcctgtgtgcagcacggcctgcccagcagcagcagcagcagccagagcatcccagcctgcaagcaccacaccctggtgggcttcctggccacagagggcggccagagcagcgccacagatgcccagcccggcaacaccctgagccctgccaacaacagccacagcaggaaggccgaggtgatctacagagtgcagatcgtggaccccagccagatcctggagggcatcaacctgagcaagaggaaggagctgcagtggccagatgagggcatccggctgaaggccggcaggaacagctggaaggactggagcccccaggagggcatggagggccacgtgatccaccgctgggtgccctgcagccgggaccccggcaccaggagccacatcgacaaggctgtgctgctggtgcagattgatgacaagtatgtgaccgtcatcgagaccggggtgctggagctgggcgctgaggtgtag

SEQ ID NO: 36732 - DNA, 6693 bp, Artificial Sequence
  Description of Artificial Sequence: Synthetic coding sequence
atgggcagccagaccctgcagatcctgcggcagggcgtgtgggccgccctgagcggcggctggtactatgacccccaccaggccacctttgtgaatgccctgcacctgtacctgtggctgttcctgctgggcctgcccttcaccctgtacatggccctgcccagcaccatgatcatcgtggccgtgtactgccctgtgattgctgctgtgttcatcgtgctgaagatggtgaactaccgcctgcaccgggccctggatgctggggaggtggtggacagaacagccaatgagttcacagaccagaggaccaaggccgagcagggcaactgcagcaccaggaggaaggacagcaatggccccagcgaccccggcggcggcatcgagatgtctgagttcatccgggaggccaccccacctgtgggctgcagcagcagaaattcctatgccggcctggaccccagcaaccagatcggcagcggcagcagccggctgggcacagctgccaccatcaagggggacacagacacagccaagaccagtgatgacatcagcctgagcctgggccagagcagcagcctgtgcaaggagggcagcgaggagcaggacctggccgctgacaggaagctgttccggctggtgtccaatgacagcttcatcagcatccagcccagcctgagcagctgtggccaggacctgccccgggacttcagtgacaaggtgaacctgcccagccacaaccaccaccaccacgtggaccagagcctgagcagcgcctgtgacacagaggtggccagcctggtgcccctgcacagccacagctacaggaaggaccaccggccccggggcgtgcccaggaccagcagcagcgctgtggccttcccagacaccagcctgaatgacttccccctgtaccagcagaggcggggcctggaccctgtgtctgagctggagagcagcaagcccctgagcggcagcaaggagagcctggtggagaacagcggcctgagcggggagttccagctggccggggacctgaagatcaacaccagccagccccccaccaagagcggcaagagcaagcccctgaaggccgagaagtccatggacagcctgcggagcctgagcaccaggagcagcggcagcacagagagctactgcagcggcacagaccgggacaccaacagcacagtgtcctcctacaagtctgagcagaccagcagcacccacatcgagagcatcctgtctgaacatgaggagagccccaaggccggcaccaagagcggcaggaagaaggagtgctgtgccggccctgaggagaagaacagctgtgccagtgacaagaggaccagcagcgagaagatcgccatggaggccagcaccaacagcggcgtgcatgaggccaaggaccccacccccagtgatgagatgcacaaccagaggggcctgagcaccagcgccagcgaggaggccaacaagaacccccacgccaatgagttcaccagccagggcgaccggcccccaggcaacacagctgagaacaaggaggagaagagtgacaagtctgctgtgtctgtggacagcaaggtgaggaaggatgtgggcggcaagcagaaggagggagatgtgcggcccaagagcagcagcgtcatccacaggacagccagcgcccacaagtctggaagaagaagaacaggcaagaagagggccagcagctttgacagcagccgccaccgggactatgtgtgcttccggggcgtgtctggcaccaagccccacagcgccatcttctgccatgatgaggacagcagtgaccagagcgacctgagccgggccagctctgtgcagagcgcccaccagttcagcagtgacagcagcagcagcaccaccagccacagctgccagagccctgagggccgctacagcgccctgaagaccaagcacacccacaaggagcggggcacagacagcgagcacacccacaaggcccacctggtgcctgagggcaccagcaagaagagggccaccaggaggaccagcagcaccaacagcgccaagacccgggcccgggtgctgagcctggacagcggcaccgtggcctgcctgaatgacagcaaccggctgatggcccctgagagcatcaagcccctgaccaccagcaagagtgacctggaggccaaggagggggaggtgctggatgagctgagcctgctgggccgggccagccagctggagaccgtgaccaggagcaggaacagcctgcccaaccaggtggccttccctgagggggaggagcaggatgctgtgtctgggggcaagttcagcagcaccctgtatgagaccggcggctgtgacatgagcctggtgaactttgagcctgctgcccggcgggccagcaacatctgtgacacagacagccacgtgagcagcagcacctctgtgcgcttctacccccatgatgtgatccggctgaaccggctgctgaccatcgacacagacctgctggagcagcaggacatcgacctgagcccagacctggccgccacctacggccccacagaggaggccgcccagaaggtgaagcactactaccgcttctggatcctgccccagctgtggattggcatcaactttgaccggctgaccctgctggccctgtttgacaggaaccgggagatcctggagaatgtgctggccgtcatcctggccatcctggtggccttcctgggcagcatcctgctgatccagggcttcttccgggacatctgggtgttccagttctgcctggtgattgccagctgccagtacagcctgctgaagtctgtgcagcctgacagcagcagccccaggcatggccacaaccgcatcatcgcctacagcaggcctgtgtacttctgcatctgctgcggcctcatctggctgctggactatggcagcaggaacctgacagccaccaagttcaagctgtatggcatcaccttcaccaaccccctggtgttcatcagcgcccgggacctggtgattgtgttcaccctgtgcttccccatcgtgttcttcatcggcctgctgccccaggtgaacacctttgtgatgtacctgtgtgagcagctggacatccacatctttggaggaaatgccaccaccagcctgctggccgccctgtacagcttcatctgcagcatcgtggccgtggccctgctgtatggcctgtgctatggagccctgaaggacagctgggatggccagcacatccctgtgctcttcagcatcttctgtggcctgctggtggccgtgtcctaccacctgagccggcagagcagtgaccccagcgtgctcttcagcctggtgcagagcaagatcttccccaagacagaggagaagaaccctgaggaccccctgtctgaggtgaaggaccccctgcctgagaagctgaggaacagcgtgtctgagcggctgcagagcgacctggtggtgtgcatcgtgattggagtgctgtactttgccatccacgtgtccaccgtcttcaccgtgctgcagcctgccctgaagtatgtgctgtacaccctggtgggctttgtgggctttgtgacccactacgtgctgccccaggtgaggaagcagctgccctggcactgcttcagccaccccctgctgaagaccctggagtacaaccagtatgaggtgagaaatgctgccaccatgatgtggtttgagaagctgcacgtgtggctgctgtttgtggagaagaacatcatctaccccctgattgtgctgaatgagctgagcagcagcgctgagaccatcgccagccccaagaagctgaacacagagctgggcgccctgatgatcaccgtggccggcctgaagctgctgcggagcagcttcagcagccccacctaccagtatgtgaccgtcatcttcaccgtgctcttcttcaagtttgattatgaggccttcagcgagaccatgctgctggacctcttcttcatgagcatcctcttcaacaagctgtgggagctgctgtacaagctgcagtttgtgtacacctacatcgccccctggcagatcacctggggcagcgccttccacgcctttgcccagccctttgctgtgccccacagcgccatgctgttcatccaggccgctgtgtctgccttcttcagcacccccctgaaccccttcctgggcagcgccatcttcatcaccagctatgtgcggcctgtgaagttctgggagcgggactacaacaccaagagggtggaccacagcaacacccggctggccagccagctggacaggaaccctggcagtgatgacaacaacctgaacagcatcttctatgagcacctgaccaggagcctgcagcacagcctgtgtggggacctgctgctgggccgctggggcaactacagcactggagactgcttcatcctggccagtgactacctgaatgccctggtgcacctgattgaaattggaaatggcctggtgaccttccagctgcggggcctggagttccggggcacctactgccagcagcgggaggtggaggccatcacagaaggagtggaggaggatgagggcttctgctgctgtgagcccggccacatcccccacatgctgtccttcaatgctgccttcagccagcgctggctggcctgggaggtgattgtgaccaagtacatcctggagggctacagcatcacagacaacagcgctgcctccatgctgcaggtgtttgacctgaggaaggtgctgaccacctactacgtgaagggcatcatctactacgtgaccaccagcagcaagctggaggagtggctggccaatgagaccatgcaggagggcctgcggctgtgtgccgacaggaactacgtggatgtggaccccaccttcaaccccaacattgatgaagattatgaccaccggctggccggcatcagccgggagagcttctgtgtgatctacctgaactggattgagtactgcagcagcagaagagccaagcctgtggatgtggacaaggacagcagcctggtgaccctgtgctacggcctgtgtgtgctgggccggcgggccctgggcacagccagccaccacatgagcagcaacctggagagcttcctgtatggcctgcacgccctcttcaagggggacttccgcatcagcagcatcagagatgagtggatctttgctgacatggagctgctgaggaaggtggtggtgcccggcatccgcatgagcatcaagctgcaccaggaccacttcaccagcccagatgaatatgatgaccccaccgtgctgtatgaggccatcgtgtcccatgagaagaacctggtgattgcccacgagggggaccctgcctggaggtctgctgtgctggccaacagccccagcctgctggccctgcggcacgtgatggatgatggcaccaatgagtacaagatcatcatgctgaacagacgctacctgtccttccgggtcatcaaggtgaacaaggaatgtgtgcggggcctgtgggccggccagcagcaggagctggtgttcctgaggaacagaaatcctgagcggggcagcatccagaatgccaagcaggccctgaggaacatgatcaacagcagctgtgaccagcccatcggctaccccatctttgtgagccccctgaccaccagctacagcgacagccatgagcagctgaaggacatcctgggcggccccatcagcctgggcaacatccggaacttcatcgtgtccacctggcaccggctgaggaagggctgtggggccggctgcaacagcggcggcaacattgaagattctgacacaggaggcggcaccagctgcaccggcaacaatgccaccacagccaacaacccccacagcaatgtgacccagggcagcatcggcaaccctggccagggcagcggcaccggcctgcacccccctgtgaccagctacccacccaccctgggcaccagccacagcagccacagcgtgcagagcggcctggtgcggcagagccctgcccgggcctctgtggccagccagagcagctactgctacagcagccgccacagcagcctgaggatgagcaccaccggctttgtgccctgccgccgcagcagcaccagccagatcagcctgaggaacctgcccagcagcatccagagccggctgtccatggtgaaccagatggagcccagcggccagagcggcctggcctgtgtgcagcacggcctgcccagcagcagcagcagcagccagagcatcccagcctgcaagcaccacaccctggtgggcttcctggccacagaaggaggccagagcagcgccacagatgcccagcccggcaacaccctgagccctgccaacaacagccacagcaggaaggccgaggtgatctacagagtgcagatcgtggaccccagccagatcctggagggcatcaacctgagcaagaggaaggagctgcagtggccagatgagggcatccggctgaaggccggcagaaattcctggaaggactggagcccccaggagggcatggagggccacgtgatccaccgctgggtgccctgcagccgggaccccggcaccaggagccacatcgacaaggctgtgctgctggtgcagattgatgacaagtatgtgacagtgattgaaacaggagtgctggagctgggcgctgaggtgtag

SEQ ID NO: 36733 - DNA, 3987 bp, Artificial Sequence
  Description of Artificial Sequence: Synthetic coding sequence
tgagacctgctggagcagcaggacatcgacctgagcccagacctggccgccacctacggccccacagaggaggccgcccagaaggtgaagcactactaccgcttctggatcctgccccagctgtggattggcatcaactttgaccggctgaccctgctggccctgtttgacaggaaccgggagatcctggagaatgtgctggccgtcatcctggccatcctggtggccttcctgggcagcatcctgctgatccagggcttcttccgggacatctgggtgttccagttctgcctggtgattgccagctgccagtacagcctgctgaagtctgtgcagcctgacagcagcagccccaggcatggccacaaccgcatcatcgcctacagcaggcctgtgtacttctgcatctgctgcggcctcatctggctgctggactatggcagcaggaacctgacagccaccaagttcaagctgtatggcatcaccttcaccaaccccctggtgttcatcagcgcccgggacctggtgattgtgttcaccctgtgcttccccatcgtgttcttcatcggcctgctgccccaggtgaacacctttgtgatgtacctgtgtgagcagctggacatccacatctttggaggaaatgccaccaccagcctgctggccgccctgtacagcttcatctgcagcatcgtggccgtggccctgctgtatggcctgtgctatggagccctgaaggacagctgggatggccagcacatccctgtgctcttcagcatcttctgtggcctgctggtggccgtgtcctaccacctgagccggcagagcagtgaccccagcgtgctcttcagcctggtgcagagcaagatcttccccaagacagaggagaagaaccctgaggaccccctgtctgaggtgaaggaccccctgcctgagaagctgaggaacagcgtgtctgagcggctgcagagcgacctggtggtgtgcatcgtgattggagtgctgtactttgccatccacgtgtccaccgtcttcaccgtgctgcagcctgccctgaagtatgtgctgtacaccctggtgggctttgtgggctttgtgacccactacgtgctgccccaggtgaggaagcagctgccctggcactgcttcagccaccccctgctgaagaccctggagtacaaccagtatgaggtgagaaatgctgccaccatgatgtggtttgagaagctgcacgtgtggctgctgtttgtggagaagaacatcatctaccccctgattgtgctgaatgagctgagcagcagcgctgagaccatcgccagccccaagaagctgaacacagagctgggcgccctgatgatcaccgtggccggcctgaagctgctgcggagcagcttcagcagccccacctaccagtatgtgaccgtcatcttcaccgtgctcttcttcaagtttgattatgaggccttcagcgagaccatgctgctggacctcttcttcatgagcatcctcttcaacaagctgtgggagctgctgtacaagctgcagtttgtgtacacctacatcgccccctggcagatcacctggggcagcgccttccacgcctttgcccagccctttgctgtgccccacagcgccatgctgttcatccaggccgctgtgtctgccttcttcagcacccccctgaaccccttcctgggcagcgccatcttcatcaccagctatgtgcggcctgtgaagttctgggagcgggactacaacaccaagagggtggaccacagcaacacccggctggccagccagctggacaggaaccctggcacctactgccagcagcgggaggtggaggccatcacagaaggagtggaggaggatgagggcttctgctgctgtgagcccggccacatcccccacatgctgtccttcaatgctgccttcagccagcgctggctggcctgggaggtgattgtgaccaagtacatcctggagggctacagcatcacagacaacagcgctgcctccatgctgcaggtgtttgacctgaggaaggtgctgaccacctactacgtgaagggcatcatctactacgtgaccaccagcagcaagctggaggagtggctggccaatgagaccatgcaggagggcctgcggctgtgtgccgacaggaactacgtggatgtggaccccaccttcaaccccaacattgatgaagattatgaccaccggctggccggcatcagccgggagagcttctgtgtgatctacctgaactggattgagtactgcagcagcagaagagccaagcctgtggatgtggacaaggacagcagcctggtgaccctgtgctacggcctgtgtgtgctgggccggcgggccctgggcacagccagccaccacatgagcagcaacctggagagcttcctgtatggcctgcacgccctcttcaagggggacttccgcatcagcagcatcagagatgagtggatctttgctgacatggagctgctgaggaaggtggtggtgcccggcatccgcatgagcatcaagctgcaccaggaccacttcaccagcccagatgaatatgatgaccccaccgtgctgtatgaggccatcgtgtcccatgagaagaacctggtgattgcccacgagggggaccctgcctggaggtctgctgtgctggccaacagccccagcctgctggccctgcggcacgtgatggatgatggcaccaatgagtacaagatcatcatgctgaacagacgctacctgtccttccgggtcatcaaggtgaacaaggaatgtgtgcggggcctgtgggccggccagcagcaggagctggtgttcctgaggaacagaaatcctgagcggggcagcatccagaatgccaagcaggccctgaggaacatgatcaacagcagctgtgaccagcccatcggctaccccatctttgtgagccccctgaccaccagctacagcgacagccatgagcagctgaaggacatcctgggcggccccatcagcctgggcaacatccggaacttcatcgtgtccacctggcaccggctgaggaagggctgtggggccggctgcaacagcggcggcaacattgaagattctgacacaggaggcggcaccagctgcaccggcaacaatgccaccacagccaacaacccccacagcaatgtgacccagggcagcatcggcaaccctggccagggcagcggcaccggcctgcacccccctgtgaccagctacccacccaccctgggcaccagccacagcagccacagcgtgcagagcggcctggtgcggcagagccctgcccgggcctctgtggccagccagagcagctactgctacagcagccgccacagcagcctgaggatgagcaccaccggctttgtgccctgccgccgcagcagcaccagccagatcagcctgaggaacctgcccagcagcatccagagccggctgtccatggtgaaccagatggagcccagcggccagagcggcctggcctgtgtgcagcacggcctgcccagcagcagcagcagcagccagagcatcccagcctgcaagcaccacaccctggtgggcttcctggccacagaaggaggccagagcagcgccacagatgcccagcccggcaacaccctgagccctgccaacaacagccacagcaggaaggccgaggtgatctacagagtgcagatcgtggaccccagccagatcctggagggcatcaacctgagcaagaggaaggagctgcagtggccagatgagggcatccggctgaaggccggcagaaattcctggaaggactggagcccccaggagggcatggagggccacgtgatccaccgctgggtgccctgcagccgggaccccggcaccaggagccacatcgacaaggctgtgctgctggtgcagattgatgacaagtatgtgacagtgattgaaacaggagtgctggagctgggcgctgaggtgtag

SEQ ID NO: 36734 - DNA, 6414 bp, Artificial Sequence
  Description of Artificial Sequence: Synthetic coding sequence
atggtgtcccaggtgctgcagctgctgcggcagggcgtgtgggccgccctgaccggcggctggtaccatgaccctgagcagagcaagttcaccaacagctgccacctgtacctgtggctgttcctgctgctgctgcccctggccctgcacctggccttccccccaaatgccatcatcgtgttcttctactgcagcgctgtgaccatcttcttcaccatcatcaagctggtgtcctaccgcctgcacctgatgtttgataaaggagaggtgatccagcagaagcccagcaggaaggaggagaagcccaacaaggacaaggaggccaagggggagcacatcaccaaccacaggaaccccagcaacaaccggcagatccacaacgggaagaaggaggaggccagcaggaacctgagcaccccacccctgcgctgcagcagccggggccagagcatcaccagccaccacagcagcggccccctggagctgagcgcccaggagaccgtggaggacctgaagggcgtcatcctgctggaggaccaccccatcgcccctgtgagcagcaccagccctggcatcaaggtggagagcctgcctgccagccaggcccacatgctggagaccaccaccaagagcgtcatccctgtgaagcctgtggccacagagaccctcatcaatggcaagggcaaggagcggggcggcaagggccagccccccctgcggcacaggtctgagggcggcctggtggacaagggccccctgaagaagctgccccacctgagcctgagccagtatgacctgctggagacagatgtgtccttccagccctggggctctgaaaattctgtgctgatccctgagcctgtgtcctgcccccggggcagcatccgggagcgggtgcagagcaagagcccccaggacagcctgagcagcagctgcccccagtgtgacaccatcgtggccaagcctgtggaggagcctgctgacaccagctgccaggtggacaccagctgccagggcgacctgcccctgcaccaggaggtggacagcagtgacagcgaggtggccgtgaccctgattgacaccagccagcccggggaccccctgagcctgcacgagcccatcaagatcgtcatcaccatgagcagcacccccaacagcatgacagacctggagagcagcctgcacctgcgggtggtgggcacagagaagacctctgtgaagagtgatgctgagcccaccaaccctggagctgctggcagccccaatgctgagcagatcagcatccctgtgatcaccctggacctgcctgagggcggcggcggcggcgtgccctgcccagagggcaatggaagtgagaggaccccagagcggctgaagaccagggtgtccaccaaccagtgcagcggctacggcagcggggagggcggcaatgccatcaaggaccacagcagcagcagccgggagccctgggagagcgtgtcccggctgaccccagacaccggcagcgagagcaaggtgggcaaggagggccagaccaacctggaccccagcagctgcaagagcagccatgagaagagacatgcccgggtgctgtctgtggacagcggcacagatgtgttcctgagcaagagcagcgctgagatcgtgaatgacacagagaagaccatgcccaccagcaagagtgacctggaggccaaggagggccagatgcccaatgaaagcaacttcctggagtttgtgtccctgctggagagcatcaacaccagcaagatgacagccagcagccagctgaatggcagcgctgagcagaatgaggagagcggcctgctgcgggacaactgcagccaggagaagaaggaggagatcctggagaatgagaagcccagcggccacagcagcaagcagggcaagccagacctgcagagccaggaccacaccagcacaggccctgcctgcacccagcctgccaagaccacagccttcttccagggcaaccggcagaggcagatcatctacagagtgaccagccagcaggacagctctgtgctgcaggtgatcagcggccctgagacctctgtgcaggaggagatctctgtggatgccatgcacgtgttcattgatgaacatggagagatccgcagctgctacctgaagagcggcaaccagaaggagggccccctgcagcccctgcccagcaacaatgactgcctgagccaggcccgggagatgcaggtgagcagcagcagcaccaccaccagcgagagccaggaccccagcagcggggaccctgctgtgtctgccctgcagcagcagctgctgctgatggtggcccggaggacccagagcgagacccccaggcatgtgtcccaggacctggaggccagcagctgcagcagcacccagggcaagttcaaccgggagcagttctacaagttcatcatcttccctgggaagtggatcaaggtgtggtatgaccggctgaccctgctggccctgctggacagaacagaggacatcaaggaaaatgtgctggccatcctgctgattgtgctggtgtccctgctgggcttcctgaccctgagccagggcttctgcaaggacatgtgggtgctgctcttctgcctggtgatggccagctgccagtacagcctgctgaagtctgtgcagcctgaccctgccagccccatccacggccacaaccagatcatcacctacagccggcccatctacttctgtgtgctgtgtggcctcatcctgctgctggacacaggagccaaggcccggcacccccccagctatgtggtgtatggcctgaagctgttcagccctgtgttcctgcagagcgcccgggactacctgattgtgttcctgtactgcttccctgccatcagcctgctgggcctcttcccccagatcaacaccttctgcacctacctgctggagcagattgacatgctgttcttcggcggcagcgctgtgtctggcatcaccagcgctgtgtacagcgtggcccggtctgtgctggccgccgccctgctgcatgctgtgtgcttctctgctgtgaaggagccctggagcatgcagcacatcccagccctcttcagcgccttctgtggcctgctggtggccctgagctaccacctgagccggcagagcagtgaccccagcgtgctgatgtccttcatccagtgccgcctcttccccaagttcctgcaccagaacctggccgagagcgctgctgaccccctgcccaagaagatgaaggacagcgtgacagatgtgctgaagtgggacctgattgtgtgtgctgtggtggccgtgctgagctttgctgtgtctgccagcaccgtcttcctgagcctgcggcccttcctgagcatcgtgctgtttgccctggccggggctgtgggctttgtgacccactacgtgctgccccagctgaggaagcaccacccctggatgtggatcagccaccccatcctgaagaacaaggagtaccaccagcgggaggtgagagatgtggcccacctgatgtggtttgagcggctgtatgtgtggctgcagtgctttgagaagtacatcctgtacccagccctgatcctgaatgccctgaccattgatgccttcctgatcagcaaccaccggcggctgggcacccactgggacatcttcctgatgatcatcgccggcatgaagctgctgcggaccagcttctgcaaccctgtgtaccagttcatcaacctgtccttcaccgtcatcttcttccactttgactacaaggacatcagcgagagcttcctgctggacttcttcatggtgtccatcctcttcagcaagctgggggacctgctgcacaagctgcagtttgtgctgacctacgtggccccctggcagatggcctggggcagcagcttccacgtgtttgcccagctgtttgccatcccccacagcgccatgctgttcttccagaccatcgccaccagcatcttcagcacccccctgagccccttcctgggcagcgtcatcttcatcaccagctatgtgcggcctgtgaagttctgggagaagaactacaacaccaggagagtggacaacagcaacacccggctggccgtgcagatcgagcgggaccctggaaatgatgacaacaacctgaacagcatcttctatgagcacctgaccaggaccctgcaggagagcctgtgtggggacctggtgctgggccgctggggcaactacagcagcggggactgcttcatcctggccagtgatgacctgaatgcctttgtgcacctgattgaaattggaaatggcctggtgaccttccagctgcggggcctggagttccggggcacctactgccagcagcgggaggtggaggccatcatggagggagatgaggaggaccggggctgctgctgctgcaagccaggccacctgccccacctgctgagctgcaatgctgccttccacctgcgctggctgacctgggagatcacccagacccagtacatcctggagggctacagcatcctggacaacaatgctgccaccatgctgcaggtgtttgacctgcggcgcatcctgatccgctactacatcaagagcatcatctactacatggtgaccagccccaagctgctgtcctggatcaagaatgaaagcctgctgaagagcctgcagccctttgccaagtggcactacatcgagcgggacctggccatgttcaacatcaacattgatgatgattatgtgccctgcctgcagggcatcacccgggccagcttctgcaatgtgtacctggagtggatccagcactgtgccaggaagaggcaggagcccagcaccaccctggacagtgatgaggacagccccctggtgaccctgagctttgccctgtgcaccctgggccggcgggccctgggcacagctgcccacaacatggccatcagcctggacagcttcctgtatggcctgcacgtgctcttcaagggggacttccgcatcacagccagagatgagtgggtgtttgctgacatggacctgctgcacaaggtggtggccccagccatccgcatgagcctgaagctgcaccaggaccagttcacctgcccagatgaatatgaagatcctgctgtgctgtatgaggccatccagagctttgagaagaaggtggtgatctgccatgaaggagaccctgcctggagaggagctgtgctgagcaacaaggaggagctgctgaccctgcggcacgtggtggatgagggcgcagatgagtacaaggtgatcatgctgcacaggagcttcctgtccttcaaggtgatcaaggtgaacaaggaatgtgtgcggggcctgtgggccggccagcagcaggagctgatcttcctgaggaacagaaatcctgagcggggcagcatccagaacaacaagcaggtgctgaggaacctgatcaacagcagctgtgaccagcccctgggctaccccatgtatgtgagccccctgaccaccagctacctgggcacccaccggcagctgaagaacatctggggcggccccatcaccctggaccgcatccgcacctggttctggaccaagtgggtgaggatgaggaaggactgcaatgcccggcagcacagcggcggcaacattgaagatgtggatggcggcggggcccccaccaccggcggcaacaatgcccccagcggcggcagccaggagagcagcgctgagcagcccaggaagggcggggcccagcacggcgtgagcagctgtgagggcacccagaggacaggccgcaggaagggccgcagccagagcgtgcaggcccacagcgccctgagccagaggcctcccatgctgagcagcagcggccccatcctggagagccggcagaccttcctgcagaccagcacctctgtgcatgagctggcccagaggctgagcggcagccggctgagcctgcacgccagcgccaccagcctgcacagccagcccccacctgtgaccaccaccggccacctgtctgtgcgggagagagctgaggccctgatccgcagcagcctgggcagcagcaccagcagcaccctgtccttcctgtttgggaagaggagcttcagcagcgccctggtgatcagcggcctgtctgctgctgagggcggcaacaccagtgacacccagagcagcagctctgtgaacatcgtgatgggccccagcgcccgggccgccagccaggccaccaggcacctgtctgagccctgtgagcccccagatgccacagagcagggccagctgcatgaccgctgcctggccgaggccgtggccgacaccctgggcgtggtgtgcagaagagccagccaggaggacatgggcctggatgacacagccagccagcagagcgtgtctgatgagcagtag

SEQ ID NO: 36735 - DNA, 2334 bp, Artificial Sequence
  Description of Artificial Sequence: Synthetic coding sequence
atgaccttctacccctttgtggccagcagcagcaccaggagagtggacaacagcaacacccggctggccgtgcagatcgagcgggaccctggaaatgatgacaacaacctgaacagcatcttctatgagcacctgaccaggaccctgcaggagagcctgtgtggggacctggtgctgggccgctggggcaactacagcagcggggactgcttcatcctggccagtgatgacctgaatgcctttgtgcacctgattgaaattggaaatggcctggtgaccttccagctgcggggcctggagttccggggcacctactgccagcagcgggaggtggaggccatcatggagggagatgaggaggaccggggctgctgctgctgcaagccaggccacctgccccacctgctgagctgcaatgctgccttccacctgcgctggctgacctgggagatcacccagacccagtacatcctggagggctacagcatcctggacaacaatgctgccaccatgctgcaggtgtttgacctgcggcgcatcctgatccgctactacatcaagagcatcatctactacatggtgaccagccccaagctgctgtcctggatcaagaatgaaagcctgctgaagagcctgcagccctttgccaagtggcactacatcgagcgggacctggccatgttcaacatcaacattgatgatgattatgtgccctgcctgcagggcatcacccgggccagcttctgcaatgtgtacctggagtggatccagcactgtgccaggaagaggcaggagcccagcaccaccctggacagtgatgaggacagccccctggtgaccctgagctttgccctgtgcaccctgggccggcgggccctgggcacagctgcccacaacatggccatcagcctggacagcttcctgtatggcctgcacgtgctcttcaagggggacttccgcatcacagccagagatgagtgggtgtttgctgacatggacctgctgcacaaggtggtggccccagccatccgcatgagcctgaagctgcaccaggaccagttcacctgcccagatgaatatgaagatcctgctgtgctgtatgaggccatccagagctttgagaagaaggtggtgatctgccatgaaggagaccctgcctggagaggagctgtgctgagcaacaaggaggagctgctgaccctgcggcacgtggtggatgagggcgcagatgagtacaaggtgatcatgctgcacaggagcttcctgtccttcaaggtgatcaaggtgaacaaggaatgtgtgcggggcctgtgggccggccagcagcaggagctgatcttcctgaggaacagaaatcctgagcggggcagcatccagaacaacaagcaggtgctgaggaacctgatcaacagcagctgtgaccagcccctgggctaccccatgtatgtgagccccctgaccaccagctacctgggcacccaccggcagctgaagaacatctggggcggccccatcaccctggaccgcatccgcacctggttctggaccaagtgggtgaggatgaggaaggactgcaatgcccggcagcacagcggcggcaacattgaagatgtggatggcggcggggcccccaccaccggcggcaacaatgcccccagcggcggcagccaggagagcagcgctgagcagcccaggaagggcggggcccagcacggcgtgagcagctgtgagggcacccagaggacaggccgcaggaagggccgcagccagagcgtgcaggcccacagcgccctgagccagaggcctcccatgctgagcagcagcggccccatcctggagagccggcagaccttcctgcagaccagcacctctgtgcatgagctggcccagaggctgagcggcagccggctgagcctgcacgccagcgccaccagcctgcacagccagcccccacctgtgaccaccaccggccacctgtctgtgcgggagagagctgaggccctgatccgcagcagcctgggcagcagcaccagcagcaccctgtccttcctgtttgggaagaggagcttcagcagcgccctggtgatcagcggcctgtctgctgctgagggcggcaacaccagtgacacccagagcagcagctctgtgaacatcgtgatgggccccagcgcccgggccgccagccaggccaccagggtgcggggctgggccggcctgaccaggacaggctgggatggcggcaccggctcctggccagagcggggcacctgcctggccttcccccccttctgcctgcagaaccccatccccttctccatgggcctgcctgagtag

SEQ ID NO: 36736 - DNA, 861 bp, Artificial Sequence
  Description of Artificial Sequence: Synthetic coding sequence
atgcacgtgttcattgatgagcacggggagatccgcagctgctacctgaagagcggcaaccagaaggagggccccctgcagcccctgcccagcaacaatgactgcctgagccaggcccgggagatgcaggtgagcagcagcagcaccaccaccagcgagagccaggaccccagcagcggggaccctgctgtgtctgccctgcagcagcagctgctgctgatggtggcccggaggacccagagcgagacccccaggcatgtgtcccaggacctggaggccagcagctgcagcagcacccagggcaagttcaaccgggagcagttctacaagttcatcatcttccctgggaagtggatcaaggtgtggtatgaccggctgaccctgctggccctgctggacagaacagaggacatcaaggaaaatgtgctggccatcctgctgattgtgctggtgtccctgctgggcttcctgaccctgagccagggcttctgcaaggacatgtgggtgctgctcttctgcctggtgatggccagctgccagtacagcctgctgaagtctgtgcagcctgaccctgccagccccatccacggccacaaccagatcatcacctacagccggcccatctacttctgtgtgctgtgtggcctcatcctgctgctggacaccggggccaaggcccggcaccccccatcctatgtggtgtatggcctgaagctgttcagccctgtgttcctgcagagcgcccgggactacctgattggcaagatcatgaacagccacaaggacttcttcaccagcgagaagaagaaggacaagatcatcagcgccatcagcagcgtcatcttcctgaagtcctggtag

SEQ ID NO: 36737 - DNA, 6105 bp, Artificial Sequence
  Description of Artificial Sequence: Synthetic coding sequence
atgggcagccaggtgctgcagatcctgcggcagggcgtgtgggccagcctgaccggcggctggttctttgacccccaccagagcaccttcagcaactgcttccacctgtatgtgtggatcttcctgctgatcttccccttcctgctgtacatggtgctgccccccagcctgatggtggccggcgtgtactgcctggtggtggccgtcatctttgccaccatcaagacagtgaactaccgcctgcacgccatgtttgaccagggcgagatcgtggagaagaggagcagcaccatgggagagctggaggaggagcccgcccagggcgacagcaaccccccccgggaccccggggtggagatgacagtgttcaggaaggtgagcagcaccccacctgtgcgctgcagcagccagcacagcgtgtttggcttcaaccaggtgtctgagctgctgcccaggatggaggacagcggccccctgcgggacatcaaggagctggtgcgggagcagggcagcaacaacgtgattgtgaccagcgctgaccgggagatgctgaagctgagcagccaggagaagctgattggagacctgccccagaccccacctggagctgtgcctgaccccagcctggccagcacagacagcagcgagcccagccccctggccggagatggagccccctggagcggcagctccatggctgacacccccatgagccccctgctgaagggcagcctgagccaggagctgagcaagagcttcctgaccctgacccagcctgaccgggccctggtgaggaccagcagcagaagagagcagaggagaggagctgggggctaccagcccctggaccggcggggcagcggggagcccaccccccagaaggccggcagcagtgacagctgcttctctggaacagaccgggagaccctgagcagcttcaagtctgagaagaccaacagcacccacctggacagccccccaggcggccctgcccctgagggcagtgacacagatcctccttctgaggccgagctgcctgccagcccagatgctggggtgcccagtgatgacaccctgcggagctttgacaccgtcatcggggccggcaccccacctggcctggccgagcccctgctggtggtgcggcccaaggacctggccctgctgcggcccagcaagaggcagccccccctgcggcggcacagccccccaggccgggccccccggcggcccctgctggagggcggcggcttctttgaagatgaggacaccagcgagggcagcgagctgagccctgccagcagcctgcggagccagaggcgctacagcacagacagcagcagcagcaccagctgctacagccctgagagcagcagaggagctgctgggggccccaggaagaggcgggccccccacggggctgaggagggcacagctgtgccccccaagaggccctacggcacccagaggacccccagcacagccagcgccaagacccacgcccgggtgctgtccatggatggagctggaggagatgtgctgcggccccccctggccggctgcaaggccgagctggaggcccaggtgggcgtggagcaggccgccagcgagcctgtggtgctgcctgctgaggcccggcggggccctgctgccaaccagcccggctggagaggagagctgcaggaggagggcgctgtgggcggcgctgctgaggagactggaagaagagacaggagcagctctgtgcggaggacccaggccatcagaagaagacacaatgccggcagcaaccccaccccaccagcctctgtgatgggcagcccccccagcagcctgcaggaggcccagaggggccgggccgccagccacagccgggccctgaccctgcccagcgccctgcactttgccagcagcctgctgctgacccgggccggggccaacgtgcatgaggcctgcacctttgatgacaccagcgagggcgctgtgcactacttctatgatgaaagtggagtgcggcgcagctacaccttcggcctggccggcggcggctatgaaaatcctgtgggccagcagggcgagcagacagccaatggagcctgggacagacacagccacagcagcagcttccacagcgcagatgtgcctgaggccaccggcggcctgaacctgctgcagcccaggcctgtggtgctgcagggcatgcaggtgagaagagtgcccctggagatccctgaggagcagaccctgatggaggaggccccaccccgggcccagcacagctacaagtactggctgctgcccggccgctggacctctgtgcgctatgagcggctggccctgctggccctgctggacaggacccggggcgtgctggagaacatctttggagtgggcctgagcagcctggtggccttcctgggctacctgctgctgctgaagggcttcttcacagacatctgggtgttccagttctgcctggtgattgccagctgccagtacagcctgctgaagtctgtgcagccagatgctgccagccccatgcacggccacaactgggtgattgcctacagcaggcctgtgtacttctgcatctgctgcctgctgatctggctgctggatgccctgggcagcgcccagcccttcccccctgtgtccctgtatggcctgaccctcttcagcgccagcttcttcttctgtgccagagatgtggccaccgtcttcaccctgtgcttcccctttgtgttcctgctgggcctgctgccccaggtgaacacctgcctgatgtacctgctggagcagattgacatgcacggctttggaggaacagctgccaccagccccctgacagctgtgttcagcctgagccgcagcctgctggccgccgccctgctgtatggcttctgcctgggcgccatcaagaccccctggccagagcagcacgtgcctgtgctcttcagcgtcttctgtggcctgctggtggccctgagctaccacctgagccggcagagcagtgaccccaccgtgctgtggagcctcatccgcagcaagctgtttcctgagctggaggagaggagcctggagacagcccgggcagagcccccagaccccctgcctgacaagatgaggcagagcgtgcgggaggtgctgcacagcgacctggtgatgtgtgtggtgattgctgtgctgacctttgccatcagcgccagcaccgtcttcatcgccctgaagtctgtgctgggctttgtgctgtatgccctggccggggctgtgggcttcttcacccactacctgctgccccagctgaggaagcagctgccctggttctgcctgagccagcctgtgctgaagcccctggagtacagccagtatgaggtgcggggggccgcccaggtgatgtggtttgagaagctgtatgccggcctgcagtgtgtggagaagtacctgatctacccagctgtggtgctgaatgccctgactgtggatgcccacacagtggtgagccacccagacaagtactgcttctactgccgggccctgctgatgacagtggccggcctgaagctgctgcggagcgccttctgctgccccccccagcagtacctgaccctggccttcaccgtgctgctcttccactttgactacccccggctgagccagggcttcctgctggactacttcctgatgagcctgctgtgcagcaagctgtgggacctgctgtacaagctgcgctttgtgctgacctacatcgccccctggcagatcacctggggcagcgccttccacgcctttgcccagccctttgctgtgccccacagcgccatgctgtttgtgcaggccctgctgagcggcctcttcagcacccccctgaaccccctgctgggcagcgctgtgttcatcatgtcctatgcccggcccctgaagttctgggagcgggactacaacaccaagagggtggaccacagcaacacccggctggtgacccagctggacagaaatcctggagcagatgacaacaacctgaacagcatcttctatgagcacctgaccaggagcctgcagcacaccctgtgtggggacctggtgctgggccgctggggcaactacggccctggggactgctttgtgctggccagtgactacctgaatgccctggtgcacctgattgaggtgggcaatggcctggtgaccttccagctgcggggcctggagttccggggcacctactgccagcagcgggaggtggaggccatcacagagggcgtggaggaggatgagggctgctgctgctgtgagcccggccacctgccccgggtgctgtccttcaatgctgccttcggccagcgctggctggcctgggaggtgacagccagcaaatatgtgctggagggctacagcatcagtgacaacaatgctgcctccatgctgcaggtgtttgacctgaggaagatcctgatcacctactacgtgaagagcatcatctactacgtgagccgcagccccaagctggaggtgtggctgagccatgagggcatcacagctgccctgcggcctgtgcgggtgcccggctacgccgacagcgaccccaccttcagcctgtctgtggatgaggactatgacctgcggctgagcggcctgagcctgcccagcttctgtgctgtgcacctggagtggatccagtactgtgccagccgccgcagccagcctgtggaccaggactggaacagccccctggtgaccctgtgcttcggcctgtgtgtgctgggcagaagagccctgggcacagccagccacagcatgtctgccagcctggagcccttcctgtatggcctgcacgccctcttcaagggggacttccgcatcaccagccccagagatgagtgggtgtttgctgacatggacctgctgcaccgggtggtggcccctggggtgaggatggccctgaagctgcaccaggaccacttcaccagcccagatgaatatgaggagcctgctgccctgtatgatgccatcgccgccaatgaggagcggctggtgatcagccatgaaggagaccctgcctggaggtctgccatcctgagcaacacccccagcctgctggccctgcggcacgtgctggatgatgccagtgatgagtacaagatcatcatgctgaacagaagacacctgtccttccgggtcatcaaggtgaaccgggagtgtgtgcggggcctgtgggccggccagcagcaggagctggtgttcctgaggaacagaaatcctgagcggggcagcatccagaatgccaagcaggccctgaggaacatgatcaacagcagctgtgaccagcccctgggctaccccatctacgtgagccccctgaccaccagcctggccggcagccacccccagctgcgggccctgtggggcggccccatcagcctgggcgccatcgcccactggctgctgcggacctgggagcggctgcacaagggctgtggggccggctgcaacagcggcggcaatgtggatgacagcgactgcagcggcggcggcggcctgaccagcctgagcaacaacccccctgtggcccaccccaccccagaaaatacagctggaaatggagaccagcccctgcccccaggccctggctggggccccaggagcagcctgagcggcagcggagatggccggcccccacccctgctgcagtggcccccaccccggctgcccggccccccaccagccagccccatccccacagagggccccaggaccagcaggcctcctggccctggcctgctgagcagcgagggccccagcggcaagtggagcctgggcggcaggaagggcctgggcggcagtgatggagagcccgccagcggcagccccaagggcggcacccccaagagccaggcccccctggacctgagcctgagcctgagcctgagcctgagcccagatgtgtccacagaggccagccccccccgggccagccaggacatcccctgcctggacagcagcgcccctgagagcggcacccccatgggcgccctgggggactggccagcccccatcgaggagcgggagagccctgctgcccagcccctgctggagcaccagtactag

SEQ ID NO: 36738 - DNA, 1167 bp, Artificial Sequence
  Description of Artificial Sequence: Synthetic coding sequence
atggtgcgggacagcatggccgccgccttccggcccagcaacagagtgctgctgcaggccctgcagatcctggtgtacccaggagtgggcggcagcggctctgtgtcctgccgctgccccctgggcgccaagcgctacctgctgacagacaacgtggtgaagctgaaggagttccagcagaagaaggtggccgtggcctgcaacctgagcggcaccaaggagacctacttcaggaacctgaagaagaagctgacccagaacaagctgatcctgaagggggagctgatcaccctgctgcacctgtgtgagagccgggaccacgtggagctggccaagaatgtcatctaccgctaccacgccgagaacaagaacttcaccctgggggagtacaagtttggccccctgtttgtgcggctgtgctatgagctggacctggaggagagcgctgtggagctgatgaaggaccagcacctgcggggcttcttcagtgacagcaccagcttcaacatcctgatggacatgctgttcatcaagggcaagtacaagagcgccctgcaggtgctgattgagatgaagaaccaggatgtgaagttcaccaaggacacctacgtgctggcctttgccatctgctacaagctgaacagccctgagagcttcaagatctgcaccaccctgcgggaggaggccctgctgaagggggagatcctgagccggcgggccagctgctttgctgtggccctggccctgaaccagaatgagatggccaaggctgtgtccatcttcagccagatcatgaaccctgagagcatcgcctgcatcaacctgaacatcatcatccacatccagagcaacatgctggagaacctgatcaagaccctgaagaatgctgctgagggcaacctgagcaagtttgtgaagagacatgtgttttctgaggaggtgctggccaaggtgcgggagaaggtgaaggatgtgcctgccctggtggccaagtttgatgagatctacggcaccctgcacatcaccggccaggtgaccacagacagcctggatgctgtgctgtgccacaccccccgggacaggaagagccacaccctgctgctgaacaagaggatggtgtccaggaggaccttccagcccctgagccagagcctgctggccgagtag

SEQ ID NO: 36739 - DNA, 1167 bp, Artificial Sequence; identical to SEQ ID NO: 36738
  Description of Artificial Sequence: Synthetic coding sequence

SEQ ID NO: 36740 - DNA, 651 bp, Artificial Sequence
  Description of Artificial Sequence: Synthetic coding sequence
atgtggaactggctgaagatgtccttcaccggggccctgcaggtgctgattgagatgaagaaccaggatgtgaagttcaccaaggacacctacgtgctggcctttgccatctgctacaagctgaacagccctgagagcttcaagatctgcaccaccctgcgggaggaggccctgctgaagggggagatcctgagccggcgggccagctgctttgctgtggccctggccctgaaccagaatgagatggccaaggctgtgtccatcttcagccagatcatgaaccctgagagcatcgcctgcatcaacctgaacatcatcatccacatccagagcaacatgctggagaacctgatcaagaccctgaagaatgctgctgagggcaacctgagcaagtttgtgaagagacatgtgttttctgaggaggtgctggccaaggtgcgggagaaggtgaaggatgtgcctgccctggtggccaagtttgatgagatctacggcaccctgcacatcaccggccaggtgaccacagacagcctggatgctgtgctgtgccacaccccccgggacaggaagagccacaccctgctgctgaacaagaggatggtgtccaggaggaccttccagcccctgagccagagcctgctggccgagtag

SEQ ID NO: 36741 - DNA, 486 bp, Artificial Sequence
  Description of Artificial Sequence: Synthetic coding sequence
atggtgcgggacagcatggccgccgccttccggcccagcaacagagtgctgctgcaggccctgcagatcctggtgtacccaggagtgggcggcagcggctctgtgtcctgccgctgccccctgggcgccaagcgctacctgctgacagacaacgtggtgaagctgaaggagttccagcagaagaaggtggccgtggcctgcaacctgagcggcaccaaggagacctacttcaggaacctgaagaagaagctgacccagaacaagctgatcctgaagggggagctgatcaccctgctgcacctgtgtgagagccgggaccacgtggagctggccaagaatgtcatctaccgctaccacgccgagaacaagaacttcaccctgggggagtacaagtttggccccctgtttgtgcggctgtgctatgagctggacctggaggagagcgctgtggagctgatgaaggaccaggtgctgtgcaagtactag

SEQ ID NO: 36742 - DNA, 2070 bp, Artificial Sequence
  Description of Artificial Sequence: Synthetic coding sequence
atggctgtggtgtctgctgtgcgctggctgggcctgcggagccggctgggccagcccctgactggaagaagagctggcctgtgtgagcaggcccggagctgccgcttctacagcggcagcgccaccctgagcaaggtggagggcacagatgtgacaggcatcgaggaggtggtgatccccaagaagaagacctgggacaaggtggccgtgctgcaggccctggccagcacagtgaacagagacaccacagctgtgccctacgtgttccaggatgacccctacctgatgcctgccagcagcctggagagccgctccttcctgctggccaagaagagcggggagaatgtggccaagttcatcatcaacagctaccccaagtacttccagaaggacattgctgagccccacatcccctgcctgatgcctgagtactttgagccccagatcaaggacatcagcgaggccgccctgaaggagagaattgagctgaggaaggtgaaggcctctgtggacatgtttgaccagctgctgcaggccggcaccaccgtgtccctggagaccaccaacagcctgctggacctgctgtgctactacggggaccaggagcccagcacagactaccacttccagcagacaggccagagcgaggccctggaggaggagaatgatgagaccagcaggaggaaggccggccaccagtttggagtgacctggagggccaagaacaatgctgagcgcatcttcagcctgatgcctgagaagaatgagcacagctactgcaccatgatccggggcatggtgaagcaccgggcctatgagcaggccctgaacctgtacacagagctgctgaacaaccggctgcatgctgatgtgtacaccttcaatgccctgattgaggccaccgtgtgtgccatcaatgagaagtttgaggagaagtggagcaagatcctggagctgctgcggcacatggtggcccagaaggtgaagcccaacctgcagaccttcaacaccatcctgaagtgcctgcggcgcttccacgtgtttgcccggagccctgccctgcaggtgctgcgggagatgaaggccatcggcatcgagcccagcctggccacctaccaccacatcatccggctgtttgaccagcccggggaccccctgaagaggagcagcttcatcatctatgacatcatgaatgagctgatgggcaagcgcttcagccccaaggaccctgatgatgacaagttcttccagagcgccatgagcatctgcagcagcctgcgggacctggagctggcctaccaggtgcacggcctgctgaagacaggagacaactggaagttcatcggccctgaccagcacaggaacttctactacagcaagttctttgacctgatctgcctgatggagcagattgatgtgaccctgaagtggtatgaagatctcatccccagcgcctacttcccccacagccagaccatgatccacctgctgcaggccctggatgtggccaaccggctggaggtgatccccaagatctggaaggacagcaaggagtatggccacaccttcagaagtgacctgcgggaggagatcctgatgctgatggcccgggacaagcaccccccagagctgcaggtggcctttgctgactgtgccgctgacatcaagagcgcctatgagagccagcccatccggcagacagcccaggactggccagccaccagcctgaactgcatcgccatcctcttcctgcgggccggccgcacccaggaggcctggaagatgctgggcctcttcaggaagcacaacaagatccccaggtctgagctgctgaatgagctgatggattctgccaaggtgagcaacagccccagccaggccatcgaggtggtggagctggccagcgccttcagcctgcccatctgtgagggcctgacccagagggtgatgtctgactttgccatcaaccaggagcagaaggaggccctgagcaacctgacagccctgaccagtgacagcgacacagacagcagcagtgacagcgacagcgacaccagcgagggcaagtag

SEQ ID NO: 36743 - DNA, 627 bp, Artificial Sequence
  Description of Artificial Sequence: Synthetic coding sequence
atggctgtggtgtctgctgtgcgctggctgggcctgcggagccggctgggccagcccctgactggaagaagagctggcctgtgtgagcaggcccggagctgccgcttctacagcggcagcgccaccctgagcaaggtggagggcacagatgtgacaggcatcgaggaggtggtgatccccaagaagaagacctgggacaaggtggccgtgctgcaggccctggccagcacagtgaacagagacaccacagctgtgccctacgtgttccaggatgacccctacctgatgcctgccagcagcctggagagccgctccttcctgctggccaagaagagcggggagaatgtggccaagttcatcatcaacagctaccccaagtacttccagaaggacattgctgagccccacatccctgagcccctgtgcctgctgaagcagcagatcgtgtcctggatctactgtgtgaccatggtgaccaggagcccccagctgatcaccatcttcaacaagctggacagccagaagcactggaagaggaagatgatgaggcacctgggcggcaagctggtgatcagcctggagctgcacggggagcagaagaccaccctgcgggagagcttcctgtag

SEQ ID NO: 36744 - DNA, 1470 bp, Artificial Sequence
  Description of Artificial Sequence: Synthetic coding sequence
atggctgctgctgctgcccgggtggtgctgagcagcgctgcccggcggcggctgtggggcttcagcgagagcctgctgatcagaggagctgctggccgcagcctgtactttggagaaaatcggctgcggagcacccaggccgccacccaggtggtgctgaatgtgcctgagaccagggtgacctgcctggagagcggcctgcgggtggccagcgaggacagcggcctgagcacctgcaccgtgggcctgtggattgatgctggcagccgctatgaaaatgagaagaacaatggaacagcccacttcctggagcacatggccttcaagggcaccaagaagaggagccagctggacctggagctggagattgagaacatgggcgcccacctgaatgcctacaccagccgggagcagacagtgtactatgccaaggccttcagcaaggacctgcccagggctgtggagatcctggccgacatcatccagaacagcaccctgggggaggccgagattgagcgggagcggggcgtcatcctgcgggagatgcaggaggtggagaccaacctgcaggaggtggtgtttgactacctgcacgccacagcctaccagaacacagccctgggccgcaccatcctgggccccacagagaacatcaagagcatcagcaggaaggacctggtggactacatcaccacccactacaagggccccagaattgtgctggccgccgccggcggcgtgtcccatgatgagctgctggacctggccaagttccactttggagacagcctgtgcacccacaagggggagatcccagccctgcccccctgcaagttcaccggcagcgagatccgggtgagagatgacaagatgcccctggcccacctggccatcgctgtggaggccgtgggctgggcccacccagacaccatctgcctgatggtggccaacaccctcatcggcaactgggacaggagctttggaggcggcatgaacctgagcagcaagctggcccagctgacctgccacggcaacctgtgccacagcttccagagcttcaacaccagctacacagacaccggcctgtggggcctgtacatggtgtgtgagagcagcacagtggccgacatgctgcacgtggtgcagaaggagtggatgaggctgtgcacctctgtgacagaaagtgaggtggcccgggccaggaacctgctgaagaccaacatgctgctgcagctggatggcagcacccccatctgtgaggacatcggccggcagatgctgtgctacaacagacgcatccccatccctgagctggaggccagaattgatgctgtgaatgctgagaccatccgggaggtgtgcaccaagtacatctacaacagaagccctgccatcgctgctgtgggccccatcaagcagctgcctgacttcaagcagatccgcagcaacatgtgctggctgcgggactag

SEQ ID NO: 36745 - DNA, 1212 bp, Artificial Sequence
  Description of Artificial Sequence: Synthetic coding sequence
atggccttcaagggcaccaagaagaggagccagctggacctggagctggagattgagaacatgggcgcccacctgaatgcctacaccagccgggagcagacagtgtactatgccaaggccttcagcaaggacctgcccagggctgtggagatcctggccgacatcatccagaacagcaccctgggggaggccgagattgaaagagagcggggcgtcatcctgcgggagatgcaggaggtggagaccaacctgcaggaggtggtgtttgactacctgcacgccacagcctaccagaacacagccctgggccgcaccatcctgggccccacagagaacatcaagagcatcagcaggaaggacctggtggactacatcaccacccactacaagggcccccgcatcgtgctggccgctgctggaggagtgtcccatgatgagctgctggacctggccaagttccactttggagacagcctgtgcacccacaagggggagatcccagccctgcccccctgcaagttcaccggcagcgagatccgggtgagagatgacaagatgcccctggcccacctggccatcgctgtggaggccgtgggctgggcccacccagacaccatctgcctgatggtggccaacaccctgattggcaactgggacaggagctttggaggcggcatgaacctgagcagcaagctggcccagctgacctgccacggcaacctgtgccacagcttccagagcttcaacaccagctacacagacaccggcctgtggggcctgtacatggtgtgtgagagcagcacagtggccgacatgctgcacgtggtgcagaaggagtggatgaggctgtgcacctctgtgacagagagcgaggtggcccgggccaggaacctgctgaagaccaacatgctgctgcagctggatggcagcacccccatctgtgaagatattggccggcagatgctgtgctacaacagacgcatccccatccctgagctggaggccagaattgatgctgtgaatgctgagaccatccgggaggtgtgcaccaagtacatctacaacagaagccctgccatcgctgctgtgggctacaaccacaggtctgagctgcacgagtggaagtggaacaagctgttcagcaagaggcagaccatctcctacagctatgtgaacatcctgctgccccagccccagccccagtatgtgtag

SEQ ID NO: 36746 - DNA, 645 bp, Artificial Sequence
  Description of Artificial Sequence: Synthetic coding sequence
atgaggcctgggggcttcctgggcgccggccagaggctgagccgggccatgagccgctgtgtgctggagccccggcccccaggcaagcgctggatggtggccggcctgggcaaccctggcctgcccggcaccaggcacagcgtgggcatggctgtgctgggccagctggcccggcggctgggcgtggccgagagctggacccgggacagacactgtgccgctgacctggccctggcccccctgggagatgcccagctggtgctgctgcggccccggcggctgatgaatgccaacggccgctctgtggcccgggctgctgagctgtttggcctgacagctgaggaggtgtacctggtgcatgatgagctggacaagcccctgggccgcctggccctgaagctgggcggcagcgcccggggccacaacggggtgcgcagctgcatcagctgcctgaacagcaatgccatgccccggctgcgggtgggcatcggccggcctgcccaccctgaggccgtgcaggcccacgtgctgggctgcttcagccctgctgagcaggagctgctgcccctgctgctggaccgggccacagacctgatcctggaccacatccgggagaggagccagggccccagcctgggcccctag

SEQ ID NO: 36747 - DNA, 645 bp, Artificial Sequence; identical to SEQ ID NO: 36746
  Description of Artificial Sequence: Synthetic coding sequence

SEQ ID NO: 36748 - DNA, 4074 bp, Artificial Sequence
  Description of Artificial Sequence: Synthetic coding sequence
atgcagaccctgggcagcttcttcggcagcctgcccggcttcagcagcgccaggaacctggtggccaatgcccacagcagcgcccgggcccggcctgctgctgaccccactggagccccagctgctgaggccgcccagccccaggcccaggtggccgcccaccctgagcagacagccccctggacagagaaggagctgcagcccagcgagaagcagatggtgtctggggccaaggacctggtgtgcagcaagatgagccgggccaaggatgctgtgagcagcggcgtggcctctgtggtggatgtggccaagggcgtggtgcagggcggcctggacaccaccaggtctgccctgaccggcaccaaggaggtggtgtcctctggagtgactggagccatggacatggccaagggagctgtgcagggcggcctggacaccagcaaggctgtgctgaccggcaccaaggacacagtgtccacaggcctgactggagctgtgaatgtggccaagggcaccgtgcaggccggcgtggacaccaccaagacagtgctgaccggcaccaaggacacagtgaccactggagtgatgggcgctgtgaacctggccaagggcaccgtgcagacaggagtggagaccagcaaggctgtgctgaccggcaccaaggatgctgtgtccacaggcctgactggagctgtgaatgtggcccggggcagcatccagacaggagtggacaccagcaagacagtgctgaccggcaccaaggacacagtgtgcagcggcgtgactggagccatgaatgtggccaagggcaccatccagacaggagtggacaccagcaagacagtgctgaccggcaccaaggacacagtgtgcagcggcgtgactggagccatgaatgtggccaagggcaccatccagacaggagtggacaccagcaagacagtgctgaccggcaccaaggacacagtgtgcagcggcgtgactggagccatgaatgtggccaagggcaccatccagacaggagtggacaccaccaagacagtgctgaccggcaccaagaacacagtgtgcagcggcgtgactggagctgtgaacctggccaaggaggccatccagggcggcctggacaccaccaagtccatggtgatgggcaccaaggacaccatgagcacaggcctgaccggggccgccaacgtggccaagggggccatgcagacaggcctgaacaccacccagaacatcgccaccggcaccaaggacacagtgtgcagcggcgtgactggagccatgaacctggcccggggcaccatccagacaggagtggacaccaccaagatcgtgctgaccggcaccaaggacacagtgtgcagcggcgtgactggagctgccaacgtggccaagggagctgtgcagggcggcctggacaccaccaagtctgtgctgaccggcaccaaggatgctgtgtccacaggcctgactggagctgtgaatgtggccaagggcaccgtgcagacaggagtggacaccaccaagacagtgctgaccggcaccaaggacacagtgtgcagcggcgtgaccagcgctgtgaatgtggccaagggagctgtgcagggcggcctggacaccaccaagtctgtggtgattggcaccaaggacaccatgagcacaggcctgactggagctgccaacgtggccaagggagctgtgcagacaggagtggacacagccaagacagtgctgaccggcaccaaggacacagtgaccaccggcctggtgggcgctgtgaatgtggccaagggcaccgtgcagacaggcatggacaccaccaagacagtgctgaccggcaccaaggacaccatctacagcggcgtgaccagcgctgtgaatgtggccaagggagctgtgcagacaggcctgaagaccacccagaacatcgccaccggcaccaagaacacctttggaagtggagtgaccagcgctgtgaatgtggccaagggagctgcccagacaggagtggacacagccaagacagtgctgaccggcaccaaggacacagtgaccaccggcctgatgggcgctgtgaatgtggccaagggcaccgtgcagacctctgtggacaccaccaagacagtgctgaccggcaccaaggacacagtgtgcagcggcgtgactggagctgccaacgtggccaagggggccatccagggcggcctggacaccaccaagtctgtgctgaccggcaccaaggatgctgtgtccacaggcctgactggagctgtgaagctggccaagggcaccgtgcagacaggcatggacaccaccaagacagtgctgaccggcaccaaggatgctgtgtgcagcggcgtgactggagctgccaacgtggccaagggagctgtgcagatgggcgtggacacagccaagacagtgctgaccggcaccaaggacacagtgtgcagcggcgtgactggagctgccaacgtggccaagggagctgtgcagacaggcctgaagaccacccagaacatcgccaccggcaccaagaacaccctgggcagcggcgtgactggagctgccaaggtggccaagggagctgtgcagggcggcctggacaccaccaagtctgtgctgaccggcaccaaggatgctgtgtccacaggcctgactggagctgtgaacctggccaagggcaccgtgcagacaggagtggacaccagcaagacagtgctgaccggcaccaaggacacagtgtgcagcggcgtgactggagctgtgaatgtggccaagggcaccgtgcagacaggagtggacacagccaagacagtgctgagcggggccaaggatgctgtgaccaccggggtgactggagctgtgaatgtggccaagggcaccgtgcagacaggagtggatgccagcaaggctgtgctgatgggcaccaaggacaccgtcttctctggagtgactggagccatgtccatggccaagggagctgtgcagggcggcctggacaccaccaagacagtgctgaccggcaccaaggatgctgtgtctgctggcctgatgggcagcggaaatgtggccaccggggccacccacacaggcctgagcaccttccagaactggctgcccagcaccccagccacctcctggggcggcctgaccagcagcaggaccacagacaatggaggagagcagacagccctgagcccccaggaggcccccttcagcggcatcagcaccccaccagatgtgctgtctgtgggccctgagcccgcctgggaggccgccgccaccaccaagggcctggccacagatgtggccaccttcacccagggcgccgcccctggccgggaggacaccggcctgctggccaccacccacggccctgaggaggccccccggctggccatgctgcagaatgagctggagggcctgggggacatcttccaccccatgaatgctgaggagcaggcccagctggccgccagccagcccggccccaaggtgctgtctgctgagcagggcagctactttgtgcggctgggggacctgggccccagcttccggcagagggcctttgaacatgctgtgagccacctgcagcacggccagttccaggcccgggacaccctggcccagctgcaggactgcttccggctgattgagaaggcccagcaggcccctgagggccagccccggctggaccagggcagcggggccagcgcagaagatgctgctgtgcaggaggagagagatgctggggtgctgagccgggtgtgtggcctgctgcggcagctgcacacagcctacagcggcctggtgagcagcctgcagggcctgcctgctgagctgcagcagcctgtgggccgggcccggcacagcctgtgtgagctgtatggaattgtggccagcgctggctctgtggaggagctgcctgctgagcggctggtgcagagccgggagggcgtgcaccaggcctggcagggcctggagcagctgctggagggcctgcagcacaacccccccctgtcctggctggtgggcccctttgccctgcctgctgggggccagtag

SEQ ID NO: 36749 - DNA, 780 bp, Artificial Sequence
  Description of Artificial Sequence: Synthetic coding sequence
atggatgcctgggtgcgcttcagcgcccagagccaggcccgggagcggctgtgccgggccgcccagtatgcctgcagcctgctgggccacgccctgcagagacatggagccagccctgagctgcagaagcagatccggcagctggagagccacctgagcctgggcaggaagctgctgcggctgggcaacagcgcagatgccctggagagcgccaagagagctgtgcacctgagtgatgtggtgctgcgcttctgcatcaccgtgagccacctgaacagagccctgtactttgcctgtgacaacgtgctgtgggccggcaagagcggcctggccccccgggtggaccaggagaagtgggcccagaggagcttccgctactacctgttcagcctcatcatgaacctgagcagagatgcctatgagatccggctgctgatggagcaggagagcagcgcctgcagccggcggctgaagggcagcggcggcggcgtgcctgggggcagcgagaccggcggcctgggcggccctggcaccccaggcggcggcctgccccagctggccctgaagctgcggctgcaggtgctgctgctggcccgggtgctgcggggccacccccccctgctgctggatgtggtgagaaatgcctgtgacctcttcatccccctggacaagctgggcctgtggaggtgtggccctggcatcgtgggcctgtgtggcctggtgagcagcatcctgagcatcctgaccctcatctacccctggctgcggctgaagccctag

SEQ ID NO: 36750 - DNA, 246 bp, Artificial Sequence
  Description of Artificial Sequence: Synthetic coding sequence
cctgggggcggcctgccccagctggccctgaagctgcggctgcaggtgctgctgctggcccgggtgctgcggggccacccccccctgctgctggatgtggtgagaaatgcctgtgacctcttcatccccctggacaagctgggcctgtggaggtgtggccctggcatcgtgggcctgtgtggcctggtgagcagcatcctgagcatcctgaccctcatctacccctggctgcggctgaagccctag

SEQ ID NO: 36751 - DNA, 738 bp, Artificial Sequence
  Description of Artificial Sequence: Synthetic coding sequence
atgggcaagctgcgggccgcccagtatgcctgcagcctgctgggccacgccctgcagagacatggagccagccctgagctgcagaagcagatccggcagctggagagccacctgagcctgggcaggaagctgctgcggctgggcaacagcgcagatgccctggagagcgccaagagagctgtgcacctgagtgatgtggtgctgcgcttctgcatcaccgtgagccacctgaacagagccctgtactttgcctgtgacaacgtgctgtgggccggcaagagcggcctggccccccgggtggaccaggagaagtgggcccagaggagcttccgctactacctgttcagcctcatcatgaacctgagcagagatgcctatgagatccggctgctgatggagcaggagagcagcgcctgcagccggcggctgaagggcagcggcggcggcgtgcctgggggcagcgagaccggcggcctgggcggccctggcaccccaggcggcggcctgccccagctggccctgaagctgcggctgcaggtgctgctgctggcccgggtgctgcggggccacccccccctgctgctggatgtggtgagaaatgcctgtgacctcttcatccccctggacaagctgggcctgtggaggtgtggccctggcatcgtgggcctgtgtggcctggtgagcagcatcctgagcatcctgaccctcatctacccctggctgcggctgaagccctag

SEQ ID NO: 36752 - DNA, 297 bp, Artificial Sequence
  Description of Artificial Sequence: Synthetic coding sequence
atgaaggtgtctgctgtgctgctgtgcctgctgctgatgacagctgccttcaacccccagggcctggcccagccagatgccctgaatgtgcccagcacctgctgcttcaccttcagcagcaagaagatcagcctgcagaggctgaagagctatgtgatcaccaccagccgctgcccccagaaggccgtcatcttccgcaccaagctgggcaaggagatctgtgccgaccccaaggagaagtgggtgcagaactacatgaagcacctgggcaggaaggcccacaccctgaagacctag

SEQ ID NO: 36753 - DNA, 975 bp, Artificial Sequence
  Description of Artificial Sequence: Synthetic coding sequence
atggccgagcacggggcccacttcaccgctgcctctgtggctgatgaccagcccagcatctttgaggtggtggcccaggacagcctgatgacagctgtgcggcctgccctgcagcacgtggtgaaggtgctggccgagagcaaccccacccactacggcttcctgtggcgctggtttgatgagatcttcaccctgctggacctgctgctgcagcagcactacctgagcaggaccagcgccagcttcagcgagaacttctacggcctgaagagaattgtgatgggagacacccacaagagccagaggctggccagcgctggcctgcccaagcagcagctgtggaagagcatcatgttcctggtgctgctgccctacctgaaggtgaagctggagaagctggtgagcagcctgcgggaggaggatgagtacagcatccacccccccagcagccgctggaagcgcttctaccgggccttcctggccgcctacccctttgtgaacatggcctgggagggctggttcctggtgcagcagctgcgctacatcctgggcaaggcccagcaccacagccccctgctgcggctggccggcgtgcagctgggccgcctgactgtgcaggacatccaggccctggagcacaagccagccaaggcctccatgatgcagcagcctgcccggtctgtgtctgagaagatcaacagcgccctgaagaaggctgtgggcggcgtggccctgagcctgagcacaggcctgtctgtgggcgtcttcttcctgcagttcctggactggtggtacagcagcgagaaccaggagaccatcaagagcctgacagccctgcccaccccacctcctcctgtgcacctggactacaacagcgacagccccctgctgcccaagatgaagacagtgtgccccaagaagaagaagaagaaggagaggaagaagaagaaggagaggaagaaggagaggaggtag

SEQ ID NO: 36754 - DNA, 588 bp, Artificial Sequence
  Description of Artificial Sequence: Synthetic coding sequence
atggccccagctgccagccggctgcgggcagaggccggcctgggcgccctgccccggcgggccctggcccagtacctgctcttcctgcggctgtaccctgtgctgaccaaggccgccaccagcggcatcctgagcgccctgggcaacttcctggcccagatgattgagaagaagaggaagaaggagaacagccgcagcctggatgtgggcggccccctgcgctatgctgtgtatggcttcttcttcaccggccccctgagccacttcttctacttcttcatggagcactggatccccccagaggtgcccctggccggcctgcggcggctgctgctggaccggctggtgtttgccccagccttcctgatgctgttcttcctgatcatgaacttcctggagggcaaggatgccagcgcctttgctgccaagatgaggggcggcttctggccagccctgaggatgaactggagggtgtggacccccctgcagttcatcaacatcaactacgtgcccctgaagttccgggtgctgtttgccaacctggccgccctcttctggtacgcctacctggccagcctgggcaagtag

SEQ ID NO: 36755 - DNA, 504 bp, Artificial Sequence
  Description of Artificial Sequence: Synthetic coding sequence
atgcccttcaccggggagcggcggctgagcctgcggcggcaggatgaaggaggcctgctggccggggctgaagatgagctggccggcgtggatgccaccaccgtgcaccagcaccagctgcggcccagcgaggtgcctggggccctgcggcagcccggcagctctgtgctggtgtgcctgcccggcctgctgggggaggtgaccacagctggccgcaccagcggggccctgtggacctgggtgtggggcagccacccccccagcgagagcaggaccaaccctgtgaggatgagcctgaccctgaaccaggcccggaccaccgtgtctgaccagagagctgaggaggagcggggcatctggggccggcgggccggcgtgcaggccggccccctgcagagccagggccatgctgcccacctgccccaccaggccttccctgtgccccggggctggctgcctggagagggcccccacagcgaccctgctggcagcggggccggctag

SEQ ID NO: 36756 - DNA, 216 bp, Artificial Sequence
  Description of Artificial Sequence: Synthetic coding sequence
atggccgccccaccccagctgcgggccctgctggtggtggtgaatgccctgctgaggaagaggcgctaccacgccgccctggccgtgctgaagggcttcagaaatggagctgtgtatggagccaagatccgggcccctcatgccctggtgatgaccttcctgttcagaaatggccgcagcacctgcacctgctgccacgccagctgcctgccctag

SEQ ID NO: 36757 - DNA, 639 bp, Artificial Sequence
  Description of Artificial Sequence: Synthetic coding sequence
atggccgccccaccccagctgcgggccctgctggtggtggtgaatgccctgctgaggaagaggcgctaccacgccgccctggccgtgctgaagggcttcagaaatggagctgtgtatggagccaagatccgggcccctcatgccctggtgatgaccttcctgttcagaaatggcagcctgcaggagaagctgtgggccatcctgcaggccacctacatccacagctggaacctggccaggtttgtgttcacctacaagggcctgcgggccctgcagagctacatccagggcaagacctacccagcccacgccttcctggccgccttcctgggcggcatcctggtgtttggagagaacaacaacatcaacagccagatcaacatgtacctgctgagccgggtgctgtttgccctgagccggctggccgtggagaagggctacatccctgagccccgctgggaccccttccccctgctgacagctgtggtgtggggcctggtgctgtggctgtttgagtaccacaggagcaccctgcagcccagcctgcagagctccatgacctacctgtatgaggacagcaatgtgtggcatgacatcagtgacttcctggtgtacaacaagagccggcccagcaactag

SEQ ID NO: 36758 - DNA, 528 bp, Artificial Sequence
  Description of Artificial Sequence: Synthetic coding sequence
atgatccgctgtggcctggcctgtgagcgctgccgctggatcctgcccctgctgctgctgagtgaccacggccagaccagcagcctgtggtggaagtgcagccaggagggcggcggcagcggcagctatgaggagggctgccagagcctgatggagtatgcctggggccgggctgctgctgccatgctgttctgtggcttcatcatcctggtgatctgcttcatcctgtccttctttgccctgtgtggcccccagatgctggtgttcctgcgggtgattggaggcctgctggccctggccgctgtgttccagatcatcagcctggtgatctaccctgtgaagtacacccagaccttcaccctgcacgccaacccagctgtgacctacatctacaactgggcctacggcttcggctgggccgccaccatcatcctgattggctgtgccttcttcttctgctgcctgcccaactatgaagatgacctgctgggcaatgccaagccccgctacttctacaccagcgcctag

SEQ ID NO: 36759 - DNA, 582 bp, Artificial Sequence
  Description of Artificial Sequence: Synthetic coding sequence
atgatccgctgtggcctggcctgtgagcgctgccgctggatcctgcccctgctgctgctgagcgccatcgcctttgacatcatcgccctggccggccggggctggctgcagagcagtgaccacggccagaccagcagcctgtggtggaagtgcagccaggagggcggcggcagcggcagctatgaggagggctgccagagcctgatggagtatgcctggggccgggctgctgctgccatgctgttctgtggcttcatcatcctggtgatctgcttcatcctgtccttctttgccctgtgtggcccccagatgctggtgttcctgcgggtgattggaggcctgctggccctggccgctgtgttccagatcatcagcctggtgatctaccctgtgaagtacacccagaccttcaccctgcacgccaacccagctgtgacctacatctacaactgggcctacggcttcggctgggccgccaccatcatcctgattggctgtgccttcttcttctgctgcctgcccaactatgaagatgacctgctgggcaatgccaagccccgctacttctacaccagcgcctag

SEQ ID NO: 36760 - DNA, 1674 bp, Artificial Sequence
  Description of Artificial Sequence: Synthetic coding sequence
atggccgcccccatgctgcgctggggctgccggggccgccgctgggcctttgcccgggtggatggcggcagctgccacagaagaggagcccccaccggcagcaccagcaaccagatccggggggagagctctgtggcccagcagcccctgcacacagcccagaagaccaggaagggggagcacaagtgggccgctgtggtgggcctggagatccacgcccagatcagcagcaacagcaagctgttcagcggcagccaggtgcgcttcagcgccccacccaacagcctggtgtccttctttgatgccagcctgcccggcaccctgcctgtgctgaacagaagatgtgtggaggccgctgtgatgacaggcctggccctgaactgccacatcaacaagaagagcctgtttgacaggaagcactacttctacgccgacctgcctgctggctaccagatcacccagcagaggctgcccatcgctgtgaatggcagcctcatctatggagtgtgtgccggcaagaagcagagccaggtgatccccaagacagtgcgcatcaagcagatccagctggagcaggacagcggcaagagcctgcatgacaacctgcggagccagaccctgattgacctgaacagagctggggtgggcctgctggaggtggtgctggagccagacatgagctgtggggaggaggccgccacagctgtgcgggagctgcagctgatcctgcaggccctgggcaccagccaggccaacatggccgagggccagctgcgggtggatgccaacatctctgtgcaccaccctggagagcccctgggcgtgaggacagaggtgaagaacctgaacagcatccgcttcctggccaaggccatcgactatgagatccagaggcagatcaatgagctggagaatggaggagagatcctgaatgagaccaggagcttccaccacaagctgggctgcaccatgtccatgagggacaaggagggcaagcaggactaccgcttcatgcctgagcccaacctgccccccctggtgctgtatgatgccaccagcctgcctgctggagctgacccccagcaggtgatcaacatcgaccagatccgggagaccctgcctgagctgcccagcgtgacccgggagaagctggtgcagcagtatggcatgctgctggagcacagcttcaccctgctgaatgaggtgggcctgctggagttcttccagaatgtcatcaaggagaccagggctgagcccaagaaggtgacctcctgggtgctgaacaccttcctgggctacctgaagcagcagaacctggccgtgtctgagagccctgtgaccccatctgccctggccgagctgctggacctgctggacagcaggaccatcagcagcagcgctgccaagcaggtgtttgaggagctgtggaagcgggagggcaagaccccaggccagatcgtgtctgagaagcagctggagctgatgcaggaccagggcgccctggagcagctgtgccacagcgtgatggaggcccacccccaggtggtgatggatgtgaagaacagaaacccccgggccatcaacaagctgattggcctggtgaggaaggccacccagagcagagctgaccctgtgatgatcaaggagatcctggagaagaagctgagcctgtag

SEQ ID NO: 36761 - DNA, 786 bp, Artificial Sequence
  Description of Artificial Sequence: Synthetic coding sequence
atgcacggcatcggccccagcggcagcttcacagagttcctggaccccttccagagggtcatccagcctgaggagatctggctgtacaagaaccccctggtgcagagcgacaacatccccacccggctgatgtttgccatctccttcctgacccccctggccgtcatctgtgtggtgaagatcatcagaagaacagacaagacagagatcaaggaggccttcctggccgtgtccctggccctggccctgaatggagtgtgcaccaacaccatcaagctgattgtgggccggcccaggccagacttcttctaccgctgcttcccagatggagtgatgaacagcgagatgcactgcacaggagaccctgacctggtgtctgagggcaggaagagcttccccagcatccacagcagctttgccttcagcggcctgggcttcaccaccttctacctggccggcaagctgcactgcttcacagaaagtggccggggcaagtcctggaggctgtgtgccgccatcctgcccctgtactgtgccatgatgattgccctgagcaggatgtgtgactacaagcaccactggcaggacagctttgtgggcggcgtgattggcctcatctttgcctacatctgctaccggcagcactacccacccctggccaacacagcctgccacaagccctacgtgtccctgcgggtgcctgccagcctgaagaaggaggagcggcccacagctgacagcgcccccagcctgcccctggagggcatcacagagggccctgtgtag

SEQ ID NO: 36762 - DNA, 291 bp, Artificial Sequence
  Description of Artificial Sequence: Synthetic coding sequence
atgagggagctggccatcgagattggagtgcgggccctgctgtttggagtgtttgtgttcacagagttcctggaccccttccagagggtcatccagcctgaggagatctggctgtacaagaaccccctggtgcagagcgacaacatccccacccggctgatgttcatccccctgtgggtggagagcagcgccagcttcctgcacacctttgccacagacagcaccatcctgctgtggcccacccagctggccatcaaccccaccctggtgtgtgagagccagccccactag

SEQ ID NO: 36763 - DNA, 816 bp, Artificial Sequence
  Description of Artificial Sequence: Synthetic coding sequence
atgagggagctggccatcgagattggagtgcgggccctgctgtttggagtgtttgtgttcacagagttcctggaccccttccagagggtcatccagcctgaggagatctggctgtacaagaaccccctggtgcagagcgacaacatccccacccggctgatgtttgccatctccttcctgacccccctggccgtcatctgtgtggtgaagatcatcagaagaacagacaagacagagatcaaggaggccttcctggccgtgtccctggccctggccctgaatggagtgtgcaccaacaccatcaagctgattgtgggccggcccaggccagacttcttctaccgctgcttcccagatggagtgatgaacagcgagatgcactgcacaggagaccctgacctggtgtctgagggcaggaagagcttccccagcatccacagcagctttgccttcagcggcctgggcttcaccaccttctacctggccggcaagctgcactgcttcacagaaagtggccggggcaagtcctggaggctgtgtgccgccatcctgcccctgtactgtgccatgatgattgccctgagcaggatgtgtgactacaagcaccactggcaggacagctttgtgggcggcgtgattggcctcatctttgcctacatctgctaccggcagcactacccacccctggccaacacagcctgccacaagccctacgtgtccctgcgggtgcctgccagcctgaagaaggaggagcggcccacagctgacagcgcccccagcctgcccctggagggcatcacagagggccctgtgtag

SEQ ID NO: 36764 - DNA, 804 bp, Artificial Sequence
  Description of Artificial Sequence: Synthetic coding sequence
atgagggagctggccatcgagattggagtgcgggccctgctgtttggagtgtttgtgttcacagagttcctggaccccttccagagggtcatccagcctgaggagatctggctgtacaagaaccccctggtgcagagcgacaacatccccacccggctgatgtttgccatctccttcctgacccccctggccgtcatctgtgtggtgaagatcatcagaagaacagacaagacagagatcaaggaggccttcctggccgtgtccctggccctggccctgaatggagtgtgcaccaacaccatcaagctgattgtgggccggcccaggccagacttcttctaccgctgcttcccagatggagtgatgaacagcgagatgcactgcacaggagaccctgacctggtgtctgagggcaggaagagcttccccagcatccacagcagctttgccttcagcggcctgggcttcaccaccttctacctggccggcaagctgcactgcttcacagaaagtggccggggcaagtcctggaggctgtgtgccgccatcctgcccctgtactgtgccatgatgattgccctgagcaggatgtgtgactacaagcaccactggcaggacagctttgtgggcggcgtgattggcctcatctttgcctacatctgctaccggcagcactacccacccctggccaacacagcctgccacaagccctacgtgtccctgcgggtgcctgccagcctgaagaaggaggagcggcccacagctgacagcgcccccagcctgcccctggagggcatcacctag

SEQ ID NO: 36765 - DNA, 627 bp, Artificial Sequence
  Description of Artificial Sequence: Synthetic coding sequence
atgagggagctggccatcgagattggagtgcgggccctgctgtttggagtgtttgtgttcacagagttcctggaccccttccagagggtcatccagcctgaggagatctggctgtacaagaaccccctggtgcagagcgacaacatccccacccggctgatgtttgccatctccttcctgacccccctggccgtcatctgtgtggtgaagatcatcagaagaacagacaagacagagatcaaggaggccttcctggtggccttcagcggcctgggcttcaccaccttctacctggccggcaagctgcactgcttcacagagagcggccggggcaagtcctggaggctgtgtgccgccatcctgcccctgtactgtgccatgatgattgccctgagcaggatgtgtgactacaagcaccactggcaggacagctttgtgggcggcgtcatcggcctcatctttgcctacatctgctaccggcagcactacccacccctggccaacacagcctgccacaagccctacgtgtccctgcgggtgcctgccagcctgaagaaggaggagcggcccacagctgacagcgcccccagcctgcccctggagggcatcacagagggccctgtgtag

SEQ ID NO: 36766 - DNA, 702 bp, Artificial Sequence
  Description of Artificial Sequence: Synthetic coding sequence
atgagggagctggccatcgagattggagtgcgggccctgctgtttggagtgtttgtgttcacagagttcctggaccccttccagagggtcatccagcctgaggagatctggctgtacaagaaccccctggtgcagagcgacaacatccccacccggctgatgtttgccatctccttcctgacccccctggccgtcatctgtgtggtgaagatcatcagaagaacagacaagacagagatcaaggaggccttcctggccgtgtccctggccctggccctgaatggagtgtgcaccaacaccatcaagctgattgtgggccggcccaggccagacttcttctaccgctgcttcccagatggagtgatgaacagcgagatgcactgcacaggagaccctgacctggtgtctgagggcaggaagagcttccccagcatccacagcagctttgccttcagcggcctgggcttcaccaccttctacctggccggcaagctgcactgcttcacagaaagtggccggggcaagtcctggaggctgtgtgccgccatcctgcccctgtactgtgccatgatgattgccctgagcaggatgtgtgactacaagcaccactggcaggtgggctgctgcgtgtggcagggcccccagagccacctgcccagcgctgccaacccccggctgtgcctgggcaccagcgagccctag

SEQ ID NO: 36767 - DNA, 456 bp, Artificial Sequence
  Description of Artificial Sequence: Synthetic coding sequence
atgcctgccagccagagccgggcccgggcccgggacagaaataatgtgctgaacagagctgagttcctgagcctgaaccagccccccaagggcggccctgagcccaggagcagcggcaggaaggccagcggccccagcgcccagcccccacctgctggagatggagcccgggagcggcggcagagccagcagctgcctgaggaggactgcatgcagctgaaccccagcttcaagggcatcgccttcaacagcctgctggccatcgacatctgcatgagcaagaggctgggcgtgtgtgccggccgggccgcctcctgggccagcgcccgctccatggtgaagctgattggcatcactggacatggcatcccctggattggaggcaccatcctgtgcctggtgaagagcagcaccctggccggccaggaggtgctgatgaacctgctgctggactag

SEQ ID NO: 36768 - DNA, 816 bp, Artificial Sequence
  Description of Artificial Sequence: Synthetic coding sequence
atgcctgccagccagagccgggcccgggcccgggacagaaataatgtgctgaacagagctgagttcctgagcctgaaccagccccccaagggcggccctgagcccaggagcagcggcaggaaggccagcggccccagcgcccagcccccacctgctggagatggagcccgggagcggcggcagagccagcagctgcctgaggaggactgcatgcagctgaaccccagcttcaagggcatcgccttcaacagcctgctggccatcgacatctgcatgagcaagaggctgggcgtgtgtgccggccgggccgcctcctgggccagcgcccgctccatggtgaagctgattggcatcactggacatggcatcccctggattggaggcaccatcctgtgcctggtgaagagcagcaccctggccggccaggaggtgctgatgaacctgctgctggccctgctgctggacatcatgacagtggccggcgtgcagaagctgatcaagaggcggggcccctatgagaccagccccagcctgctggactacctgaccatggacatctatgccttccctgctggccacgccagcagagctgccatggtgtccaagttcttcctgagccacctggtgctggccgtgcccctgcgggtgctgctggtgctgtgggccctgtgtgtgggcctgagccgggtgatgattggccgccaccacgtgacagatgtgctgagcggcttcgtcatcggctacctgcagttccggctggtggagctggtgtggatgcccagcagcacctgccagatgctgatcagcgcctggtag

SEQ ID NO: 36769 - DNA, 858 bp, Artificial Sequence
  Description of Artificial Sequence: Synthetic coding sequence
atgtttgacaagacccggctgccctacgtggccctggatgtgctgtgtgtgctgctggcctccatgcccatggctgtgctgaagctgggccagatctaccccttccagaggggcttcttctgcaaggacaacagcatcaactacccctaccatgacagcacagtgaccagcacagtgctgatcctggtgggcgtgggcctgcccatcagcagcatcatcctgggggagaccctgtctgtgtactgcaacctgctgcacagcaacagcttcatccggaacaactacatcgccaccatctacaaggccatcggcaccttcctgtttggagctgctgccagccagagcctgacagacatcgccaagtacagcatcggccgcctgcggccccacttcctggatgtgtgtgaccctgactggagcaagatcaactgcagtgatggctacatcgagtactacatctgcagaggaaatgctgagcgggtgaaggagggccgcctgtccttctacagcggccacagcagcttctccatgtactgcatgctgtttgtggccctgtacctgcaggccaggatgaagggggactgggcccggctgctgcggcccaccctgcagtttggcctggtggccgtgtccatctacgtgggcctgagccgggtgtctgactacaagcaccactggagcgatgtgctgaccggcctcatccagggcgccctggtggccatcctggtggccgtgtatgtgtctgacttcttcaaggagaggaccagcttcaaggagaggaaggaggaggacagccacaccaccctgcacgagacccccaccactggaaaccactaccccagcaaccaccagccctag

SEQ ID NO: 36770 - DNA, 855 bp, Artificial Sequence
  Description of Artificial Sequence: Synthetic coding sequence
atgtttgacaagacccggctgccctacgtggccctggatgtgctgtgtgtgctgctggccggcctgccctttgccatcctgaccagccgccacacccccttccagaggggcgtcttctgcaatgatgagagcatcaagtacccctacaaggaggacaccatcccctatgccctgctgggcggcatcatcatccccttcagcatcatcgtcatcatcctgggggagaccctgtctgtgtactgcaacctgctgcacagcaacagcttcatccggaacaactacatcgccaccatctacaaggccatcggcaccttcctgtttggagctgctgccagccagagcctgacagacatcgccaagtacagcatcggccgcctgcggccccacttcctggatgtgtgtgaccctgactggagcaagatcaactgcagtgatggctacatcgagtactacatctgcagaggaaatgctgagcgggtgaaggagggccgcctgtccttctacagcggccacagcagcttctccatgtactgcatgctgtttgtggccctgtacctgcaggccaggatgaagggggactgggcccggctgctgcggcccaccctgcagtttggcctggtggccgtgtccatctacgtgggcctgagccgggtgtctgactacaagcaccactggagcgatgtgctgaccggcctcatccagggcgccctggtggccatcctggtggccgtgtatgtgtctgacttcttcaaggagaggaccagcttcaaggagaggaaggaggaggacagccacaccaccctgcacgagacccccaccaccggcaaccactaccccagcaaccaccagccctag

SEQ ID NO: 36771 - DNA, 936 bp, Artificial Sequence
  Description of Artificial Sequence: Synthetic coding sequence
atgcagaactacaagtatgacaaggccatcgtgcctgagagcaagaatggaggcagccctgccctgaacaacaaccccaggagaagtggcagcaagagggtgctgctgatctgcctggacctcttctgcctcttcatggccggcctgcccttcctgatcatcgagaccagcaccatcaagccctaccaccggggcttctactgcaatgatgagagcatcaagtaccccctgaagacaggagagaccatcaatgatgctgtgctgtgtgctgtgggcatcgtgattgccatcctggccatcatcaccggggagttctaccgcatctactacctgaagaagagccgcagcaccatccagaacccctacgtggccgccctgtacaagcaggtgggctgcttcctgtttggctgtgccatcagccagagcttcacagacatcgccaaggtgtccatcggccgcctgcggccccacttcctgtctgtgtgcaacccagacttcagccagatcaactgcagcgagggctacatccagaactaccgctgcagaggagatgacagcaaggtgcaggaggccaggaagagcttcttcagcggccacgccagcttctccatgtacaccatgctgtacctggtgctgtacctgcaggcccgcttcacctggaggggggcccggctgctgcggcccctgctgcagttcaccctcatcatgatggccttctacacaggcctgagccgggtgtctgaccacaagcaccaccccagtgatgtgctggccggctttgcccagggcgccctggtggcctgctgcatcgtgttctttgtgtctgacctcttcaagaccaagaccaccctgagcctgcctgccccagccatcaggaaggagatcctgagccctgtggacatcatcgacaggaacaaccaccacaacatgatgtag

SEQ ID NO: 36772 - DNA, 867 bp, Artificial Sequence
  Description of Artificial Sequence: Synthetic coding sequence
atgcagaggcgctgggtgtttgtgctgctggatgtgctgtgcctgctggtggccagcctgccctttgccatcctgaccctggtgaatgccccctacaagaggggcttctactgtggagatgacagcatccgctacccctacagaccagacaccatcacccacggcctgatggccggcgtgaccatcacagccaccgtcatcctggtgtctgctggggaggcctacctggtgtacacagaccggctgtacagcagaagtgacttcaacaactacgtggccgctgtgtacaaggtgctgggcaccttcctgtttggagctgctgtgtcccagagcctgacagacctggccaagtacatgattggccgcctgcggcccaacttcctggccgtgtgtgaccctgactggagccgggtgaactgcagcgtgtatgtgcagctggagaaggtgtgccggggcaacccagcagatgtgacagaggcccggctgtccttctacagcggccacagcagctttggcatgtactgcatggtgttcctggccctgtatgtgcaggcccggctgtgctggaagtgggcccggctgctgcggcccaccgtgcagttcttcctggtggcctttgccctgtatgtgggctacaccagggtgtctgactacaagcaccactggagcgatgtgctggtgggcctgctgcagggcgccctggtggccgccctgactgtgtgctacatcagtgacttcttcaaggcccggcccccccagcactgcctgaaggaggaggagctggagaggaagcccagcctgagcctgaccctgaccctgggggaggccgaccacaaccactacggctacccccacagcagcagctag

SEQ ID NO: 36773 - DNA, 930 bp, Artificial Sequence
  Description of Artificial Sequence: Synthetic coding sequence
atgggcgtggcccggggccctggcagccggggccagcaccccccaccccggcagcaggaggtgtgtgccgagggcccccgggcccggctgcacccagcccctcctggcctgggcgccagcctgccctttgccatcctgaccctggtgaatgccccctacaagaggggcttctactgtggagatgacagcatccgctacccctacagaccagacaccatcacccacggcctgatggccggcgtgaccatcacagccaccgtcatcctggtgtctgctggggaggcctacctggtgtacacagaccggctgtacagcagaagtgacttcaacaactacgtggccgctgtgtacaaggtgctgggcaccttcctgtttggagctgctgtgtcccagagcctgacagacctggccaagtacatgattggccgcctgcggcccaacttcctggccgtgtgtgaccctgactggagccgggtgaactgcagcgtgtatgtgcagctggagaaggtgtgccggggcaacccagcagatgtgacagaggcccggctgtccttctacagcggccacagcagctttggcatgtactgcatggtgttcctggccctgtatgtgcaggcccggctgtgctggaagtgggcccggctgctgcggcccaccgtgcagttcttcctggtggcctttgccctgtatgtgggctacaccagggtgtctgactacaagcaccactggagcgatgtgctggtgggcctgctgcagggcgccctggtggccgccctgactgtgtgctacatcagtgacttcttcaaggcccggcccccccagcactgcctgaaggaggaggagctggagaggaagcccagcctgagcctgaccctgaccctgggggaggccgaccacaaccactacggctacccccacagcagcagctag

SEQ ID NO: 36774 - DNA, 699 bp, Artificial Sequence
  Description of Artificial Sequence: Synthetic coding sequence
atggccggcgtgaccatcacagccaccgtcatcctggtgtctgctggggaggcctacctggtgtacacagaccggctgtacagcagaagtgacttcaacaactacgtggccgctgtgtacaaggtgctgggcaccttcctgtttggagctgctgtgtcccagagcctgacagacctggccaagtacatgattggccgcctgcggcccaacttcctggccgtgtgtgaccctgactggagccgggtgaactgcagcgtgtatgtgcagctggagaaggtgtgccggggcaacccagcagatgtgacagaggcccggctgtccttctacagcggccacagcagctttggcatgtactgcatggtgttcctggccctgtatgtgcaggcccggctgtgctggaagtgggcccggctgctgcggcccaccgtgcagttcttcctggtggcctttgccctgtatgtgggctacaccagggtgtctgactacaagcaccactggagcgatgtgctggtgggcctgctgcagggcgccctggtggccgccctgactgtgtgctacatcagtgacttcttcaaggcccggcccccccagcactgcctgaaggaggaggagctggagaggaagcccagcctgagcctgaccctgaccctgggggaggccgaccacaaccactacggctacccccacagcagcagctag

SEQ ID NO: 36775 - DNA, 711 bp, Artificial Sequence
  Description of Artificial Sequence: Synthetic coding sequence
atgaagaggagcggcaaccctggagctgaggtgaccaacagctctgtggccggccctgactgctgcggcggcctgggcaacatcgacttccggcaggccgacttctgtgtgatgacccggctgctgggctacgtggaccccctggaccccagctttgtggccgctgtgatcaccatcaccttcaaccccctgtactggaatgtggtggcccgctgggagcacaagaccaggaagctgagccgggccttcggcagcccctacctggcctgctacagcctgtctgtgaccatcctgctgctgaacttcctgcggagccactgcttcacccaggccatgctgagccagcccaggatggagagcctggacaccccagctgcctacagcctgggcctggccctgctgggcctgggcgtggtgctggtgctgagcagcttctttgccctgggctttgctggcaccttcctgggggactacttcggcatcctgaaggaggcccgggtgaccgtcttccccttcaacatcctggacaaccccatgtactggggcagcacagccaactacctgggctgggccatcatgcacgccagccccaccggcctgctgctgactgtgctggtggccctgacctacatcgtggccctgctgtatgaggagcccttcaccgctgagatctaccggcagaaggccagcggcagccacaagaggagctag

SEQ ID NO: 36776 - DNA, 699 bp, Artificial Sequence
  Description of Artificial Sequence: Synthetic coding sequence
atgaagaggagcggcaaccctggagctgaggtgaccaacagctctgtggccggccctgactgctgcggcggcctgggcaacatcgacttccggcaggccgacttctgtgtgatgacccggctgctgggctacgtggaccccctggaccccagctttgtggccgctgtgatcaccatcaccttcaaccccctgtactggaatgtggtggcccgctgggagcacaagaccaggaagctgagccgggccttcggcagcccctacctggcctgctacagcctgtctgtgaccatcctgctgctgaacttcctgcggagccactgcttcacccaggccatgctgagccagcccaggatggagagcctggacaccccagctgcctacagcctgggcctggccctgctgggcctgggcgtggtgctggtgctgagcagcttctttgccctgggctttgctggcaccttcctgggggactacttcggcatcctgaaggaggcccgggtgaccgtcttccccttcaacatcctggacaaccccatgtactggggcagcacagccaactacctgggctgggccatcatcccagccccagctggagctgtgggcagcgaggcccggcagccccacggccctgccccagatggagctgggggcccccacctgcacagcggcagccccatcagaagagccctgcacaggtag

SEQ ID NO: 36777 - DNA, 600 bp, Artificial Sequence
  Description of Artificial Sequence: Synthetic coding sequence
atgacccggctgctgggctacgtggaccccctggaccccagctttgtggccgccgtcatcaccatcaccttcaaccccctgtactggaatgtggtggcccgctgggagcacaagaccaggaagctgagccgggccttcggcagcccctacctggcctgctacagcctgtctgtgaccatcctgctgctgaacttcctgcggagccactgcttcacccaggccatgctgagccagcccaggatggagagcctggacaccccagctgcctacagcctgggcctggccctgctgggcctgggcgtggtgctggtgctgagcagcttctttgccctgggctttgctggcaccttcctgggggactacttcggcatcctgaaggaggcccgggtgacagtgttccccttcaacatcctggacaaccccatgtactggggcagcacagccaactacctgggctgggccatcatgcacgccagccccaccggcctgctgctgactgtgctggtggccctgacctacatcgtggccctgctgtatgaggagcccttcaccgctgagatctaccggcagaaggccagcggcagccacaagaggagctag

SEQ ID NO: 36778 - DNA, 600 bp, Artificial Sequence; identical to SEQ ID NO: 36777
  Description of Artificial Sequence: Synthetic coding sequence

SEQ ID NO: 36779 - DNA, 642 bp, Artificial Sequence
  Description of Artificial Sequence: Synthetic coding sequence
atgaagaggagcggcaaccctggagctgaggtgaccaacagctctgtggccggccctgactgctgcggcggcctgggcaacatcgacttccggcaggccgacttctgtgtgatgacccggctgctgggctacgtggaccccctggaccccagctttgtggccgctgtgatcaccatcaccttcaaccccctgtactggaatgtggtggcccgctgggagcacaagaccaggaagctgagccgggccttcggcagcccctacctggcctgctacagcctgtctgtgaccatcctgctgctgaacttcctgcggagccactgcttcacccaggccatgctgagccagcccaggatggagagcctggacaccccagctgcctacagcctgggcctggccctgctgggcctgggcgtggtgctggtgctgagcagcttctttgccctgggctttgctggcaccttcctgggggactacttcggcatcctgaaggaggcccgggtgaccgtcttccccttcaacatcctggacaaccccatgtactggggcagcacagccaactacctgggctgggccatcatcctgtgcccctgtggccgctaccccttcccccagaggggcccccgggccatgagggaggcctag

SEQ ID NO: 36780 - DNA, 636 bp, Artificial Sequence
  Description of Artificial Sequence: Synthetic coding sequence
atgaagaggagcggcaaccctggagctgaggccgacttctgtgtgatgacccggctgctgggctacgtggaccccctggaccccagctttgtggccgctgtgatcaccatcaccttcaaccccctgtactggaatgtggtggcccgctgggagcacaagaccaggaagctgagccgggccttcggcagcccctacctggcctgctacagcctgtctgtgaccatcctgctgctgaacttcctgcggagccactgcttcacccaggccatgctgagccagcccaggatggagagcctggacaccccagctgcctacagcctgggcctggccctgctgggcctgggcgtggtgctggtgctgagcagcttctttgccctgggctttgctggcaccttcctgggggactacttcggcatcctgaaggaggcccgggtgaccgtcttccccttcaacatcctggacaaccccatgtactggggcagcacagccaactacctgggctgggccatcatcagccctgccccagctggagctgtgggcagcgaggcccggcagccccacggccctgccccagatggagctgggggcccccacctgcacagcggcagccccatccggcgggccctgcacaggtag

SEQ ID NO: 36781 - DNA, 684 bp, Artificial Sequence
  Description of Artificial Sequence: Synthetic coding sequence
atgggctggaccatgaggctggtgacagctgccctgctgctgggcctgatgatggtggtgactggagatgaagatgagaacagcccctgtgcccacgaggccctgctggatgaggacaccctcttctgccagggcctggaggtgttctacccagagctgggcaacatcggctgcaaggtggtgcctgactgcaacaactaccggcagaagatcacctcctggatggagcccatcgtgaagtttcctggagctgtggatggagccacctacatcctggtgatggtggaccctgatgcccccagcagagctgagccccggcagcgcttctggaggcactggctggtgacagacatcaagggagctgacctgaagaagggcaagatccagggccaggagctgagcgcctaccaggcccccagccccccagcccacagcggcttccaccgctaccagttctttgtgtacctgcaggagggcaaggtgatcagcctgctgcccaaggagaacaagacccggggctcctggaagatggaccgcttcctgaaccgcttccacctgggggagcctgaggccagcacccagttcatgacccagaactaccaggacagccccaccctgcaggccccccgggagcgggccagcgagcccaagcacaagaaccaggccgagattgctgcctgctag

SEQ ID NO: 36782 - DNA, 1671 bp, Artificial Sequence
  Description of Artificial Sequence: Synthetic coding sequence
atggctgtggccgctgctgctgctgctggccctgtgttctggaggcggctgctgggcctgctgcccggccggcccggcctggccgccctgctgggccgcctgagtgaccggctgggcaggaacagagaccggcagaggagaagaagcccctggctgctgctggcccccctgctgagccctgctgtgccccaggtgaccagccccccctgctgcctgtgcccagagggcgtgcaccgcttccagtggatccggaacctggtgcctgagtttggagtgagcagcagccacgtgcgggtgctgagcagccctgctgagttctttgagctgatgaagggccagatccgggtggccaagagaagagtggtgatggccagcctgtacctgggcaccggccccctggagcaggagctggtggactgcctggagagcaccctggagaagagcctgcaggccaagttccccagcaacctgaaggtgtccatcctgctggacttcacccggggcagccggggcaggaagaacagcaggaccatgctgctgcccctgctgcggcgcttccctgagcaggtgcgggtgtccctcttccacaccccccacctgcggggcctgctgcggctgctgatccctgagcgcttcaatgagaccatcggcctgcagcacatcaaggtgtacctgtttgacaacagcgtcatcctgagcggggccaacctgagtgacagctacttcaccaaccggcaggacagatatgtgttcctgcaggactgtgccgagattgctgacttcttcacagagctggtggatgctgtgggagatgtgtccctgcagctgcagggagatgacacagtgcaggtggtggatggcatggtgcacccctacaagggggacagagctgagtactgcaaggccgccaacaagagggtgatggatgtgatcaacagcgcccggacccggcagcagatgctgcacgcccagaccttccacagcaacagcctgctgacccaggaggatgctgctgctgctggggacagaagacctgccccagacacctggatctaccccctcatccagatgaagccctttgagatccagattgatgaaattgtgacagagaccctgctgacagaggccgagcggggggccaaggtgtacctgaccaccggctacttcaacctgacccaggcctacatggacctggtgctgggcaccagggctgagtaccagatcctgctggccagccctgaggtgaatggcttctttggagccaagggcgtggccggggccatcccagctgcctacgtgcacatcgagcggcagttcttcagcgaggtgtgcagcctgggccagcaggagcgggtgcagctgcaggagtactggaggcggggctggaccttccacgccaagggcctgtggctgtacctggccggcagcagcctgccctgcctgaccctcatcggcagccccaactttggctacagatctgtgcaccgggacctggaggcccagatcgccatcgtgacagagaaccaggccctgcagcagcagctgcaccaggagcaggagcagctgtacctgcggtctggagtggtgtcctctgccacctttgagcagcccagccggcaggtgaagctgtgggtgaagatggtgacccccctcatcaagaacttcttctag

SEQ ID NO: 36783 - DNA, 1266 bp, Artificial Sequence
  Description of Artificial Sequence: Synthetic coding sequence
atgaaggtggactgcctggagagcaccctggagaagagcctgcaggccaagttccccagcaacctgaaggtgtccatcctgctggacttcacccggggcagccggggcaggaagaacagcaggaccatgctgctgcccctgctgcggcgcttccctgagcaggtgcgggtgtccctcttccacaccccccacctgcggggcctgctgcggctgctgatccctgagcgcttcaatgagaccatcggcctgcagcacatcaaggtgtacctgtttgacaacagcgtcatcctgagcggggccaacctgagtgacagctacttcaccaaccggcaggaccgctacgtgttcctgcaggactgtgccgagattgctgacttcttcacagagctggtggatgctgtgggagatgtgtccctgcagctgcagggagatgacacagtgcaggtggtggatggcatggtgcacccctacaagggggacagagctgagtactgcaaggccgccaacaagagggtgatggatgtgatcaacagcgcccggacccggcagcagatgctgcacgcccagaccttccacagcaacagcctgctgacccaggaggatgctgctgctgctggggaccggcggcctgccccagacacctggatctaccccctcatccagatgaagccctttgagatccagattgatgagatcgtgacagagaccctgctgacagaagctgagcggggggccaaggtgtacctgaccaccggctacttcaacctgacccaggcctacatggacctggtgctgggcaccagggctgagtaccagatcctgctggccagccctgaggtgaatggcttcttcggggccaagggcgtggccggggccatcccagctgcctacgtgcacatcgagcggcagttcttcagcgaggtgtgcagcctgggccagcaggagcgggtgcagctgcaggagtactggaggcggggctggaccttccacgccaagggcctgtggctgtacctggccggcagcagcctgccctgcctgaccctgattggcagccccaactttggctacagatctgtgcaccgggacctggaggcccagatcgccatcgtgacagagaaccaggccctgcagcagcagctgcaccaggagcaggagcagctgtacctgcggtctggagtggtgagcagcgccacctttgagcagcccagccggcaggtgaagctgtgggtgaagatggtgacccccctcatcaagaacttcttctag

SEQ ID NO: 36784 - DNA, 807 bp, Artificial Sequence
  Description of Artificial Sequence: Synthetic coding sequence
atgaaggtggactgcctggagagcaccctggagaagagcctgcaggccaagttccccagcaacctgaaggtgtccatcctgctggacttcacccggggcagccggggcaggaagaacagcaggaccatgctgctgcccctgctgcggcgcttccctgagcaggtgcgggtgtccctcttccacaccccccacctgcggggcctgctgcggctgctgatccctgagcgcttcaatgagaccatcggcctgcagcacatcaaggtgtacctgtttgacaacagcgtcatcctgagcggggccaacctgagtgacagctacttcaccaaccggcaggaccgctacgtgttcctgcaggactgtgccgagattgctgacttcttcacagagctggtggatgctgtgggagatgtgtccctgcagctgcagggagatgacacagtgcaggtggtggatggcatggtgcacccctacaagggggacagagctgagtactgcaaggccgccaacaagagggtgatggatgtgatcaacagcgcccggacccggcagcagatgctgcacgcccagaccttccacagcaacagcctgctgacccaggaggatgctgctgctgctggggaccggcggcctgccccagacacctggatctaccccctcatccagatgaagccctttgagatccagattgatgagatcgtgacagagaccctgctgacagaagctgagcggggggccaaggtgtacctgaccaccggctacttcaacctgacccaggcctacatgcctggcctgggccacagcggctag

SEQ ID NO: 36785 - DNA, 900 bp, Artificial Sequence
  Description of Artificial Sequence: Synthetic coding sequence
atgccctacaccacctacctggtggagaagggggccagccacagctttgtggccgaggccaagccacccaccgtgaccatgccccgcatcaaggccctgatgacaggcagcctgcccggctttgtggatgtgatccggaacctgaacagccctgccctgctggaggacagcgtcatccggcaggccaaggctgctgggaagagaattgtgttctatggagatgagacctgggtgaagctgttccccaagcactttgtggagtatgatggcaccaccagcttctttgtgtctgactacacagaggtggacaacaacgtgaccaggcacctggacaaggtgctgaagagaggagactgggacatcctgatcctgcactacctgggcctggaccacatcggccacatcagcggccccaacagccccctgattggccagaagctgtctgagatggacagcgtgctgatgaagatccacaccagcctgcagagcaaggagcgggagacccccctgcccaacctgctggtgctgtgtggggaccacggcatgtctgaaacaggcagccacggggccagcagcacagaggaggtgaacacccccctcatcctgatcagcagcgcctttgagaggaagccaggggacatccgccaccccaagcacgtgcagcagacagatgtggccgccaccctggccatcgccctgggcctgcccatccccaaggacagcgtgggcagcctgctcttccctgtggtggagggccggcccatgagggagcagctgcgcttcctgcacctgaacacagtgcagctgagcaagctgctgcaggagaatgtgcccagctatgagaagggcagccacccagccccagcccagaggcccactggaacagcccagaagggctag

SEQ ID NO: 36786 - DNA, 2928 bp, Artificial Sequence
  Description of Artificial Sequence: Synthetic coding sequence
atgaggctgggcagcggcacctttgccacctgctgcgtggccatcgaggtgctgggcattgctgtgttcctgcggggcttcttccctgcccctgtgcgcagcagcgcccgggcagagcacggggctgagcccccagcccctgagcccagcgctggggccagcagcaactggaccaccctgcccccacccctcttcagcaaggtggtgattgtgctgattgatgccctgagagatgactttgtgtttggcagcaaaggagtgaagttcatgccctacaccacctacctggtggagaagggggccagccacagctttgtggccgaggccaagcccccaacagtgaccatgccccgcatcaaggccctgatgacaggcagcctgcccggctttgtggatgtgatccggaacctgaacagccctgccctgctggaggacagcgtcatccggcaggccaaggccgccggcaagagaattgtgttctatggagatgagacctgggtgaagctgttccccaagcactttgtggagtatgatggcaccaccagcttctttgtgtctgactacacagaggtggacaacaacgtgaccaggcacctggacaaggtgctgaagagaggagactgggacatcctgatcctgcactacctgggcctggaccacatcggccacatcagcggccccaacagccccctcatcggccagaagctgtctgagatggattctgtgctgatgaagatccacaccagcctgcagagcaaggagcgggagacccccctgcccaacctgctggtgctgtgtggggaccacggcatgtctgagaccggcagccatggagccagcagcacagaggaggtgaacacccccctcatcctgatcagcagcgcctttgagaggaagccaggggacatccgccaccccaagcacgtgcagcagacagatgtggccgccaccctggccatcgccctgggcctgcccatccccaaggacagcgtgggcagcctgctcttccctgtggtggagggccggcccatgagggagcagctgcgcttcctgcacctgaacacagtgcagctgagcaagctgctgcaggagaatgtgcccagctatgagaaggaccccggctttgagcagttcaagatgtctgagcggctgcacggcaactggatccggctgtacctggaggagaagcacagcgaggtgctcttcaacctgggcagcaaggtgctgcggcagtacctggatgccctgaagaccctgagcctgagcctgagcgcccaggtggcccagtatgacatctacagcatgatggtgctgaccctgctgctgctgtctgtgccccaggccctgcggaggaaggccgagctggaggtgcccctgagcagccctggcttcagcctgctcttctacctggtgatcctggtgctgtctgctgtgcacgtgattgtgtgcaccagcgctgagagcagctgctacttctgtggcctgtcctggctggccgccggcggcgtgatggtgctggccagcgccctgctgtgtgtgattgtgtctgtgctgaccaacgtgctggtgggcggcaacacccccaggaagaaccccatgcaccccagcagccgctggagcgagctggacctgctgatcctgctgggcacagctggccacgtgctgagcctgggcgccagcagctttgtggaggaggagcaccagacctggtacttcctggtgaacaccctgtgcctggccctgagccaggagacctacagaaactacttcctgggagatgatggagagcccccctgtggcctgtgtgtggagcagggccatgatggagccacagctgcctggcaggacggccctggctgtgatgtgctggagcgggacaagggccacggcagccccagcaccagcgaggtgctgcggggccgggagaagtggatggtgctggccagcccctggctgatcctggcctgctgccgcctgctgcggagcctgaaccagacaggagtgcagtgggcccacaggccagacctgggccactggctgaccagcagtgaccacaaggccgagctgtctgtgctggccgccctgagcctgctggtggtgtttgtgctggtgcagaggggctgcagccctgtgtccaaggccgccctggccctgggcctgctgggcgtgtactgctaccgggccgccatcggctctgtgcgcttcccctggaggccagacagcaaggacatcagcaagggcatcatcgaggccaggtttgtgtatgtgtttgtgctgggcatcctcttcaccggcaccaaggacctgctgaagagccaggtgattgctgctgacttcaagctgaagacagtgggcctgtgggagatctacagcggcctggtgctgctggccgccctgctcttccggccccacaacctgcctgtgctggccttcagcctgctgatccagaccctgatgaccaagttcatctggaagcccctgcggcatgatgctgctgagatcaccgtgatgcactactggtttggccaggccttcttctacttccagggcaacagcaacaacatcgccaccgtggacatctctgctggctttgtgggcctggacacctacgtggagatcccagctgtgctgctgacagccttcggcacctacgccggccctgtgctgtgggccagccacctggtgcacttcctgagcagcgagaccaggagcggcagcgccctgagccacgcctgcttctgctacgccctgatctgcagcatccctgtgttcacctacatcgtgctggtgaccagcctgcgctaccacctgttcatctggagcgtcttcagccccaagctgctgtatgagggcatgcacctgctgatcacagctgctgtgtgtgtgttcttcaccgccatggaccagacccggctgacccagagctag

SEQ ID NO: 36787 - DNA, 2553 bp, Artificial Sequence
  Description of Artificial Sequence: Synthetic coding sequence
atgaggctgggcagcggcacctttgccacctgctgcgtggccatcgaggtgctgggcattgctgtgttcctgcggggcttcttccctgcccctgtgcgcagcagcgcccgggcagagcacggggctgagcccccagcccctgagcccagcgctggggccagcagcaactggaccaccctgcccccacccctcttcagcaaggtggtgattgtgctgattgatgccctgagagatgactttgtgtttggcagcaaaggagtgaagttcatgccctacaccacctacctggtggagaagggggccagccacagctttgtggccgaggccaagcccccaacagtgaccatgccccgcatcaaggagcgggagacccccctgcccaacctgctggtgctgtgtggggaccacggcatgtctgaaacaggcagccacggggccagcagcacagaggaggtgaacacccccctcatcctgatcagcagcgcctttgagaggaagccaggggacatccgccaccccaagcacgtgcagcagacagatgtggccgccaccctggccatcgccctgggcctgcccatccccaaggacagcgtgggcagcctgctcttccctgtggtggagggccggcccatgagggagcagctgcgcttcctgcacctgaacacagtgcagctgagcaagctgctgcaggagaatgtgcccagctatgagaaggaccccggctttgagcagttcaagatgtctgagcggctgcacggcaactggatccggctgtacctggaggagaagcacagcgaggtgctcttcaacctgggcagcaaggtgctgcggcagtacctggatgccctgaagaccctgagcctgagcctgagcgcccaggtggcccagtatgacatctacagcatgatggtgggcaccgtggtggtgctggaggtgctgaccctgctgctgctgtctgtgccccaggccctgcggaggaaggccgagctggaggtgcccctgagcagccctggcttcagcctgctcttctacctggtgatcctggtgctgtctgctgtgcacgtgattgtgtgcaccagcgctgagagcagctgctacttctgtggcctgtcctggctggccgccggcggcgtgatggtgctggccagcgccctgctgtgtgtgattgtgtctgtgctgaccaacgtgctggtgggcggcaacacccccaggaagaaccccatgcaccccagcagccgctggagcgagctggacctgctgatcctgctgggcacagctggccacgtgctgagcctgggcgccagcagctttgtggaggaggagcaccagacctggtacttcctggtgaacaccctgtgcctggccctgagccaggagacctacagaaactacttcctgggagatgatggagagcccccctgtggcctgtgtgtggagcagggccatgatggagccacagctgcctggcaggacggccctggctgtgatgtgctggagcgggacaagggccacggcagccccagcaccagcgaggtgctgcggggccgggagaagtggatggtgctggccagcccctggctgatcctggcctgctgccgcctgctgcggagcctgaaccagacaggagtgcagtgggcccacaggccagacctgggccactggctgaccagcagtgaccacaaggccgagctgtctgtgctggccgccctgagcctgctggtggtgtttgtgctggtgcagaggggctgcagccctgtgtccaaggccgccctggccctgggcctgctgggcgtgtactgctacagagctgccatcggctctgtgcgcttcccctggaggccagacagcaaggacatcagcaagggcatcatcgaggccaggtttgtgtatgtgtttgtgctgggcatcctcttcaccggcaccaaggacctgctgaagagccaggtgattgctgctgacttcaagctgaagacagtgggcctgtgggagatctacagcggcctggtgctgctggccgccctgctcttccggccccacaacctgcctgtgctggccttcagcctgctgatccagaccctgatgaccaagttcatctggaagcccctgcggcatgatgctgctgagatcaccgtgatgcactactggtttggccaggccttcttctacttccagggcaacagcaacaacatcgccaccgtggacatctctgctggctttgtgggcctggacacctacgtggagatcccagctgtgctgctgacagccttcggcacctacgccggccctgtgctgtgggccagccacctggtgcacttcctgagcagcgagaccaggagcggcagcgccctgagccacgcctgcttctgctacgccctgatctgcagcatccctgtgttcacctacatcgtgctggtgaccagcctgcgctaccacctgttcatctggagcgtcttcagccccaagctgctgtatgagggcatgcacctgctgatcacagctgctgtgtgtgtgttcttcaccgccatggaccagacccggctgacccagagctag

SEQ ID NO: 36788 - DNA, 2952 bp, Artificial Sequence
  Description of Artificial Sequence: Synthetic coding sequence
atgaggctgggcagcggcacctttgccacctgctgcgtggccatcgaggtgctgggcattgctgtgttcctgcggggcttcttccctgcccctgtgcgcagcagcgcccgggcagagcacggggctgagcccccagcccctgagcccagcgctggggccagcagcaactggaccaccctgcccccacccctcttcagcaaggtggtgattgtgctgattgatgccctgagagatgactttgtgtttggcagcaaaggagtgaagttcatgccctacaccacctacctggtggagaagggggccagccacagctttgtggccgaggccaagcccccaacagtgaccatgccccgcatcaaggccctgatgacaggcagcctgcccggctttgtggatgtgatccggaacctgaacagccctgccctgctggaggacagcgtcatccggcaggccaaggccgccggcaagagaattgtgttctatggagatgagacctgggtgaagctgttccccaagcactttgtggagtatgatggcaccaccagcttctttgtgtctgactacacagaggtggacaacaacgtgaccaggcacctggacaaggtgctgaagagaggagactgggacatcctgatcctgcactacctgggcctggaccacatcggccacatcagcggccccaacagccccctcatcggccagaagctgtctgagatggattctgtgctgatgaagatccacaccagcctgcagagcaaggagcgggagacccccctgcccaacctgctggtgctgtgtggggaccacggcatgtctgagaccggcagccatggagccagcagcacagaggaggtgaacacccccctcatcctgatcagcagcgcctttgagaggaagccaggggacatccgccaccccaagcacgtgcagcagacagatgtggccgccaccctggccatcgccctgggcctgcccatccccaaggacagcgtgggcagcctgctcttccctgtggtggagggccggcccatgagggagcagctgcgcttcctgcacctgaacacagtgcagctgagcaagctgctgcaggagaatgtgcccagctatgagaaggaccccggctttgagcagttcaagatgtctgagcggctgcacggcaactggatccggctgtacctggaggagaagcacagcgaggtgctcttcaacctgggcagcaaggtgctgcggcagtacctggatgccctgaagaccctgagcctgagcctgagcgcccaggtggcccagtatgacatctacagcatgatggtgggcaccgtggtggtgctggaggtgctgaccctgctgctgctgtctgtgccccaggccctgcggaggaaggccgagctggaggtgcccctgagcagccctggcttcagcctgctcttctacctggtgatcctggtgctgtctgctgtgcacgtgattgtgtgcaccagcgctgagagcagctgctacttctgtggcctgtcctggctggccgccggcggcgtgatggtgctggccagcgccctgctgtgtgtgattgtgtctgtgctgaccaacgtgctggtgggcggcaacacccccaggaagaaccccatgcaccccagcagccgctggagcgagctggacctgctgatcctgctgggcacagctggccacgtgctgagcctgggcgccagcagctttgtggaggaggagcaccagacctggtacttcctggtgaacaccctgtgcctggccctgagccaggagacctacagaaactacttcctgggagatgatggagagcccccctgtggcctgtgtgtggagcagggccatgatggagccacagctgcctggcaggacggccctggctgtgatgtgctggagcgggacaagggccacggcagccccagcaccagcgaggtgctgcggggccgggagaagtggatggtgctggccagcccctggctgatcctggcctgctgccgcctgctgcggagcctgaaccagacaggagtgcagtgggcccacaggccagacctgggccactggctgaccagcagtgaccacaaggccgagctgtctgtgctggccgccctgagcctgctggtggtgtttgtgctggtgcagaggggctgcagccctgtgtccaaggccgccctggccctgggcctgctgggcgtgtactgctaccgggccgccatcggctctgtgcgcttcccctggaggccagacagcaaggacatcagcaagggcatcatcgaggccaggtttgtgtatgtgtttgtgctgggcatcctcttcaccggcaccaaggacctgctgaagagccaggtgattgctgctgacttcaagctgaagacagtgggcctgtgggagatctacagcggcctggtgctgctggccgccctgctcttccggccccacaacctgcctgtgctggccttcagcctgctgatccagaccctgatgaccaagttcatctggaagcccctgcggcatgatgctgctgagatcaccgtgatgcactactggtttggccaggccttcttctacttccagggcaacagcaacaacatcgccaccgtggacatctctgctggctttgtgggcctggacacctacgtggagatcccagctgtgctgctgacagccttcggcacctacgccggccctgtgctgtgggccagccacctggtgcacttcctgagcagcgagaccaggagcggcagcgccctgagccacgcctgcttctgctacgccctgatctgcagcatccctgtgttcacctacatcgtgctggtgaccagcctgcgctaccacctgttcatctggagcgtcttcagccccaagctgctgtatgagggcatgcacctgctgatcacagctgctgtgtgtgtgttcttcaccgccatggaccagacccggctgacccagagctag

SEQ ID NO: 36789 - DNA, 426 bp, Artificial Sequence
  Description of Artificial Sequence: Synthetic coding sequence
atgcactactggtttggccaggccttcttctacttccagggcaacagcaacaacatcgccaccgtggacatctctgctggctttgtgggcctggacacctacgtggagatcccagctgtgctgctgacagccttcggcacctacgccggccctgtgctgtgggccagccacctggtgcacttcctgagcagcgagaccaggagcggcagcgccctgagccacgcctgcttctgctacgccctgatctgcagcatccctgtgttcacctacatcgtgctggtgaccagcctgcgctaccacctgttcatctggagcgtcttcagccccaagctgctgtatgagggcatgcacctgctgatcacagctgctgtgtgtgtgttcttcacctggatcaagccagacagccacagcctgcggctgtcctag

SEQ ID NO: 36790 - DNA, 900 bp, Artificial Sequence; identical to SEQ ID NO: 36785
  Description of Artificial Sequence: Synthetic coding sequence

SEQ ID NO: 36791 - DNA, 1026 bp, Artificial Sequence
  Description of Artificial Sequence: Synthetic coding sequence
atgacaggcagcctgcccggctttgtggatgtgatccggaacctgaacagccctgccctgctggaggacagcgtcatccggcaggccaaggccgccggcaagagaattgtgttctatggagatgagacctgggtgaagctgttccccaagcactttgtggagtatgatggcaccaccagcttctttgtgtctgactacacagaggtggacaacaacgtgaccaggcacctggacaaggtgctgaagagaggagactgggacatcctgatcctgcactacctgggcctggaccacatcggccacatcagcggccccaacagccccctcatcggccagaagctgtctgagatggattctgtgctgatgaagatccacaccagcctgcagagcaaggagcgggagacccccctgcccaacctgctggtgctgtgtggggaccacggcatgtctgagaccggcagccatggagccagcagcacagaggaggtgaacacccccctcatcctgatcagcagcgcctttgagaggaagccaggggacatccgccaccccaagcacgtgcagcagacagatgtggccgccaccctggccatcgccctgggcctgcccatccccaaggacagcgtgggcagcctgctcttccctgtggtggagggccggcccatgagggagcagctgcgcttcctgcacctgaacacagtgcagctgagcaagctgctgcaggagaatgtgcccagctatgagaaggaccccggctttgagcagttcaagatgtctgagcggctgcacggcaactggatccggctgtacctggaggagaagcacagcgaggtgctcttcaacctgggcagcaaggtgctgcggcagtacctggatgccctgaagaccctgagcctgagcctgagcgcccaggtggcccagttcagcccctgcagctgcagcgccagccaccgccactgtgccgagcggctgtcctggaagagccactgccacctgctgggcttcctgtgcagcttcatctggtag

SEQ ID NO: 36792 - DNA, 2019 bp, Artificial Sequence
  Description of Artificial Sequence: Synthetic coding sequence
atgcagaaggcctctgtgctgctcttcctggcctgggtgtgcttcctgttctacgccggcatcgccctcttcaccagcggcttcctgctgacccggctggagctgaccaaccacagcagctgccaggagcccccaggccctggcagcctgccctggggcagccagggcaagccaggggcctgctggatggccagccgcttcagccgggtggtgctggtgctgattgatgccctgcgctttgattttgcccagccccagcacagccacgtgccccgggagccccctgtgtccctgcccttcctgggcaagctgagcagcctgcagaggatcctggagatccagccccaccacgcccggctgtaccgcagccaggtggacccccccaccaccaccatgcagaggctgaaggccctgaccaccggcagcctgcccaccttcattgatgctggcagcaactttgccagccacgccatcgtggaggacaacctgatcaagcagctgaccagcgctggccggcgggtggtgttcatgggagatgacacctggaaggacctcttccctggggccttcagcaaggccttcttcttccccagcttcaacgtgcgggacctggacacagtggacaatggcatcctggagcacctgtaccccaccatggattctggagagtgggatgtgctgattgcccacttcctgggcgtggaccactgcggccacaagcacggcccccaccaccctgagatggccaagaagctgagccagatggaccaggtgatccagggcctggtggagcggctggagaatgacaccctgctggtggtggccggggaccacggcatgaccaccaatggagaccacggcggggacagcgagctggaggtgtctgctgccctcttcctgtacagccccacagctgtgttccccagcaccccacctgaggagcctgaggtgatcccccaggtgtccctggtgcccaccctggccctgctgctgggcctgcccatcccctttggaaacatcggggaggtgatggccgagctgttctctggaggagaggacagccagccccacagcagcgccctggcccaggccagcgccctgcacctgaatgcccagcaggtgagccgcttcctgcacacctacagcgctgccacccaggacctgcaggccaaggagctgcaccagctgcagaacctcttcagcaaggccagcgctgactaccagtggctgctgcagagccccaagggagctgaggccaccctgcccaccgtgattgctgagctgcagcagttcctgcggggggcccgggccatgtgcatcgagagctgggcccgcttcagcctgtccttcctgctgctgcacctgctggccgccggcatccctgtgaccaccccaggccccttcaccgtgccctggcaggccgtgtctgcctgggccctgatggccacccagaccttctacagcacaggccaccagcctgtgtttcctgccatccactggcacgccgcctttgtgggcttccctgagggccacggcagctgcacctggctgcctgccctgctggtgggcgccaacacctttgccagccacctgctgtttgctgtgggctgccccctgctgctgctgtggcccttcctgtgtgagagccagggcctgaggaagaggcagcagcccccaggaaatgaagcagatgcccgggtgcggcctgaggaggaggaggagcccctgatggagatgaggctgagagatgccccccagcacttctacgccgccctgctgcagctgggcctgaagtacctgttcatcctgggcatccagatcctggcctgtgccctggccgccagcatcctgcggcggcacctgatggtgtggaaggtgtttgcccccaagttcatctttgaagctgtgggcttcatcgtgtcctctgtgggcctgctgctgggcatcgccctggtgatgagggtggatggagctgtgtcctcctggttccggcagctgttcctggcccagcagaggtag

SEQ ID NO: 36793 - DNA, 3270 bp, Artificial Sequence
  Description of Artificial Sequence: Synthetic coding sequence
atgcagaaggcctctgtgctgctcttcctggcctgggtgtgcttcctgttctacgccggcatcgccctcttcaccagcggcttcctgctgacccggctggagctgaccaaccacagcagctgccaggagcccccaggccctggcagcctgccctggggcagccagggcaagccaggggcctgctggatggccagccgcttcagccgggtggtgctggtgctgattgatgccctgcgctttgattttgcccagccccagcacagccacgtgccccgggagccccctgtgtccctgcccttcctgggcaagctgagcagcctgcagaggatcctggagatccagccccaccacgcccggctgtaccgcagccaggtggacccccccaccaccaccatgcagaggctgaaggccctgaccaccggcagcctgcccaccttcattgatgctggcagcaactttgccagccacgccatcgtggaggacaacctgatcaagcagctgaccagcgctggccggcgggtggtgttcatgggagatgacacctggaaggacctcttccctggggccttcagcaaggccttcttcttccccagcttcaacgtgcgggacctggacacagtggacaatggcatcctggagcacctgtaccccaccatggattctggagagtgggatgtgctgattgcccacttcctgggcgtggaccactgcggccacaagcacggcccccaccaccctgagatggccaagaagctgagccagatggaccaggtgatccagggcctggtggagcggctggagaatgacaccctgctggtggtggccggggaccacggcatgaccaccaatggagaccacggcggggacagcgagctggaggtgtctgctgccctcttcctgtacagccccacagctgtgttccccagcaccccacctgaggagcctgaggtgatcccccaggtgtccctggtgcccaccctggccctgctgctgggcctgcccatcccctttggaaacatcggggaggtgatggccgagctgttctctggaggagaggacagccagccccacagcagcgccctggcccaggccagcgccctgcacctgaatgcccagcaggtgagccgcttcctgcacacctacagcgctgccacccaggacctgcaggccaaggagctgcaccagctgcagaacctcttcagcaaggccagcgctgactaccagtggctgctgcagagccccaagggagctgaggccaccctgcccaccgtgattgctgagctgcagcagttcctgcggggggcccgggccatgtgcatcgagagctgggcccgcttcagcctggtgaggatggccggcggcacagccctgctggccgccagctgcttcatctgcctgctggccagccagtgggccatcagccctggcttccccttctgccccctgctgctgacccctgtggcctggggcctggtgggcgccatcgcctatgccggcctgctgggcaccatcgagctgaagctggacctggtgctgctgggcgctgtggccgctgtgtcctccttcctgcccttcctgtggaaggcctgggccggctggggcagcaagaggcccctggccaccctcttccccatccctggccctgtgctgctgctgctgctcttccggctggccgtgttcttcagtgacagctttgtggtggccgaggcccgggccacccccttcctgctgggcagcttcatcctgctgctggtggtgcagctgcactgggagggccagctgctgccccccaagctgctgaccatgccccggctgggcaccagcgccaccaccaaccccccaagacacaatggagcctatgccctgcggctgggcatcggcctgctgctgtgcacccggctggccggcctcttccaccgctgcccagaggagacccctgtgtgccacagcagcccctggctgagccccctggcctccatggtgggcggccgggccaagaacctgtggtacggggcctgtgtggccgccctggtggccctgctggccgctgtgcggctgtggctgcggcgctatggcaacctgaagagccctgagccccccatgctgtttgtgcgctggggcctgcccctgatggccctgggcacagctgcctactgggccctggccagcggggctgatgaggccccaccccggctgcgggtgctggtgtctggggcctccatggtgctgcccagggctgtggccggcctggccgccagcggcctggccctgctgctgtggaagcctgtgacagtgctggtgaaggccggggccggggcccccaggaccaggacagtgctgacccccttcagcggcccccccaccagccaggccgacctggactatgtggtgccccagatctaccgccacatgcaggaggagttccggggccgcctggagaggaccaagagccagggccccctgactgtggccgcctaccagctgggctctgtgtacagcgctgccatggtgacagccctgaccctgctggccttccccctgctgctgctgcacgccgagcgcatcagcctggtgttcctgctgctcttcctgcagagcttcctgctgctgcacctgctggccgccggcatccctgtgaccaccccaggccccttcaccgtgccctggcaggccgtgtctgcctgggccctgatggccacccagaccttctacagcacaggccaccagcccgtcttccctgccatccactggcatgctgcctttgtgggcttccctgagggccacggcagctgcacctggctgcctgccctgctggtgggcgccaacacctttgccagccacctgctgtttgctgtgggctgccccctgctgctgctgtggcccttcctgtgtgagagccagggcctgaggaagaggcagcagcccccaggaaatgaagcagatgcccgggtgcggcctgaggaggaggaggagcccctgatggagatgaggctgagagatgccccccagcacttctatgctgccctgctgcagctgggcctgaagtacctgttcatcctgggcatccagatcctggcctgtgccctggccgccagcatcctgcggcggcacctgatggtgtggaaggtgtttgcccccaagttcatctttgaggccgtgggcttcatcgtgtcctctgtgggcctgctgctgggcatcgccctggtgatgagggtggatggagctgtgtcctcctggttccggcagctgttcctggcccagcagaggtag

SEQ ID NO: 36794 - DNA, 2019 bp, Artificial Sequence; identical to SEQ ID NO: 36792
  Description of Artificial Sequence: Synthetic coding sequence

SEQ ID NO: 36795 - DNA, 3270 bp, Artificial Sequence; identical to SEQ ID NO: 36793
  Description of Artificial Sequence: Synthetic coding sequence

SEQ ID NO: 36796 - DNA, 2283 bp, Artificial Sequence
  Description of Artificial Sequence: Synthetic coding sequence
atggtgctgaaggccttcttccccacctgctgcgtgtccacagacagcggcctgctggtgggccgctgggtgcctgagcagagcagcgctgtggtgctggccgtgctgcacttccccttcatccccatccaggtgaagcagctgctggcccaggtgcggcaggccagccaggtgggcgtggccgtgctgggcacctggtgccactgccggcaggagcctgaggagagcctgggccgcttcctggagagcctgggcgctgtgttcccccatgagccctggctgcggctgtgccgggagcggggcggcaccttctggagctgtgaggccacccaccggcaggcccccacagcccctggggcccctggagaggaccaggtgatgctgatcttctatgaccagaggcaggtgctgctgagccagctgcacctgcccaccgtgctgcctgaccggcaggccggggccaccacagccagcactggaggcctggccgctgtgtttgacacagtggcccggtctgaggtgctcttcagaagtgacagatttgatgagggccctgtgcggctgagccactggcagagcgagggcgtggaggccagcatcctggccgagctggcccggcgggccagcggccccatctgcctgctgctggccagcctgctgagcctggtgtctgctgtgtctgcctgcagggtcttcaagctgtggcccctgtccttcctgggcagcaagctgagcacctgtgagcagctgcggcaccggctggagcacctgaccctcatcttcagcaccaggaaggcagaaaatcctgcccagctgatgaggaaggccaacacagtggcctctgtgctgctggatgtggccctgggcctgatgctgctgtcctggctgcacggccgcagccgcatcggccacctggctgatgccctggtgcctgtggccgaccacgtggccgaggagctgcagcacctgctgcagtggctgatgggcgccccagctggcctgaagatgaacagagccctggaccaggtgctgggccgcttcttcctgtaccacatccacctgtggatctcctacatccacctgatgagcccctttgtggagcacatcctgtggcacgtgggcctgagcgcctgcctgggcctgactgtggccctgagcctgctgagtgacatcatcgccctgctgaccttccacatctactgcttctacgtgtatggagcccggctgtactgcctgaagatccacggcctgagcagcctgtggaggctcttccggggcaagaagtggaatgtgctgcggcagagggtggacagctgcagctatgacctggaccagctgttcatcggcaccctgctcttcaccatcctgctcttcctgctgcccaccacagccctgtactacctggtgttcaccctgctgcggctgctggtggtggccgtgcagggcctcatccacctgctggtggacctgatcaacagcctgcccctgtacagcctgggcctgcggctgtgccggccctaccgcctggccgacaagcccacagccctgcagcccaggggggcccacctgcccccaccccagctgtggctgcccccccaggccctgctgggccggcctgtgccccaggccgtgccctggggcgcccacctgcccctggaggccgagcggggccaggccggcctgcgggagctgctggcccggctggccccaccccacggccacagccagcccagcgccctgcccggctggcaccagctgtcctggaggatgagctgtgccctgtggaccctgctgtgtgcccctgagcacggccggccctgctaccacaccctgggcctggaggtgattggcagcgagcagatgtggggctggccagcccggctggccgccctgcaccactggcactgcctgccctgggaccccctgcccacctgctgcggccaccacggcggggagcacagcaacccccgctgcccagagcactgccccatgcccaccctgtgcacccaggtgcagagggtgcggcccccccagcagccccaggtggagggctggagcccctggggcctgcccagcggcagcgccctggccgtgggcgtggagggcccctgccaggatgagccccccagccccaggcaccccctggcccccagcgctgagcagcacccagccagcggcggcctgaagcagagcctgacccctgtgcccagcggccctggccccagcctgcctgagccccatggagtgtacctgaggatgtttcctggagaggtggccctgtag

SEQ ID NO: 36797 - DNA, 447 bp, Artificial Sequence
  Description of Artificial Sequence: Synthetic coding sequence
atggtgctgaaggccttcttccccacctgctgcgtgtccacagacagcggcctgctggtgggccgctgggtgcctgagcagagcagcgctgtggtgctggccgtgctgcacttccccttcatccccatccaggtgaagcagctgctggcccaggtgcggcaggccagccaggtgggcgtggccgtgctgggcacctggtgccactgccggcaggagcctgaggagagcctgggccgcttcctggagagcctgggcgctgtgttcccccatgagccctggctgcggctgtgccgggagcggggcggcaccttctggagctgtgaggccacccaccggcaggcccccacagcccctggggcccctggagaggaccaggtgatgctgatcttctatgaccagaggcaggtgctgctgagccagctgcacctgcccaccgtgctgccctag

SEQ ID NO: 36798 - DNA, 1746 bp, Artificial Sequence
  Description of Artificial Sequence: Synthetic coding sequence
atggtgctgaaggccttcttccccacctgctgcgtgtccacagacagcggcctgctggtgggccgctgggtgcctgagcagagcagcgctgtggtgctggccgtgctgcacttccccttcatccccatccaggtgaagcagctgctggcccaggtgcggcaggccagccaggtgggcgtggccgtgctgggcacctggtgccactgccggcaggagcctgaggagagcctgggccgcttcctggagagcctgggcgctgtgttcccccatgagccctggctgcggctgtgccgggagcggggcggcaccttctggagctgtgaggccacccaccggcaggcccccacagcccctggggcccctggagaggaccaggtgatgctgatcttctatgaccagaggcaggtgctgctgagccagctgcacctgcccaccgtgctgcctgaccggcaggccggggccaccacagccagcactggaggcctggccgctgtgtttgacacagtggcccggtctgaggtgctcttcagaagtgacagatttgatgagggccctgtgcggctgagccactggcagagcgagggcgtggaggccagcatcctggccgagctggcccggcgggccagcggccccatctgcctgctgctggccagcctgctgagcctggtgtctgctgtgtctgcctgcagggtcttcaagctgtggcccctgtccttcctgggcagcaagctgagcacctgtgagcagctgcggcaccggctggagcacctgaccctcatcttcagcaccaggaaggcagaaaatcctgcccagctgatgaggaaggccaacacagtggcctctgtgctgctggatgtggccctgggcctgatgctgctgtcctggctgcacggccgcagccgcatcggccacctggctgatgccctggtgcctgtggccgaccacgtggccgaggagctgcagcacctgctgcagtggctgatgggcgccccagctggcctgaagatgaacagagccctggaccaggtgctgggccgcttcttcctgtaccacatccacctgtggatctcctacatccacctgatgagcccctttgtggagcacatcctgtggcacgtgggcctgagcgcctgcctgggcctgactgtggccctgagcctgctgagtgacatcatcgccctgctgaccttccacatctactgcttctacgtgtatggagcccggctgtactgcctgaagatccacggcctgagcagcctgtggaggctcttccggggcaagaagtggaatgtgctgcggcagagggtggacagctgcagctatgacctggaccagctgttcatcggcaccctgctcttcaccatcctgctcttcctgctgcccaccacagccctgtactacctggtgttcaccctgctgcggctgctggtggtggccgtgcagggcctcatccacctgctggtggacctgatcaacagcctgcccctgtacagcctgggcctgcggctgtgccggccctaccgcctggccgccggcgtgaagttccgggtgctgcggcatgaggccggccggcccctgcggctgctgatgcagatcaaccccctgccctacagccgggtggtgcacacctaccgcctgcccagctgtggctgccaccccaagcacagctggggcgccctgtgcaggaagctgttcctgggggagctgatctacccctggaggcagagaggagacaagcaggactag

SEQ ID NO: 36799 - DNA, 756 bp, Artificial Sequence
  Description of Artificial Sequence: Synthetic coding sequence
atggtgctgaaggccttcttccccacctgctgcgtgtccacagacagcggcctgctggtgggccgctgggtgcctgagcagagcagcgctgtggtgctggccgtgctgcacttccccttcatccccatccaggtgaagcagctgctggcccaggtgcggcaggccagccaggtgggcgtggccgtgctgggcacctggtgccactgccggcaggagcctgaggagagcctgggccgcttcctggagagcctgggcgctgtgttcccccatgagccctggctgcggctgtgccgggagcggggcggcaccttctggagctgtgaggccacccaccggcaggcccccacagcccctggggcccctggagaggaccaggtgatgctgatcttctatgaccagaggcaggtgctgctgagccagctgcacctgcccaccgtgctgcctgaccggcaggccggggccaccacagccagcactggaggcctggccgctgtgtttgacacagtggcccggtctgaggtgctcttcagaagtgacagatttgatgagggccctgtgcggctgagccactggcagagcgagggcgtggaggccagcatcctggccgagctggcccggcgggccagcggccccatctgcctgctgctggccagcctgctgagcctggtgtctgctgtgtctgcctgcagggtcttcaagctgtggcccctgtccttcctgggcagcaagctgagcacctgtgagcagctgaggtag

SEQ ID NO: 36800 - DNA, 1746 bp, Artificial Sequence; identical to SEQ ID NO: 36798
  Description of Artificial Sequence: Synthetic coding sequence

SEQ ID NO: 36801 - DNA, 945 bp, Artificial Sequence
  Description of Artificial Sequence: Synthetic coding sequence
atggtgctgaaggccttcttccccacctgctgcgtgtccacagacagcggcctgctggtgggccgctgggtgcctgagcagagcagcgctgtggtgctggccgtgctgcacttccccttcatccccatccaggtgaagcagctgctggcccaggtgcggcaggccagccaggtgggcgtggccgtgctgggcacctggtgccactgccggcaggagcctgaggagagcctgggccgcttcctggagagcctgggcgctgtgttcccccatgagccctggctgcggctgtgccgggagcggggcggcaccttctggagctgtgaggccacccaccggcaggcccccacagcccctggggcccctggagaggaccaggtgatgctgatcttctatgaccagaggcaggtgctgctgagccagctgcacctgcccaccgtgctgcctgaccggcaggccggggccaccacagccagcactggaggcctggccgctgtgtttgacacagtggcccggtctgaggtgctcttcagaagtgacagatttgatgagggccctgtgcggctgagccactggcagagcgagggcgtggaggccagcatcctggccgagctggcccggcgggccagcggccccatctgcctgctgctggccagcctgctgagcctggtgtctgctgtgtctgcctgcagggtcttcaagctgtggcccctgtccttcctgggcagcaagctgagcacctgtgagcagctgcggcaccggctggagcacctgaccctcatcttcagcaccaggaaggcagaaaatcctgcccagctgatgaggaaggccaacacagtggcctctgtgctgctggatgtggccctgggcctgatgctgctgtcctggctgcacggccgcagccgcatcggccacctggctgatgccctggtgcctgtggccgactag

SEQ ID NO: 36802 - DNA, 339 bp, Artificial Sequence
  Description of Artificial Sequence: Synthetic coding sequence
atggtgctgaaggccttcttccccacctgctgcgtgtccacagacagcggcctgctggtgggccgctgggtgcctgagcagagcagcgctgtggtgctggccgtgctgcacttccccttcatccccatccaggtgaagcagctgctggcccaggtgcggcaggccagccaggtgggcgtggccgtgctgggcacctggtgccactgccggcaggagcctgaggagagcctgggccgcttcctggagagcctgggcgctgtgttcccccatgagccctggctgcggctgtgccgggagcggggcggcaccttctggagctgtgaggccacccacaggtag

SEQ ID NO: 36803 - DNA, 1725 bp, Artificial Sequence
  Description of Artificial Sequence: Synthetic coding sequence
atgtggtgggccctgcggcccccaggcatcctgcccccaggcatggtgctgaaggccttcttccccacctgctgcgtgtccacagacagcggcctgctggtgggccgctgggtgcctgagcagagcagcgctgtggtgctggccgtgctgcacttccccttcatccccatccaggtgaagcagctgctggcccaggtgcggcaggccagccaggtgggcgtggccgtgctgggcacctggtgccactgccggcaggagcctgaggagagcctgggccgcttcctggagagcctgggcgctgtgttcccccatgagccctggctgcggctgtgccgggagcggggcggcaccttctggagctgtgaggccacccaccggcaggcccccacagcccctggggcccctggagaggaccaggtgatgctgatcttctatgaccagaggcaggtgctgctgagccagctgcacctgcccaccgtgctgcctgaccggcaggccggggccaccacagccagcactggaggcctggccgctgtgtttgacacagtggcccggtctgaggtgctcttcagaagtgacagatttgatgagggccctgtgcggctgagccactggcagagcgagggcgtggaggccagcatcctggccgagctggcccggcgggccagcggccccatctgcctgctgctggccagcctgctgagcctggtgtctgctgtgtctgcctgcagggtcttcaagctgtggcccctgtccttcctgggcagcaagctgagcacctgtgagcagctgcggcaccggctggagcacctgaccctcatcttcagcaccaggaaggcagaaaatcctgcccagctgatgaggaaggccaacacagtggcctctgtgctgctggatgtggccctgggcctgatgctgctgtcctggctgcacggccgcagccgcatcggccacctggctgatgccctggtgcctgtggccgaccacgtggccgaggagctgcagcacctgctgcagtggctgatgggcgccccagctggcctgaagatgaacagagccctggaccaggtgctgggccgcttcttcctgtaccacatccacctgtggatctcctacatccacctgatgagcccctttgtggagcacatcctgtggcacgtgggcctgagcgcctgcctgggcctgactgtggccctgagcctgctgagtgacatcatcgccctgctgaccttccacatctactgcttctacgtgtatggagcccggctgtactgcctgaagatccacggcctgagcagcctgtggaggctcttccggggcaagaagtggaatgtgctgcggcagagggtggacagctgcagctatgacctggaccagctgttcatcggcaccctgctcttcaccatcctgctcttcctgctgcccaccacagccctgtactacctggtgttcaccctgctgcggctgctggtggtggccgtgcagggcctcatccacctgctggtggacctgatcaacagcctgcccctgtacagcctgggcctgcggctgtgccggccctaccgcctggccggcagcgagccctggaggcctgaggccaccggcctgtgcagcagcgccctgggcttcagcggcctgggcagcctgaactgcaggcctggggccaagaggggcaaggtgcggggcaccaggagccagcagggcggccaccaccccctggcctag

SEQ ID NO: 36804 - DNA, 900 bp, Artificial Sequence
  Description of Artificial Sequence: Synthetic coding sequence
atggtgctgaaggccttcttccccacctgctgcgtgtccacagacagcggcctgctggtgggccgctgggtgcctgagcagagcagcgctgtggtgctggccgtgctgcacttccccttcatccccatccaggtgaagcagctgctggcccaggtgcggcaggccagccaggtgggcgtggccgtgctgggcacctggtgccactgccggcaggagcctgaggagagcctgggccgcttcctggagagcctgggcgctgtgttcccccatgagccctggctgcggctgtgccgggagcggggcggcaccttctggagctgtgaggccacccaccggcaggcccccacagcccctggggcccctggagaggaccaggtgatgctgatcttctatgaccagaggcaggtgctgctgagccagctgcacctgcccaccgtgctgcctgaccggcaggccggggccaccacagccagcactggaggcctggccgctgtgtttgacacagtggcccggtctgaggtgctcttcagaagtgacagatttgatgagggccctgtgcggctgagccactggcagagcgagggcgtggaggccagcatcctggccgagctggcccggcgggccagcggccccatctgcctgctgctggccagcctgctgagcctggtgtctgctgtgtctgcctgcagggtcttcaagctgtggcccctgtccttcctgggcagcaagctgagcacctgtgagcagctgcggcaccggctggagcacctgaccctcatcttcagcaccaggaaggcagaaaatcctgcccagctgatgagatgtggccctgccctggtgtctgctggcctgggcgcctgccccctggcccccagccccagccccagcgcccccaggtag

SEQ ID NO: 36805 - DNA, 480 bp, Artificial Sequence
  Description of Artificial Sequence: Synthetic coding sequence
cagcccttcctgaatgccctgggcgccgccctgctgtgtggcctgagtgacagcctgctgtgcaatgtgggcggggagagccccctgacccagctgcccccagccaccatctggacctgcacagccagccccatgagcagcacccagtggagccctggctgggaccctgtgctgcccccctgcaccctgtgcagcaccttctacagcacctgcctgagcctgcacacccaccgctgcaccttccgcaccaggatggccctgcagtggccacccatgcccagcatcgtgcctgctggggtgggcagcctggtgtacaacgtggacagcaagacctacaatgcctctgtgctgcctgtgcgggtggaggtggacatggtgcgctggcgctgctcctggcacagctgtggctgcagcctgggcctgctgagccccagctgcctgcagaatgcctgcttccagggcctgcgggtgaagggctag

SEQ ID NO: 36806 - DNA, 1668 bp, Artificial Sequence
  Description of Artificial Sequence: Synthetic coding sequence
atggctgctgctggagctgctgccacccacctggaggtggcccggggcaagagagctgccctcttctttgctgctgtggccatcgtgctgggcctgcccctgtggtggaagaccacagagacctaccgggccagcctgccctacagccagatcagcggcctgaatgccctgcagctgcggctgatggtgcctgtgacagtggtgttcacccgggagagcgtgcccctggatgaccaggagaagctgcccttcaccgtggtgcatgagcgggagatccccctgaagtacaagatgaagatcaagtgccgcttccagaaggcctacagaagagccctggaccacgaggaggaggccctgagcagcggctctgtgcaggaggccgaggccatgctggatgagccccaggagcaggccgagggcagcctgactgtgtatgtgatcagcgagcacagcagcctgctgccccaggacatgatgagctacatcggccccaagaggacagctgtggtgcggggcatcatgcaccgggaggccttcaacatcatcggccgccgcatcgtgcaggtggcccaggccatgagcctgacagaagatgtgctggccgccgccctggccgaccacctgcctgaggacaagtggagcgctgagaagaggcggcccctgaagagcagcctgggctatgagatcaccttcagcctgctgaacccagaccccaagagccatgatgtgtactgggacattgaaggagctgtgcggcgctacgtgcagcccttcctgaatgccctgggcgctgctggcaacttctctgtggacagccagatcctgtactatgccatgctgggcgtgaaccccaggtttgacagcgccagcagcagctactacctggacatgcacagcctgccccacgtgatcaaccctgtggagagccggctgggcagcagcgctgccagcctgtaccctgtgctgaacttcctgctgtatgtgcctgagctggcccacagccccctgtacatccaggacaaggatggagcccctgtggccaccaatgccttccacagcccccgctggggcggcatcatggtgtacaacgtggacagcaagacctacaatgcctctgtgctgcctgtgcgggtggaggtggacatggtgcgggtgatggaggtgttcctggcccagctgcggctgctgtttggaattgcccagccccagctgccccccaagtgcctgctgagcggccccaccagcgagggcctgatgacctgggagctggaccggctgctgtgggcccggtctgtggagaacctggccacagccaccaccaccctgaccagcctggcccagctgctgggcaagatcagcaacatcgtcatcaaggatgatgtggccagcgaggtgtacaaggctgtggccgctgtgcagaagtctgctgaggagctggccagcggccacctggccagcgcctttgtggccagccaggaggccgtgaccagcagcgagctggccttctttgaccccagcctgctgcacctgctgtacttcccagatgaccagaagtttgccatctacatccccctcttcctgcccatggctgtgcccatcctgctgagcctggtgaagatcttcctggagaccaggaagtcctggaggaagccagagaagacagactag

SEQ ID NO: 36807 - DNA, 1644 bp, Artificial Sequence
  Description of Artificial Sequence: Synthetic coding sequence
atgcccagcgaggtggcccggggcaagagagctgccctcttctttgctgctgtggccatcgtgctgggcctgcccctgtggtggaagaccacagagacctaccgggccagcctgccctacagccagatcagcggcctgaatgccctgcagctgcggctgatggtgcctgtgacagtggtgttcacccgggagagcgtgcccctggatgaccaggagaagctgcccttcaccgtggtgcatgagcgggagatccccctgaagtacaagatgaagatcaagtgccgcttccagaaggcctacagaagagccctggaccacgaggaggaggccctgagcagcggctctgtgcaggaggccgaggccatgctggatgagccccaggagcaggccgagggcagcctgactgtgtatgtgatcagcgagcacagcagcctgctgccccaggacatgatgagctacatcggccccaagaggacagctgtggtgcggggcatcatgcaccgggaggccttcaacatcatcggccgccgcatcgtgcaggtggcccaggccatgagcctgacagaagatgtgctggccgccgccctggccgaccacctgcctgaggacaagtggagcgctgagaagaggcggcccctgaagagcagcctgggctatgagatcaccttcagcctgctgaacccagaccccaagagccatgatgtgtactgggacattgaaggagctgtgcggcgctacgtgcagcccttcctgaatgccctgggcgctgctggcaacttctctgtggacagccagatcctgtactatgccatgctgggcgtgaaccccaggtttgacagcgccagcagcagctactacctggacatgcacagcctgccccacgtgatcaaccctgtggagagccggctgggcagcagcgctgccagcctgtaccctgtgctgaacttcctgctgtatgtgcctgagctggcccacagccccctgtacatccaggacaaggatggagcccctgtggccaccaatgccttccacagcccccgctggggcggcatcatggtgtacaacgtggacagcaagacctacaatgcctctgtgctgcctgtgcgggtggaggtggacatggtgcgggtgatggaggtgttcctggcccagctgcggctgctgtttggaattgcccagccccagctgccccccaagtgcctgctgagcggccccaccagcgagggcctgatgacctgggagctggaccggctgctgtgggcccggtctgtggagaacctggccacagccaccaccaccctgaccagcctggcccagctgctgggcaagatcagcaacatcgtcatcaaggatgatgtggccagcgaggtgtacaaggctgtggccgctgtgcagaagtctgctgaggagctggccagcggccacctggccagcgcctttgtggccagccaggaggccgtgaccagcagcgagctggccttctttgaccccagcctgctgcacctgctgtacttcccagatgaccagaagtttgccatctacatccccctcttcctgcccatggctgtgcccatcctgctgagcctggtgaagatcttcctggagaccaggaagtcctggaggaagccagagaagacagactag

SEQ ID NO: 36808 - DNA, 1485 bp, Artificial Sequence
  Description of Artificial Sequence: Synthetic coding sequence
atggtgcctgtgacagtggtgttcacccgggagagcgtgcccctggatgaccaggagaagctgcccttcaccgtggtgcatgagcgggagatccccctgaagtacaagatgaagatcaagtgccgcttccagaaggcctaccgccgggccctggaccacgaggaggaggccctgagcagcggctctgtgcaggaggccgaggccatgctggatgagccccaggagcaggccgagggcagcctgactgtgtatgtgatcagcgagcacagcagcctgctgccccaggacatgatgagctacatcggccccaagaggacagctgtggtgcggggcatcatgcaccgggaggccttcaacatcattggaagaagaattgtgcaggtggcccaggccatgagcctgacagaagatgtgctggccgccgccctggccgaccacctgcctgaggacaagtggagcgctgagaagagaagacccctgaagagcagcctgggctatgagatcaccttcagcctgctgaacccagaccccaagagccatgatgtgtactgggacatcgagggcgctgtgagaagatatgtgcagcccttcctgaatgccctgggcgccgccggcaacttctctgtggacagccagatcctgtactatgccatgctgggcgtgaaccccaggtttgattctgccagcagcagctactacctggacatgcacagcctgccccacgtgatcaaccctgtggagagccggctgggcagcagcgctgccagcctgtaccctgtgctgaacttcctgctgtatgtgcctgagctggcccacagccccctgtacatccaggacaaggatggagcccctgtggccaccaatgccttccacagcccccgctggggcggcatcatggtgtacaacgtggacagcaagacctacaatgcctctgtgctgcctgtgcgggtggaggtggacatggtgcgggtgatggaggtgttcctggcccagctgcggctgctgtttggcatcgcccagccccagctgccccccaagtgcctgctgagcggccccaccagcgagggcctgatgacctgggagctggaccggctgctgtgggcccggtctgtggagaacctggccacagccaccaccaccctgaccagcctggcccagctgctgggcaagatcagcaacatcgtcatcaaggatgatgtggccagcgaggtgtacaaggctgtggccgctgtgcagaagtctgctgaggagctggccagcggccacctggccagcgcctttgtggccagccaggaggccgtgaccagcagcgagctggccttctttgaccccagcctgctgcacctgctgtacttcccagatgaccagaagtttgccatctacatccccctcttcctgcccatggctgtgcccatcctgctgagcctggtgaagatcttcctggagaccaggaagtcctggaggaagccagagaagacagactag

SEQ ID NO: 36809 - DNA, 1431 bp, Artificial Sequence
  Description of Artificial Sequence: Synthetic coding sequence
atggctgctgccatgcccctggccctgctggtgctgctgctgctgggccctgggggctggtgcctggccgagcccccccgggacagcctgcgggaggagctggtgatcacccccctgcccagcggagatgtggccgccaccttccagttccgcacccgctgggacagcgagctgcagcgggagggggacacagaccactacttcctgcgctatgctgtgctgccccgggaggtggtgtgcacagagaacctgaccccctggaagaagctgctgccctgcagcagcaaggccggcctgtctgtgctgctgaaggctgacaggctcttccacaccagctaccacagccaggccgtgcacatccggcctgtgtgcagaaatgcccgctgcaccagcatctcctgggagctgcggcagaccctgtctgtggtgtttgatgccttcatcaccggccagggcaagaaggactggagcctcttcaggatgttcagcaggaccctgacagagccctgccccctggccagcgagagccgggtgtatgtggacatcaccacctacaaccaggacaatgagaccctggaggtgcaccccccacccaccaccacctaccaggacgtcatcctgggcaccaggaagacctacgccatctatgacctgctggacacagccatgatcaacaacagcaggaacctgaacatccagctgaagtggaagaggcccccagaaaatgaggcccctcctgtgcccttcctgcacgcccagagatatgtgtctggctacggcctgcagaagggggagctgagcaccctgctgtacaacacccacccctaccgggccttccctgtgctgctgctggacacagtgccctggtacctgcggctgtatgtgcacaccctgaccatcaccagcaagggcaaggagaacaagcccagctacatccactaccagcctgcccaggaccggctgcagccccacctgctggagatgctgatccagctgcctgccaacagcgtgaccaaggtgtccatccagtttgagcgggccctgctgaagtggacagagtacaccccagaccccaaccacggcttctacgtgagccccagcgtgctgagcgccctggtgcccagcatggtggccgccaagcctgtggactgggaggagagccccctcttcaacagcctcttccctgtgtctgatggcagcaactactttgtgcggctgtacacagagcccctgctggtgaacctgcccaccccagacttctccatgccctacaacgtcatctgcctgacctgcaccgtggtggccgtgtgctacggcagcttctacaacctgctgaccaggaccttccacatcgaggagcccaggactggaggcctggccaagaggctggccaacctgatccggcgggcccggggcgtgccccccctgtag

SEQ ID NO: 36810 - DNA, 1737 bp, Artificial Sequence
  Description of Artificial Sequence: Synthetic coding sequence
atggctgctgccatgcccctggccctgctggtgctgctgctgctgggccctgggggctggtgcctggccgagcccccccgggacagcctgcgggaggagctggtgatcacccccctgcccagcggagatgtggccgccaccttccagttccgcacccgctgggacagcgagctgcagcgggagggcgtgagccactaccgcctcttccccaaggccctgggccagctgatcagcaagtacagcctgcgggagctgcacctgtccttcacccagggcttctggaggacccgctactggggcccccccttcctgcaggcccccagcggggctgagctgtgggtgtggttccaggacacagtgacagatgtggacaagtcctggaaggagctgagcaatgtgctgagcggcatcttctgtgccagcctgaacttcatcgacagcaccaacacagtgacccccacagccagcttcaagcccctgggcctggccaatgacacagaccactacttcctgcgctatgctgtgctgccccgggaggtggtgtgcacagagaacctgaccccctggaagaagctgctgccctgcagcagcaaggccggcctgtctgtgctgctgaaggctgacaggctcttccacaccagctaccacagccaggccgtgcacatccggcctgtgtgcagaaatgcccgctgcaccagcatctcctgggagctgcggcagaccctgtctgtggtgtttgatgccttcatcaccggccagggcaagaaggactggagcctcttcaggatgttcagcaggaccctgacagagccctgccccctggccagcgagagccgggtgtatgtggacatcaccacctacaaccaggacaatgagaccctggaggtgcaccccccacccaccaccacctaccaggacgtcatcctgggcaccaggaagacctacgccatctatgacctgctggacacagccatgatcaacaacagcaggaacctgaacatccagctgaagtggaagaggcccccagaaaatgaggcccctcctgtgcccttcctgcacgcccagagatatgtgtctggctacggcctgcagaagggggagctgagcaccctgctgtacaacacccacccctaccgggccttccctgtgctgctgctggacacagtgccctggtacctgcggctgtatgtgcacaccctgaccatcaccagcaagggcaaggagaacaagcccagctacatccactaccagcctgcccaggaccggctgcagccccacctgctggagatgctgatccagctgcctgccaacagcgtgaccaaggtgtccatccagtttgagcgggccctgctgaagtggacagagtacaccccagaccccaaccacggcttctacgtgagccccagcgtgctgagcgccctggtgcccagcatggtggccgccaagcctgtggactgggaggagagccccctcttcaacagcctcttccctgtgtctgatggcagcaactactttgtgcggctgtacacagagcccctgctggtgaacctgcccaccccagacttctccatgccctacaacgtcatctgcctgacctgcaccgtggtggccgtgtgctacggcagcttctacaacctgctgaccaggaccttccacatcgaggagcccaggactggaggcctggccaagaggctggccaacctgatccggcgggcccggggcgtgccccccctgtag

SEQ ID NO: 36811 - DNA, 1155 bp, Artificial Sequence
  Description of Artificial Sequence: Synthetic coding sequence
atggctgctgccatgcccctggccctgctggtgctgctgctgctgggccctgggggctggtgcctggccgagcccccccgggacagcctgcgggaggagctggtgatcacccccctgcccagcggagatgtggccgccaccttccagttccgcacccgctgggacagcgagctgcagcgggagggggactggagcctcttcaggatgttcagcaggaccctgacagagccctgccccctggccagcgagagccgggtgtatgtggacatcaccacctacaaccaggacaatgagaccctggaggtgcaccccccacccaccaccacctaccaggacgtcatcctgggcaccaggaagacctacgccatctatgacctgctggacacagccatgatcaacaacagcaggaacctgaacatccagctgaagtggaagaggcccccagaaaatgaggcccctcctgtgcccttcctgcacgcccagagatatgtgtctggctacggcctgcagaagggggagctgagcaccctgctgtacaacacccacccctaccgggccttccctgtgctgctgctggacacagtgccctggtacctgcggctgtatgtgcacaccctgaccatcaccagcaagggcaaggagaacaagcccagctacatccactaccagcctgcccaggaccggctgcagccccacctgctggagatgctgatccagctgcctgccaacagcgtgaccaaggtgtccatccagtttgagcgggccctgctgaagtggacagagtacaccccagaccccaaccacggcttctacgtgagccccagcgtgctgagcgccctggtgcccagcatggtggccgccaagcctgtggactgggaggagagccccctcttcaacagcctcttccctgtgtctgatggcagcaactactttgtgcggctgtacacagagcccctgctggtgaacctgcccaccccagacttctccatgccctacaacgtcatctgcctgacctgcaccgtggtggccgtgtgctacggcagcttctacaacctgctgaccaggaccttccacatcgaggagcccaggactggaggcctggccaagaggctggccaacctgatccggcgggcccggggcgtgccccccctgtag

SEQ ID NO: 36812 - DNA, 1536 bp, Artificial Sequence
  Description of Artificial Sequence: Synthetic coding sequence
atggctgctgccatgcccctggccctgctggtgctgctgctgctgggccctgggggctggtgcctggccgagcccccccgggacagcctgcgggaggagctggtgatcacccccctgcccagcggagatgtggccgccaccttccagttccgcacccgctgggacagcgagctgcagcgggagggcgtgagccactaccgcctcttccccaaggccctgggccagctgatcagcaagtacagcctgcgggagctgcacctgtccttcacccagggcttctggaggacccgctactggggcccccccttcctgcaggcccccagcggggctgagctgtgggtgtggttccaggacacagtgacagatgtggacaagtcctggaaggagctgagcaatgtgctgagcggcatcttctgtgccagcctgaacttcatcgacagcaccaacacagtgacccccacagccagcttcaagcccctgggcctggccaatgacacagaccactacttcctgcgctatgctgtgctgccccgggaggtggtgtgcacagagaacctgaccccctggaagaagctgctgccctgcagcagcaaggccggcctgtctgtgctgctgaaggctgacaggctcttccacaccagctaccacagccaggccgtgcacatccggcctgtgtgcagaaatgcccgctgcaccagcatctcctgggagctgcggcagaccctgtctgtggtgtttgatgccttcatcaccggccagggcaagaaggactggagcctcttcaggatgttcagcaggaccctgacagagccctgccccctggccagcgagagccgggtgtatgtggacatcaccacctacaaccaggacaatgagaccctggaggtgcaccccccacccaccaccacctaccaggacgtcatcctgggcaccaggaagacctacgccatctatgacctgctggacacagccatgatcaacaacagcaggaacctgaacatccagctgaagtggaagaggcccccagaaaatggctacatccactaccagcctgcccaggaccggctgcagccccacctgctggagatgctgatccagctgcctgccaacagcgtgaccaaggtgtccatccagtttgagcgggccctgctgaagtggacagagtacaccccagaccccaaccacggcttctacgtgagccccagcgtgctgagcgccctggtgcccagcatggtggccgccaagcctgtggactgggaggagagccccctcttcaacagcctcttccctgtgtctgatggcagcaactactttgtgcggctgtacacagagcccctgctggtgaacctgcccaccccagacttctccatgccctacaacgtcatctgcctgacctgcaccgtggtggccgtgtgctacggcagcttctacaacctgctgaccaggaccttccacatcgaggagcccaggactggaggcctggccaagaggctggccaacctgatcagaagagcccggggcgtgccccccctgtag

SEQ ID NO: 36813 - DNA, 1272 bp, Artificial Sequence
  Description of Artificial Sequence: Synthetic coding sequence
atgtggatcaacctgggccgcagctctgtgatgagcagccagggcagcagcgcccccctgagcaccagcagcaccccacccacccagagcctgcccctgccccccagcaacccctgggtgtggcccatggccggcctgtctgtgctgctgaaggctgacaggctcttccacaccagctaccacagccaggccgtgcacatccggcctgtgtgcagaaatgcccgctgcaccagcatctcctgggagctgcggcagaccctgtctgtggtgtttgatgccttcatcaccggccagggcaagaaggactggagcctcttcaggatgttcagcaggaccctgacagagccctgccccctggccagcgagagccgggtgtatgtggacatcaccacctacaaccaggacaatgagaccctggaggtgcaccccccacccaccaccacctaccaggatgtgatcctgggcaccaggaagacctacgccatctatgacctgctggacacagccatgatcaacaacagcaggaacctgaacatccagctgaagtggaagaggcccccagaaaatgaggcccctcctgtgcccttcctgcacgcccagcgctacgtgtctggctacggcctgcagaagggggagctgagcaccctgctgtacaacacccacccctaccgggccttccctgtgctgctgctggacacagtgccctggtacctgcggctgtatgtgcacaccctgaccatcaccagcaagggcaaggagaacaagcccagctacatccactaccagcctgcccaggaccggctgcagccccacctgctggagatgctgatccagctgcctgccaacagcgtgaccaaggtgtccatccagtttgagcgggccctgctgaagtggacagagtacaccccagaccccaaccacggcttctacgtgagccccagcgtgctgagcgccctggtgcccagcatggtggccgccaagcctgtggactgggaggagagccccctcttcaacagcctcttccctgtgtctgatggcagcaactactttgtgcggctgtacacagagcccctgctggtgaacctgcccaccccagacttctccatgccctacaacgtcatctgcctgacctgcaccgtggtggccgtgtgctacggcagcttctacaacctgctgaccaggaccttccacatcgaggagcccaggactggaggcctggccaagaggctggccaacctgatcagaagagcccggggcgtgccccccctgtag

SEQ ID NO: 36814 - DNA, 1569 bp, Artificial Sequence
  Description of Artificial Sequence: Synthetic coding sequence
atggctgctgccatgcccctggccctgctggtgctgctgctgctgggccctgggggctggtgcctggccgagcccccccgggacagcctgcgggaggagctggtgatcacccccctgcccagcggagatgtggccgccaccttccagttccgcacccgctgggacagcgagctgcagcgggagggcgtgagccactaccgcctcttccccaaggccctgggccagctgatcagcaagtacagcctgcgggagctgcacctgtccttcacccagggcttctggaggacccgctactggggcccccccttcctgcaggcccccagcgacacagaccactacttcctgcgctatgctgtgctgccccgggaggtggtgtgcacagagaacctgaccccctggaagaagctgctgccctgcagcagcaaggccggcctgtctgtgctgctgaaggctgacaggctcttccacaccagctaccacagccaggccgtgcacatccggcctgtgtgcagaaatgcccgctgcaccagcatctcctgggagctgcggcagaccctgtctgtggtgtttgatgccttcatcaccggccagggcaagaaggactggagcctcttcaggatgttcagcaggaccctgacagagccctgccccctggccagcgagagccgggtgtatgtggacatcaccacctacaaccaggacaatgagaccctggaggtgcaccccccacccaccaccacctaccaggacgtcatcctgggcaccaggaagacctacgccatctatgacctgctggacacagccatgatcaacaacagcaggaacctgaacatccagctgaagtggaagaggcccccagaaaatgaggcccctcctgtgcccttcctgcacgcccagagatatgtgtctggctacggcctgcagaagggggagctgagcaccctgctgtacaacacccacccctaccgggccttccctgtgctgctgctggacacagtgccctggtacctgcggctgtatgtgcacaccctgaccatcaccagcaagggcaaggagaacaagcccagctacatccactaccagcctgcccaggaccggctgcagccccacctgctggagatgctgatccagctgcctgccaacagcgtgaccaaggtgtccatccagtttgagcgggccctgctgaagtggacagagtacaccccagaccccaaccacggcttctacgtgagccccagcgtgctgagcgccctggtgcccagcatggtggccgccaagcctgtggactgggaggagagccccctcttcaacagcctcttccctgtgtctgatggcagcaactactttgtgcggctgtacacagagcccctgctggtgaacctgcccaccccagacttctccatgccctacaacgtcatctgcctgacctgcaccgtggtggccgtgtgctacggcagcttctacaacctgctgaccaggaccttccacatcgaggagcccaggactggaggcctggccaagaggctggccaacctgatccggcgggcccggggcgtgccccccctgtag

SEQ ID NO: 36815 - DNA, 951 bp, Artificial Sequence
  Description of Artificial Sequence: Synthetic coding sequence
atgttcagcaggaccctgacagagccctgccccctggccagcgagagccgggtgtatgtggacatcaccacctacaaccaggacaatgagaccctggaggtgcaccccccacccaccaccacctaccaggacgtcatcctgggcaccaggaagacctacgccatctatgacctgctggacacagccatgatcaacaacagcaggaacctgaacatccagctgaagtggaagaggcccccagaaaatgaggcccctcctgtgcccttcctgcacgcccagagatatgtgtctggctacggcctgcagaagggggagctgagcaccctgctgtacaacacccacccctaccgggccttccctgtgctgctgctggacacagtgccctggtacctgcggctgtatgtgcacaccctgaccatcaccagcaagggcaaggagaacaagcccagctacatccactaccagcctgcccaggaccggctgcagccccacctgctggagatgctgatccagctgcctgccaacagcgtgaccaaggtgtccatccagtttgagcgggccctgctgaagtggacagagtacaccccagaccccaaccacggcttctacgtgagccccagcgtgctgagcgccctggtgcccagcatggtggccgccaagcctgtggactgggaggagagccccctcttcaacagcctcttccctgtgtctgatggcagcaactactttgtgcggctgtacacagagcccctgctggtgaacctgcccaccccagacttctccatgccctacaacgtcatctgcctgacctgcaccgtggtggccgtgtgctacggcagcttctacaacctgctgaccaggaccttccacatcgaggagcccaggactggaggcctggccaagaggctggccaacctgatccggcgggcccggggcgtgccccccctgtag

SEQ ID NO: 36816 - DNA, 345 bp, Artificial Sequence
  Description of Artificial Sequence: Synthetic coding sequence
atgctgagcggggcccgctgccgcctggccagcgccctgcggggcacccgggcccctccttctgctgtggcccggcgctgcctgcacgccagcggcagccggcccctggccgaccggggcaagaagacagaggagcccccccgggactttgatcctgccctgctggagttcctggtgtgccccctgagcaagaagcccctgcgctatgaggccagcaccaatgagctgatcaatgaggagctgggcatcgcctaccccatcattgatggcatccccaacatgatcccccaggccgccaggatgacccggcagagcaagaagcaggaggaggtggagcagaggtag

SEQ ID NO: 36817 - DNA, 216 bp, Artificial Sequence
  Description of Artificial Sequence: Synthetic coding sequence
atgttcctgagcctgcccaccctgactgtgctgatccccctggtgtccctggccggcctcttctacagcgcctctgtggaggagaacttcccccagggctgcaccagcacagccagcctgtgcttctacagcctgctgctgcccatcaccatccctgtgtatgtgttcttccacctgtggacctggatgggcatcaagctgttccgccacaactag

SEQ ID NO: 36818 - DNA, 4032 bp, Artificial Sequence
  Description of Artificial Sequence: Synthetic coding sequence
atgatcatcaaggagtaccgcatccccctgcccatgacagtggaggagtacagaattgcccagctgtacatgatccagaagaagagcagaaatgagacctacggggagggcagcggcgtggagatcctggagaaccggccctacacagatggccctgggggcagcggccagtacacccacaaggtgtaccacgtgggcatgcacatccccagctggttccgcagcatcctgcccaaggccgccctgcgggtggtggaggagagctggaatgcctacccctacaccaggacccgcttcacctgcccctttgtggagaagttcagcattgatattgagaccttctacaagacagatgctggagaaaatccagatgtgttcaacctgagccctgtggagaagaaccagctgaccatcgacttcattgatattgtgaaggaccctgtgccccacaatgagtacaagacagaggaggaccccaagctgttccagagcaccaagacccagaggggccccctgtctgagaactggattgaggagtacaagaagcaggtgttccccatcatgtgtgcctacaagctgtgcaaggtggagttccgctactggggcatgcagagcaagattgagcgcttcatccatgacaccggcctgcggcgggtgatggtgcgggcccaccggcaggcctggtgctggcaggatgagtggtacggcctgtccatggagaacatccgggagctggagaaggaggcccagctgatgctgagcaggaagatggcccagttcaatgaagatggagaggaggccacagagctggtgaagcatgaagctgtgtctgaccagaccagcggggagcccccagagcccagcagcagcaatggagagcccctggtgggccggggcctgaagaagcagtggagcaccagcagcaagagcagccgcagcagcaagagaggagccagccccagccgccacagcatcagcgagtggaggatgcagagcatcgcccgggacagtgatgagagcagtgatgatgagttctttgatgcccacgaggacctgagtgacacagaggagatgttccccaaggacatcaccaagtggagcagcaatgacctgatggacaagattgagagccctgagcctgaggacacccaggacggcctgtaccggcagggcgcccctgagttccgggtggccagctctgtggagcagctgaacatcattgaagatgaggtgtcccagcccctggccgccccacccagcaagatccacgtgctgctgctggtgctgcacggcggcaccatcctggacacaggagctggggaccccagcagcaagaagggagatgccaacaccatcgccaacgtgtttgacacagtgatgagggtgcactaccccagcgccctgggccgcctggccatccggctggtgccctgcccccctgtgtgcagtgatgcctttgccctggtgagcaacctgagcccctacagccatgatgagggctgcctgagcagcagccaggaccacatccccctggccgccctgcccctgctggccaccagcagcccccagtaccaggaggccgtggccaccgtcatccagagggccaacctggcctatggagacttcatcaagagccaggagggcatgaccttcaacggccaggtgtgcctgattggagactgtgtgggcggcatcctggcctttgatgccctgtgctacagcaaccagcctgtgtctgagagccagagcagcagccggcggggctctgtggtgtccatgcaggacaatgacctgctgagccctggcatcctgatgaatgctgcccactgctgcggcggcggcggcggcggcggcggcggcggcggcagcagcggcggcggcggcagcagcggcggcagcagcctggagagcagccgccacctgagccgcagcaatgtggacatccccaggagcaatggaacagaggaccccaagaggcagctgcccaggaagagaagtgacagcagcacctatgagctggacaccatccagcagcaccaggccttcctgagcagcctgcacgcctctgtgctgaggacagagccctgcagccgccacagcagcagcagcaccatgctggatggcactggagccctgggccgctttgattttgagatcacagacctcttcctgtttggctgccccctgggcctggtgctggccctgaggaagacagtcatcccagccctggatgtgttccagctgcggcctgcctgccagcaggtgtacaacctcttccaccctgctgaccccagcgccagccggctggagcccctgctggagcggcgcttccacgccctgccccccttctctgtgccccgctaccagcgctaccccctgggagatggctgcagcaccctgctggtggagaccgtgcagagaaatcctgagctggtgctggagggcggccccctggcccccctgccccatggagatggcttcctggagacctccatgcctgtgcctgcccccacctggcaggacggccccaggcctggctgtgccgagagtgatgtgctgcagacccacaatgctgccttccaggagcacggggcccccagcagccctggaacagccccagccagccggggcttcagaagagccagcgagatcagcatcgccagccaggtgtctggcatggccgagagctacacagccagcagcatcgcccagattgctgccaagtggtggggccagaagagaattgattatgccctgtactgcccagatgccctgacagccttccccaccgtggccctgccccacctgttccacgccagctactgggagagcacagatgtggtgtccttcctgctgcggcaggtgatgagacatgacaacagcagcatcctggagctggatggcaaggaggtgtctgtgttcacccccagcaagccccgggagaagtggcagaggaagaggacccacgtgaagctgagaaatgtgacagccaaccaccgcatcaatgatgccctggccaatgaagatggcccccaggtgctgaccggccgcttcatgtatggccccctggacatggtgaccctgactggagagaaggtggatgtgcacatcatgacccagcccccatctggagagtggctgtacctggacaccctggtgaccaacaacagcggccgggtgtcctacaccatccctgagagccaccggctgggcgtgggcgtgtaccccatcaagatggtggtgcggggggaccacacctttgctgacagctacatcaccgtgctgcccaagggcacagaatttgtggtgttcagcattgatggcagctttgctgcctctgtgtccatcatgggcagtgaccccaaggtgcgggccggggctgtggatgtggtgcgccactggcaggacctgggctacctgatcatctacgtgacaggccgcccagacatgcagaagcagagggtggtggcctggctggcccagcacaacttcccccacggcgtggtgtccttctgtgatggcctggtgcatgaccccctgcggcacaaggccaacttcctgaagctgctgatcagcgagctgcacctgcgggtgcacgccgcctacggcagcaccaaggatgtggccgtgtacagcgccatcagcctgagccccatgcagatctacatcgtgggccggcccaccaagaagctgcagcagcagtgccagttcatcacagatggctatgctgcccacctggcccagctgaagtacagccaccgggcccggcctgccaggaacacagccaccaggatggccctgaggaagggcagctttggcctgcccggccagggcgacttcctgcggagcaggaaccacctgctgcggaccatcagcgcccagcccagcggccccagccacagacatgagaggacccagagccaggctgatggagagcagaggggccagaggtccatgtctgtggccgccggctgctggggccgggccatgacaggccgcctggagcccggggctgctgctggccccaagtag

SEQ ID NO: 36819 - DNA, 4050 bp, Artificial Sequence
  Description of Artificial Sequence: Synthetic coding sequence
atgatcatcaaggagtaccgcatccccctgcccatgacagtggaggagtacagaattgcccagctgtacatgatccagaagaagagcagaaatgagacctacggggagggcagcggcgtggagatcctggagaaccggccctacacagatggccctgggggcagcggccagtacacccacaaggtgtaccacgtgggcatgcacatccccagctggttccgcagcatcctgcccaaggccgccctgcgggtggtggaggagagctggaatgcctacccctacaccaggacccgcttcacctgcccctttgtggagaagttcagcattgatattgagaccttctacaagacagatgctggagaaaatccagatgtgttcaacctgagccctgtggagaagaaccagctgaccatcgacttcattgatattgtgaaggaccctgtgccccacaatgagtacaagacagaggaggaccccaagctgttccagagcaccaagacccagaggggccccctgtctgagaactggattgaggagtacaagaagcaggtgttccccatcatgtgtgcctacaagctgtgcaaggtggagttccgctactggggcatgcagagcaagattgagcgcttcatccatgacaccggcctgcggcgggtgatggtgcgggcccaccggcaggcctggtgctggcaggatgagtggtacggcctgtccatggagaacatccgggagctggagaaggaggcccagctgatgctgagcaggaagatggcccagttcaatgaagatggagaggaggccacagagctggtgaagcatgaagctgtgtctgaccagaccagcggggagcccccagagcccagcagcagcaatggagagcccctggtgggccggggcctgaagaagcagtggagcaccagcagcaagagcagccgcagcagcaagagaggagccagccccagccgccacagcatcagcgagtggaggatgcagagcatcgcccgggacagtgatgagagcagtgatgatgagttctttgatgcccacgaggacctgagtgacacagaggagatgttccccaaggacatcaccaagtggagcagcaatgacctgatggacaagattgagagccctgagcctgaggacacccaggacggcctgtaccggcagggcgcccctgagttccgggtggccagctctgtggagcagctgaacatcattgaagatgaggtgtcccagcccctggccgccccacccagcaagatccacgtgctgctgctggtgctgcacggcggcaccatcctggacacaggagctggggaccccagcagcaagaagggagatgccaacaccatcgccaacgtgtttgacacagtgatgagggtgcactaccccagcgccctgggccgcctggccatccggctggtgccctgcccccctgtgtgcagtgatgcctttgccctggtgagcaacctgagcccctacagccatgatgagggctgcctgagcagcagccaggaccacatccccctggccgccctgcccctgctggccaccagcagcccccagtaccaggaggccgtggccaccgtcatccagagggccaacctggcctatggagacttcatcaagagccaggagggcatgaccttcaacggccaggtgtgcctgattggagactgtgtgggcggcatcctggcctttgatgccctgtgctacagcaaccagcctgtgtctgagagccagagcagcagccggcggggctctgtggtgtccatgcaggacaatgacctgctgagccctggcatcctgatgaatgctgcccactgctgcggcggcggcggcggcggcggcggcggcggcggcagcagcggcggcggcggcagcagcggcggcagcagcctggagagcagccgccacctgagccgcagcaatgtggacatccccaggagcaatggaacagaggaccccaagaggcagctgcccaggaagagaagtgacagcagcacctatgagctggacaccatccagcagcaccaggccttcctgagcagcctgcacgcctctgtgctgaggacagagccctgcagccgccacagcagcagcagcaccatgctggatggcactggagccctgggccgctttgattttgagatcacagacctcttcctgtttggctgccccctgggcctggtgctggccctgaggaagacagtcatcccagccctggatgtgttccagctgcggcctgcctgccagcaggtgtacaacctcttccaccctgctgaccccagcgccagccggctggagcccctgctggagcggcgcttccacgccctgccccccttctctgtgccccgctaccagcgctaccccctgggagatggctgcagcaccctgctggctgatgtgctgcagacccacaatgctgccttccaggagcacggggcccccagcagccctggaacagccccagccagccggggcttcagaagagccagcgagatcagcatcgccagccaggtgtctggcatggccgagagctacacagccagcagcatcgcccagaaggccccagatgccctgagccacaccccatctgtgcggcggctgagcctgctggccctgcctgcccccagccccaccaccccaggcccccaccccccagccaggaaggccagccctggcctggagcgggcccctggcctgcctgagctggacatcggggaggtggccgccaagtggtggggccagaagagaattgattatgccctgtactgcccagatgccctgacagccttccccaccgtggccctgccccacctgttccacgccagctactgggagagcacagatgtggtgtccttcctgctgcggcaggtgatgagacatgacaacagcagcatcctggagctggatggcaaggaggtgtctgtgttcacccccagcaagccccgggagaagtggcagaggaagaggacccacgtgaagctgagaaatgtgacagccaaccaccgcatcaatgatgccctggccaatgaagatggcccccaggtgctgaccggccgcttcatgtatggccccctggacatggtgaccctgactggagagaaggtggatgtgcacatcatgacccagcccccatctggagagtggctgtacctggacaccctggtgaccaacaacagcggccgggtgtcctacaccatccctgagagccaccggctgggcgtgggcgtgtaccccatcaagatggtggtgcggggggaccacacctttgctgacagctacatcaccgtgctgcccaagggcacagaatttgtggtgttcagcattgatggcagctttgctgcctctgtgtccatcatgggcagtgaccccaaggtgcgggccggggctgtggatgtggtgcgccactggcaggacctgggctacctgatcatctacgtgacaggccgcccagacatgcagaagcagagggtggtggcctggctggcccagcacaacttcccccacggcgtggtgtccttctgtgatggcctggtgcatgaccccctgcggcacaaggccaacttcctgaagctgctgatcagcgagctgcacctgcgggtgcacgccgcctacggcagcaccaaggatgtggccgtgtacagcgccatcagcctgagccccatgcagatctacatcgtgggccggcccaccaagaagctgcagcagcagtgccagttcatcacagatggctatgctgcccacctggcccagctgaagtacagccaccgggcccggcctgccaggaacacagccaccaggatggccctgaggaagggcagctttggcctgcccggccagggcgacttcctgcggagcaggaaccacctgctgcggaccatcagcgcccagcccagcggccccagccacagacatgagaggacccagagccaggctgatggagagcagaggggccagaggtccatgtctgtggccgccggctgctggggccgggccatgacaggccgcctggagcccggggctgctgctggccccaagtag

SEQ ID NO: 36820 - DNA, 3213 bp, Artificial Sequence
  Description of Artificial Sequence: Synthetic coding sequence
atgatcatcaaggagtaccgcatccccctgcccatgacagtggaggagtacagaattgcccagctgtacatgatccagaagaagagcagaaatgagacctacggggagggcagcggcgtggagatcctggagaaccggcccttctggaggatgcagagcatcgcccgggacagtgatgagagcagtgatgatgagttctttgatgcccacgaggacctgagtgacacagaggagatgttccccaaggacatcaccaagtggagcagcaatgacctgatggacaagattgagagccctgagcctgaggacacccaggacggcctgtaccggcagggcgcccctgagttccgggtggccagctctgtggagcagctgaacatcattgaagatgaggtgtcccagcccctggccgccccacccagcaagatccacgtgctgctgctggtgctgcatggaggcaccatcctggacaccggggccggggaccccagcagcaagaagggagatgccaacaccatcgccaacgtgtttgacacagtgatgagggtgcactaccccagcgccctgggccgcctggccatccggctggtgccctgcccccctgtgtgcagtgatgcctttgccctggtgagcaacctgagcccctacagccatgatgagggctgcctgagcagcagccaggaccacatccccctggccgccctgcccctgctggccaccagcagcccccagtaccaggaggccgtggccaccgtcatccagagggccaacctggcctacggggacttcatcaagagccaggagggcatgaccttcaacggccaggtgtgcctgattggagactgtgtgggcggcatcctggcctttgatgccctgtgctacagcaaccagcctgtgtctgagagccagagcagcagcagaagaggctctgtggtgtccatgcaggacaatgacctgctgagccctggcatcctgatgaatgctgcccactgctgcggcggcggcggcggcggcggcggcggcggcggcagcagcggcggcggcggcagcagcggcggcagcagcctggagagcagccgccacctgagccgcagcaatgtggacatccccaggagcaatggaacagaggaccccaagaggcagctgcccaggaagagaagtgacagcagcacctatgagctggacaccatccagcagcaccaggccttcctgagcagcctgcacgcctctgtgctgaggacagagccctgcagccgccacagcagcagcagcaccatgctggatggcaccggggccctgggccgctttgattttgagatcacagacctcttcctgtttggctgccccctgggcctggtgctggccctgaggaagacagtcatcccagccctggatgtgttccagctgcggcctgcctgccagcaggtgtacaacctcttccaccctgctgaccccagcgccagccggctggagcccctgctggagcggcgcttccacgccctgccccccttctctgtgccccgctaccagcgctaccccctgggagatggctgcagcaccctgctggctgatgtgctgcagacccacaatgctgccttccaggagcacggggcccccagcagccctggaacagccccagccagccggggcttccggcgggccagcgagatcagcatcgccagccaggtgtctggcatggccgagagctacacagccagcagcatcgcccagaaggccccagatgccctgagccacacccccagcgtgcggcggctgagcctgctggccctgcctgcccccagccccaccaccccaggcccccaccccccagccaggaaggccagccctggcctggagcgggcccctggcctgcctgagctggacattggagaggtggccgccaagtggtggggccagaagagaattgattatgccctgtactgcccagatgccctgacagccttccccaccgtggccctgccccacctgttccacgccagctactgggagagcacagatgtggtgtccttcctgctgcggcaggtgatgagacatgacaacagcagcatcctggagctggatggcaaggaggtgtctgtgttcacccccagcaagccccgggagaagtggcagaggaagaggacccacgtgaagctgagaaatgtgacagccaaccaccgcatcaatgatgccctggccaatgaagatggcccccaggtgctgaccggccgcttcatgtatggccccctggacatggtgaccctgaccggggagaaggtggatgtgcacatcatgacccagccccccagcggggagtggctgtacctggacaccctggtgaccaacaacagcggccgggtgtcctacaccatccctgagagccaccggctgggcgtgggcgtgtaccccatcaagatggtggtgcggggggaccacacctttgctgacagctacatcaccgtgctgcccaagggcacagaatttgtggtgttcagcattgatggcagctttgctgcctctgtgtccatcatgggcagtgaccccaaggtgcgggccggggctgtggatgtggtgcgccactggcaggacctgggctacctgatcatctacgtgacaggccgcccagacatgcagaagcagagggtggtggcctggctggcccagcacaacttcccccatggagtggtgtccttctgtgatggcctggtgcatgaccccctgcggcacaaggccaacttcctgaagctgctgatcagcgagctgcacctgcgggtgcatgctgcctacggcagcaccaaggatgtggccgtgtacagcgccatcagcctgagccccatgcagatctacatcgtgggccggcccaccaagaagctgcagcagcagtgccagttcatcacagatggctacgccgcccacctggcccagctgaagtacagccaccgggcccggcctgccaggaacacagccaccaggatggccctgaggaagggcagctttggcctgcccggccagggcgacttcctgcggagcaggaaccacctgctgcggaccatcagcgcccagcccagcggccccagccacagacatgagaggacccagagccaggctgatggagagcagaggggccagaggtccatgtctgtggccgccggctgctggggccgggccatgacaggccgcctggagcctggagctgctgctggccccaagtag

SEQ ID NO: 36821 - DNA, 48 bp, Artificial Sequence
  Description of Artificial Sequence: Synthetic coding sequence
atgatcatcaaggagtaccgcatccccctgcccatgacagtggagtag

SEQ ID NO: 36822 - DNA, 126 bp, Artificial Sequence
  Description of Artificial Sequence: Synthetic coding sequence
atgatcatcaaggagtaccgcatccccctgcccatgacagtggaggagtacagaattgcccagctgtacatgatccagaagaagagcagaaatgagacctacggggagggcagcggcgtggagtag

SEQ ID NO: 36823 - DNA, 4050 bp, Artificial Sequence; identical to SEQ ID NO: 36819
  Description of Artificial Sequence: Synthetic coding sequence

SEQ ID NO: 36824 - DNA, 1251 bp, Artificial Sequence
  Description of Artificial Sequence: Synthetic coding sequence
atgagcagcaactgcaccagcaccacagctgtggccgtggcccccctgagcgccagcaagaccaagaccaagaagaagcactttgtgtgccagaaggtgaagctgttccgggccagcgagcccatcctgtctgtgctgatgtggggcgtgaaccacaccatcaatgagctgagcaatgtgcctgtgcctgtgatgctgatgccagatgacttcaaggcctacagcaagatcaaggtggacaaccacctgttcaacaaggagaacctgcccagccgcttcaagttcaaggagtactgccccatggtgttcaggaacctgcgggagcgcttcggcattgatgaccaggactaccagaacagcgtgaccaggtctgcccccatcaacagcgacagccagggccgctgtggcacccgcttcctgaccacctatgacagaagatttgtgatcaagacagtgtccagtgaagatgtggccgagatgcacaacatcctgaagaagtaccaccagttcatcgtggagtgccacggcaacaccctgctgccccagttcctgggcatgtaccgcctgactgtggatggagtggagacctacatggtggtgaccagaaatgtgttcagccaccggctgactgtgcacaggaaatatgacctgaagggcagcacagtggcccgggaggccagtgacaaggagaaggccaaggacctgcccaccttcaaggacaatgacttcctgaatgaaggccagaagctgcacgtgggggaggagagcaagaagaacttcctggagaagctgaagagagatgtggagttcctggcccagctgaagatcatggactacagcctgctggtgggcatccatgatgtggacagagctgagcaggaggagatggaggtggaggagcgggcagaagatgaggagtgtgaaaatgatggagtgggcggcaacctgctgtgcagctatggcaccccaccagacagccctggcaacctgctgtccttcccccgcttctttggacctggagaatttgaccccagcgtggatgtgtatgccatgaagagccatgagagcagccccaagaaggaggtgtacttcatggccatcatcgacatcctgaccccctatgacaccaagaagaaggccgcccatgctgccaagacagtgaagcatggagctggagctgagatcagcacagtgaaccctgagcagtacagcaagcgcttcaatgagttcatgagcaacatcctgacctag

SEQ ID NO: 36825 - DNA, 834 bp, Artificial Sequence
  Description of Artificial Sequence: Synthetic coding sequence
atgagcagcaactgcaccagcaccacagctgtggccgtggcccccctgagcgccagcaagaccaagaccaagaagaagcactttgtgtgccagaaggtgaagctgttccgggccagcgagcccatcctgtctgtgctgatgtggggcgtgaaccacaccatcaatgagctgagcaatgtgcctgtgcctgtgatgctgatgccagatgacttcaaggcctacagcaagatcaaggtggacaaccacctgttcaacaaggagaacctgcccagccgcttcaagttcaaggagtactgccccatggtgttcaggaacctgcgggagcgcttcggcattgatgaccaggactaccagaacagcgtgaccaggtctgcccccatcaacagcgacagccagggccgctgtggcacccgcttcctgaccacctatgacagaagatttgtgatcaagacagtgtccagtgaagatgtggccgagatgcacaacatcctgaagaagtaccaccagttcatcgtggagtgccacggcaacaccctgctgccccagttcctgggcatgtaccgcctgactgtggatggagtggagacctacatggtggtgaccagaaatgtgttcagccaccggctgactgtgcacaggaaatatgacctgaagggcagcacagtggcccgggaggccagtgacaaggagaaggccaaggacctgcccaccttcaaggacaatgacttcctgaatgaaggccagaagctgcacgtgggggaggagagcaagaagaacttcctggagaagctgaagagagatgtggaggagatcctggtgctgagccctggatag

SEQ ID NO: 36826 - DNA, 1830 bp, Artificial Sequence
  Description of Artificial Sequence: Synthetic coding sequence
atgtggaggctgcccggggcccgggccgccctgcgggtcatcagaacagctgtggagaagctgagcagagctgaggccggcagccagacagctgctggggccatggagagagctgtggtgcgctgtgtgcccagcgagcccaagctgagcctgagctttgccctggctgatggcagccacaagaacatgcagagggaccagagcgagcccctgggccgggtgctgagccgcatcgccaccaatgccctgaagggccacgccaaggctgctgctgccaagaagagcaggaagagccggcccaatgccagcggcggggccgcctgcagcggccctggccctgagcctgctgtgttctgtgagcctgtggtgaagctgtactaccgggaggaggccgtggccgaggatgtgctgaatgtggatgcctggcaggatggagctgtgctgcagattggagatgtgaagtacaaggtggagagaaatcctccagccttcacagagctgcagctgccccgctacatcatggccggcttccctgtgtgccccaagctgagcctggagtttggagaccctgccagcagcctcttccgctggtacaaggaggccaagccaggagctgctgagcctgaggtgggcgtgcccagcagcctgagccccagcagccccagcagctcctggacagaaacagatgtggaggagcgggtgtacacccccagcaatgctgacatcggcctgcggctgaagctgcactgcaccccaggagatggccagcgcttcggccacagccgggagctggagagcgtgtgtgtggtggaggccggccctggcacctgcacctttgaccaccgccacctgtacaccaagaaggtgacagaagatgccctgatcagaacagtgtcctacaacatcctggccgacacctacgcccagacagagttcagcaggacagtgctgtacccctactgtgccccctatgccctggagctggactaccggcagaacctgatccagaaggagctgaccggctacaatgctgatgtgatctgcctgcaggaggtggacagagctgtgttcagtgacagcctggtgcctgccctggaggccttcggcctggagggcgtcttccgcatcaagcagcacgagggcctggccaccttctacaggaagagcaagttcagcctgctgagccagcacgacatctccttctatgaggccctggagagtgaccccctgcacaaggagctgctggagaagctggtgctgtaccccagcgcccaggagaaggtgctgcagaggagctctgtgctgcaggtgtctgtgctgcagagcaccaaggacagcagcaagaggatctgtgtggccaacacccacctgtactggcaccccaagggcggctacatccgcctcatccagatggctgtggccctggcccacatccgccacgtgtcctgtgacctgtacccaggcatccctgtgatcttctgtggggacttcaacagcacccccagcacaggcatgtaccacttcgtcatcaatggcagcatccctgaggaccacgaggactgggccagcaatggagaggaggagcgctgcaacatgagcctgacccacttcttcaagctgaagagcgcctgtggggagcccgcctacaccaactacgtgggcggcttccacggctgcctggactacatcttcatcgacctgaatgccctggaggtggagcaggtgatccccctgcccagccatgaggaggtgaccacccaccaggccctgcccagcgtgagccaccccagcgaccacatcgccctggtgtgtgacctgaagtggaagtag

SEQ ID NO: 36827 - DNA, 1419 bp, Artificial Sequence
  Description of Artificial Sequence: Synthetic coding sequence
atgtggaggctgcccggggcccgggccgccctgcgggtcatcagaacagctgtggagaagctgagcagagctgaggccggcagccagacagctgctggggccatggagagagctgtggtgcgctgtgtgcccagcgagcccaagctgagcctgagctttgccctggctgatggcagccacaagaacatgcagagggaccagagcgagcccctgggccgggtgctgagccgcatcgccaccaatgccctgaagggccacgccaaggctgctgctgccaagaagagcaggaagagccggcccaatgccagcggcggggccgcctgcagcggccctggccctgagcctgctgtgttctgtgagcctgtggtgaagctgtactaccgggaggaggccgtggccgaggatgtgctgaatgtggatgcctggcaggatggagctgtgctgcagattggagatgtgaagtacaaggtggagagaaatcctccagccttcacagagctgcagctgccccgctacatcatggccggcttccctgtgtgccccaagctgagcctggagtttggagaccctgccagcagcctcttccgctggtacaaggaggccaagccaggagctgctgagcctgaggtgggcgtgcccagcagcctgagccccagcagccccagcagctcctggacagaaacagatgtggaggagcgggtgtacacccccagcaatgctgacatcggcctgcggctgaagctgcactgcaccccaggagatggccagcgcttcggccacagccgggagctggagagcgtgtgtgtggtggaggccggccctggcacctgcacctttgaccaccgccacctgtacaccaagaaggtgacagaagatgccctgatcagaacagtgtcctacaacatcctggccgacacctacgcccagacagagttcagcaggacagtgctgtacccctactgtgccccctatgccctggagctggactaccggcagaacctgatccagaaggagctgaccggctacaatgctgatgtgatctgcctgcaggaggtggacagagctgtgttcagtgacagcctggtgcctgccctggaggccttcggcctggagggcgtcttccgcatcaagcagcacgagggcctggccaccttctacaggaagagcaagttcagcctgctgagccagcacgacatctccttctatgaggccctggagagtgaccccctgcacaaggagctgctggagaagctggtgctgtaccccagcgcccaggagaaggtgctgcagaggagctctgtgctgcaggtgtctgtgctgcagagcaccaaggacagcagcaagaggatctgtgtggccaacacccacctgtactggcaccccaagggccgcttctacctggtgtcccaggtgacctag

SEQ ID NO: 36828 - DNA, 2826 bp, Artificial Sequence
  Description of Artificial Sequence: Synthetic coding sequence
atgggccaggcctgtggccacagcatcctgtgccgcagccagcagtacccagctgcccggcctgctgagccccggggccagcaggtgttcctgaagccagatgagcccccacctccaccccagccctgtgccgacagcctgcaggatgccctgctgagcctgggcagcgtcatcgacatcagcggcctgcagagagctgtgaaggaggccctgtctgctgtgctgccccgggtggagaccgtgtacacctacctgctggatggagagagccagctggtgtgtgaagatcctcctcatgagctgccccaggagggcaaggtgcgggaggccatcatcagccagaagaggctgggctgcaatggcctgggcttcagtgacctgcccgggaagcccctggcccggctggtggcccccctggccccagacacccaggtgctggtgatgcccctggccgacaaggaggccggggctgtggccgccgtcatcctggtgcactgcggccagctgagtgacaatgaggagtggagcctgcaggccgtggagaagcacaccctggtggccctgcggcgggtgcaggtgctgcagcagaggggcccccgggaggcccccagggctgtgcagaaccccccagagggcacagctgaggaccagaagggcggggccgcctacacagaccgggacaggaagatcctgcagctgtgtggggagctgtatgacctggatgccagcagcctgcagctgaaggtgctgcagtacctgcagcaggagacccgggccagccgctgctgcctgctgctggtgtctgaggacaacctgcagctgagctgcaaggtgattggagacaaggtgctgggggaggaggtgtccttccccctgaccggctgcctgggccaggtggtggaggacaagaagagcatccagctgaaggacctgaccagtgaagatgtgcagcagctgcagagcatgctgggctgtgagctgcaggccatgctgtgtgtgcctgtgatcagccgggccacagaccaggtggtggccctggcctgtgccttcaacaagctggagggggacctcttcacagatgaagatgagcacgtgatccagcactgcttccactacaccagcacagtgctgaccagcaccctggccttccagaaggagcagaagctgaagtgtgagtgccaggccctgctgcaggtggccaagaacctcttcacccacctggatgatgtgtctgtgctgctgcaggagatcatcacagaggccaggaacctgagcaatgctgagatctgcagcgtcttcctgctggaccagaatgagctggtggccaaggtgtttgatggcggcgtggtggatgatgagagctatgagatccgcatcccagctgaccagggcattgctggccacgtggccaccaccggccagatcctgaacatcccagatgcctatgcccaccccctcttctaccggggcgtggatgacagcacaggcttccgcaccaggaacatcctgtgcttccccatcaagaatgaaaaccaggaggtgattggagtggccgagctggtgaacaagatcaatggcccctggttcagcaagtttgatgaggacctggccacagccttcagcatctactgcggcatcagcatcgcccacagcctgctgtacaagaaggtgaatgaggcccagtaccgcagccacctggccaatgagatgatgatgtaccacatgaaggtgtctgatgatgagtacaccaagctgctgcatgatggcatccagcctgtggccgccatcgacagcaactttgccagcttcacctacacccccaggagcctgcctgaagatgacacctccatggccatcctgtccatgctgcaggacatgaacttcatcaacaactacaagattgactgccccaccctggcccgcttctgcctgatggtgaagaagggctacagagatcctccctaccacaactggatgcacgccttctctgtgagccacttctgctacctgctgtacaagaacctggagctgaccaactacctggaggacatcgagatctttgccctcttcatcagctgcatgtgccacgacctggaccaccggggcaccaacaacagcttccaggtggccagcaagtctgtgctggccgccctgtacagcagcgagggctctgtgatggagcggcaccactttgcccaggccatcgccatcctgaacacccacggctgcaacatctttgaccacttcagcaggaaggactaccagaggatgctggacctgatgagggacatcatcctggccacagacctggcccaccacctgcgcatcttcaaggacctgcagaagatggccgaggtgggctatgacaggaacaacaagcagcaccaccggctgctgctgtgcctgctgatgaccagctgtgacctgagtgaccagaccaagggctggaagaccaccaggaagattgctgagctgatctacaaggagttcttcagccagggcgacctggagaaggccatgggcaaccggcccatggagatgatggaccgggagaaggcctacatccctgagctgcagatctccttcatggagcacatcgccatgcccatctacaagctgctgcaggacctcttccccaaggctgctgagctgtatgagcgggtggccagcaaccgggagcactggaccaaggtgagccacaagttcaccatccggggcctgcccagcaacaacagcctggacttcctggatgaggagtatgaggtgcctgacctggatggcacccgggcccccatcaatggctgctgcagcctggatgctgagtag

SEQ ID NO: 36829 - DNA, 2058 bp, Artificial Sequence
  Description of Artificial Sequence: Synthetic coding sequence
atggtgctggtgctgcaccacatcctgattgctgtggtgcagttcctgcggcggggccagcaggtgttcctgaagccagatgagcccccacctccaccccagccctgtgccgacagcctgcaggatgccctgctgagcctgggctctgtgattgacatcagcggcctgcagagagctgtgaaggaggccctgtctgctgtgctgccccgggtggagaccgtgtacacctacctgctggatggagagagccagctggtgtgtgaggacccccctcatgagctgccccaggagggcaaggtgcgcttcacagatgaagatgagcacgtgatccagcactgcttccactacaccagcacagtgctgaccagcaccctggccttccagaaggagcagaagctgaagtgtgagtgccaggccctgctgcaggtggccaagaacctcttcacccacctggatgatgtgtctgtgctgctgcaggagatcatcacagaggccaggaacctgagcaatgctgagatctgcagcgtcttcctgctggaccagaatgagctggtggccaaggtgtttgatggcggcgtggtggatgatgagagctatgagatccgcatcccagctgaccagggcattgctggccacgtggccaccaccggccagatcctgaacatcccagatgcctatgcccaccccctcttctaccggggcgtggatgacagcacaggcttccgcaccaggaacatcctgtgcttccccatcaagaatgaaaaccaggaggtgattggagtggccgagctggtgaacaagatcaatggcccctggttcagcaagtttgatgaggacctggccacagccttcagcatctactgcggcatcagcatcgcccacagcctgctgtacaagaaggtgaatgaggcccagtaccgcagccacctggccaatgagatgatgatgtaccacatgaaggtgtctgatgatgagtacaccaagctgctgcatgatggcatccagcctgtggccgccatcgacagcaactttgccagcttcacctacacccccaggagcctgcctgaagatgacacctccatggccatcctgtccatgctgcaggacatgaacttcatcaacaactacaagattgactgccccaccctggcccgcttctgcctgatggtgaagaagggctacagagatcctccctaccacaactggatgcacgccttctctgtgagccacttctgctacctgctgtacaagaacctggagctgaccaactacctggaggacatcgagatctttgccctcttcatcagctgcatgtgccacgacctggaccaccggggcaccaacaacagcttccaggtggccagcaagtctgtgctggccgccctgtacagcagcgagggctctgtgatggagcggcaccactttgcccaggccatcgccatcctgaacacccacggctgcaacatctttgaccacttcagcaggaaggactaccagaggatgctggacctgatgagggacatcatcctggccacagacctggcccaccacctgcgcatcttcaaggacctgcagaagatggccgaggtgggctatgacaggaacaacaagcagcaccaccggctgctgctgtgcctgctgatgaccagctgtgacctgagtgaccagaccaagggctggaagaccaccaggaagattgctgagctgatctacaaggagttcttcagccagggcgacctggagaaggccatgggcaaccggcccatggagatgatggaccgggagaaggcctacatccctgagctgcagatctccttcatggagcacatcgccatgcccatctacaagctgctgcaggacctcttccccaaggctgctgagctgtatgagcgggtggccagcaaccgggagcactggaccaaggtgagccacaagttcaccatccggggcctgcccagcaacaacagcctggacttcctggatgaggagtatgaggtgcctgacctggatggcacccgggcccccatcaatggctgctgcagcctggatgctgagtag

SEQ ID NO: 36830 - DNA, 2853 bp, Artificial Sequence
  Description of Artificial Sequence: Synthetic coding sequence
atgagctacatcctgaagatgcctggcacctgcctgcctggagagggcaccacctatgagctgccccccagcagcctgcaccccagcagcgcccctgtgaccagcggcggcacctgcccagccctgctgacagaggccggctgggaggcccccatcatggccttcacagaggccgccagcgctgtgggccccagctggacccacagccgggcctctgtgagcagcacagtgaagacagaaagaagaagaagagtgctgcaggcctgtggcatggtgagaagaggccagcaggtgttcctgaagccagatgagcccccacctccaccccagccctgtgccgacagcctgcaggatgccctgctgagcctgggctctgtgattgacatcagcggcctgcagagagctgtgaaggaggccctgtctgctgtgctgccccgggtggagaccgtgtacacctacctgctggatggagagagccagctggtgtgtgaggacccccctcatgagctgccccaggagggcaaggtgcgggaggccatcatcagccagaagaggctgggctgcaatggcctgggcttcagtgacctgcccgggaagcccctggcccggctggtggcccccctggccccagacacccaggtgctggtgatgcccctggccgacaaggaggccggggctgtggccgctgtgatcctggtgcactgcggccagctgagtgacaatgaggagtggagcctgcaggccgtggagaagcacaccctggtggccctgcggcgggtgcaggtgctgcagcagaggggcccccgggaggcccccagggctgtgcagaaccccccagagggcacagctgaggaccagaagggcggggccgcctacacagaccgggacaggaagatcctgcagctgtgtggggagctgtatgacctggatgccagcagcctgcagctgaaggtgctgcagtacctgcagcaggagacccgggccagccgctgctgcctgctgctggtgtctgaggacaacctgcagctgagctgcaaggtgattggagacaaggtgctgggggaggaggtgtccttccccctgaccggctgcctgggccaggtggtggaggacaagaagagcatccagctgaaggacctgaccagtgaagatgtgcagcagctgcagagcatgctgggctgtgagctgcaggccatgctgtgtgtgcctgtgatcagccgggccacagaccaggtggtggccctggcctgtgccttcaacaagctggagggggacctcttcacagatgaagatgaacatgtgatccagcactgcttccactacaccagcacagtgctgaccagcaccctggccttccagaaggagcagaagctgaagtgtgagtgccaggccctgctgcaggtggccaagaacctcttcacccacctggatgatgtgtctgtgctgctgcaggagatcatcacagaggccaggaacctgagcaatgctgagatctgcagcgtcttcctgctggaccagaatgagctggtggccaaggtgtttgatggaggagtggtggatgatgagagctatgagatccgcatcccagctgaccagggcattgctggccacgtggccaccaccggccagatcctgaacatcccagatgcctatgcccaccccctcttctacagaggagtggatgacagcacaggcttccgcaccaggaacatcctgtgcttccccatcaagaatgaaaaccaggaggtgattggagtggccgagctggtgaacaagatcaatggcccctggttcagcaagtttgatgaggacctggccacagccttcagcatctactgcggcatcagcatcgcccacagcctgctgtacaagaaggtgaatgaggcccagtaccgcagccacctggccaatgagatgatgatgtaccacatgaaggtgtctgatgatgagtacaccaagctgctgcatgatggcatccagcctgtggccgccatcgacagcaactttgccagcttcacctacacccccaggagcctgcctgaagatgacacctccatggccatcctgtccatgctgcaggacatgaacttcatcaacaactacaagattgactgccccaccctggcccgcttctgcctgatggtgaagaagggctacagagaccccccctaccacaactggatgcacgccttctctgtgagccacttctgctacctgctgtacaagaacctggagctgaccaactacctggaggacatcgagatctttgccctcttcatcagctgcatgtgccacgacctggaccaccggggcaccaacaacagcttccaggtggccagcaagtctgtgctggccgccctgtacagcagcgagggctctgtgatggagcggcaccactttgcccaggccatcgccatcctgaacacccacggctgcaacatctttgaccacttcagcaggaaggactaccagaggatgctggacctgatgagggacatcatcctggccacagacctggcccaccacctgcgcatcttcaaggacctgcagaagatggccgaggtgggctatgacaggaacaacaagcagcaccaccggctgctgctgtgcctgctgatgaccagctgtgacctgagtgaccagaccaagggctggaagaccaccaggaagattgctgagctgatctacaaggagttcttcagccagggcgacctggagaaggccatgggcaaccggcccatggagatgatggaccgggagaaggcctacatccctgagctgcagatctccttcatggagcacatcgccatgcccatctacaagctgctgcaggacctcttccccaaggcctag

SEQ ID NO: 36831 - DNA, 2799 bp, Artificial Sequence
  Description of Artificial Sequence: Synthetic coding sequence
atgaagaagcagaggatccaggagggcaagagcctggcccacagaagaggccagcaggtgttcctgaagccagatgagcccccacctccaccccagccctgtgccgacagcctgcaggatgccctgctgagcctgggctctgtgattgacatcagcggcctgcagagagctgtgaaggaggccctgtctgctgtgctgccccgggtggagaccgtgtacacctacctgctggatggagagagccagctggtgtgtgaggacccccctcatgagctgccccaggagggcaaggtgcgggaggccatcatcagccagaagaggctgggctgcaatggcctgggcttcagtgacctgcccgggaagcccctggcccggctggtggcccccctggccccagacacccaggtgctggtgatgcccctggccgacaaggaggccggggctgtggccgctgtgatcctggtgcactgcggccagctgagtgacaatgaggagtggagcctgcaggccgtggagaagcacaccctggtggccctgcggcgggtgcaggtgctgcagcagaggggcccccgggaggcccccagggctgtgcagaaccccccagagggcacagctgaggaccagaagggcggggccgcctacacagaccgggacaggaagatcctgcagctgtgtggggagctgtatgacctggatgccagcagcctgcagctgaaggtgctgcagtacctgcagcaggagacccgggccagccgctgctgcctgctgctggtgtctgaggacaacctgcagctgagctgcaaggtgattggagacaaggtgctgggggaggaggtgtccttccccctgaccggctgcctgggccaggtggtggaggacaagaagagcatccagctgaaggacctgaccagtgaagatgtgcagcagctgcagagcatgctgggctgtgagctgcaggccatgctgtgtgtgcctgtgatcagccgggccacagaccaggtggtggccctggcctgtgccttcaacaagctggagggggacctcttcacagatgaagatgaacatgtgatccagcactgcttccactacaccagcacagtgctgaccagcaccctggccttccagaaggagcagaagctgaagtgtgagtgccaggccctgctgcaggtggccaagaacctcttcacccacctggatgatgtgtctgtgctgctgcaggagatcatcacagaggccaggaacctgagcaatgctgagatctgcagcgtcttcctgctggaccagaatgagctggtggccaaggtgtttgatggaggagtggtggatgatgagagctatgagatccgcatcccagctgaccagggcattgctggccacgtggccaccaccggccagatcctgaacatcccagatgcctatgcccaccccctcttctacagaggagtggatgacagcacaggcttccgcaccaggaacatcctgtgcttccccatcaagaatgaaaaccaggaggtgattggagtggccgagctggtgaacaagatcaatggcccctggttcagcaagtttgatgaggacctggccacagccttcagcatctactgcggcatcagcatcgcccacagcctgctgtacaagaaggtgaatgaggcccagtaccgcagccacctggccaatgagatgatgatgtaccacatgaaggtgtctgatgatgagtacaccaagctgctgcatgatggcatccagcctgtggccgccatcgacagcaactttgccagcttcacctacacccccaggagcctgcctgaagatgacacctccatggccatcctgtccatgctgcaggacatgaacttcatcaacaactacaagattgactgccccaccctggcccgcttctgcctgatggtgaagaagggctacagagaccccccctaccacaactggatgcacgccttctctgtgagccacttctgctacctgctgtacaagaacctggagctgaccaactacctggaggacatcgagatctttgccctcttcatcagctgcatgtgccacgacctggaccaccggggcaccaacaacagcttccaggtggccagcaagtctgtgctggccgccctgtacagcagcgagggctctgtgatggagcggcaccactttgcccaggccatcgccatcctgaacacccacggctgcaacatctttgaccacttcagcaggaaggactaccagaggatgctggacctgatgagggacatcatcctggccacagacctggcccaccacctgcgcatcttcaaggacctgcagaagatggccgaggtgggctatgacaggaacaacaagcagcaccaccggctgctgctgtgcctgctgatgaccagctgtgacctgagtgaccagaccaagggctggaagaccaccaggaagattgctgagctgatctacaaggagttcttcagccagggcgacctggagaaggccatgggcaaccggcccatggagatgatggaccgggagaaggcctacatccctgagctgcagatctccttcatggagcacatcgccatgcccatctacaagctgctgcaggacctcttccccaaggctgctgagctgtatgaaagagtggccagcaaccgggagcactggaccaaggtgagccacaagttcaccatccggggcctgcccagcaacaacagcctggacttcctggatgaggagtatgaggtgcctgacctggatggcacccgggcccccatcaatggctgctgcagcctggatgctgagtag

SEQ ID NO: 36832 - DNA, 2805 bp, Artificial Sequence
  Description of Artificial Sequence: Synthetic coding sequence
atggtgctggtgctgcaccacatcctgattgctgtggtgcagttcctgcggcggggccagcaggtgttcctgaagccagatgagcccccacctccaccccagccctgtgccgacagcctgcaggatgccctgctgagcctgggctctgtgattgacatcagcggcctgcagagagctgtgaaggaggccctgtctgctgtgctgccccgggtggagaccgtgtacacctacctgctggatggagagagccagctggtgtgtgaggacccccctcatgagctgccccaggagggcaaggtgcgggaggccatcatcagccagaagaggctgggctgcaatggcctgggcttcagtgacctgcccgggaagcccctggcccggctggtggcccccctggccccagacacccaggtgctggtgatgcccctggccgacaaggaggccggggctgtggccgctgtgatcctggtgcactgcggccagctgagtgacaatgaggagtggagcctgcaggccgtggagaagcacaccctggtggccctgcggcgggtgcaggtgctgcagcagaggggcccccgggaggcccccagggctgtgcagaaccccccagagggcacagctgaggaccagaagggcggggccgcctacacagaccgggacaggaagatcctgcagctgtgtggggagctgtatgacctggatgccagcagcctgcagctgaaggtgctgcagtacctgcagcaggagacccgggccagccgctgctgcctgctgctggtgtctgaggacaacctgcagctgagctgcaaggtgattggagacaaggtgctgggggaggaggtgtccttccccctgaccggctgcctgggccaggtggtggaggacaagaagagcatccagctgaaggacctgaccagtgaagatgtgcagcagctgcagagcatgctgggctgtgagctgcaggccatgctgtgtgtgcctgtgatcagccgggccacagaccaggtggtggccctggcctgtgccttcaacaagctggagggggacctcttcacagatgaagatgaacatgtgatccagcactgcttccactacaccagcacagtgctgaccagcaccctggccttccagaaggagcagaagctgaagtgtgagtgccaggccctgctgcaggtggccaagaacctcttcacccacctggatgatgtgtctgtgctgctgcaggagatcatcacagaggccaggaacctgagcaatgctgagatctgcagcgtcttcctgctggaccagaatgagctggtggccaaggtgtttgatggaggagtggtggatgatgagagctatgagatccgcatcccagctgaccagggcattgctggccacgtggccaccaccggccagatcctgaacatcccagatgcctatgcccaccccctcttctacagaggagtggatgacagcacaggcttccgcaccaggaacatcctgtgcttccccatcaagaatgaaaaccaggaggtgattggagtggccgagctggtgaacaagatcaatggcccctggttcagcaagtttgatgaggacctggccacagccttcagcatctactgcggcatcagcatcgcccacagcctgctgtacaagaaggtgaatgaggcccagtaccgcagccacctggccaatgagatgatgatgtaccacatgaaggtgtctgatgatgagtacaccaagctgctgcatgatggcatccagcctgtggccgccatcgacagcaactttgccagcttcacctacacccccaggagcctgcctgaagatgacacctccatggccatcctgtccatgctgcaggacatgaacttcatcaacaactacaagattgactgccccaccctggcccgcttctgcctgatggtgaagaagggctacagagaccccccctaccacaactggatgcacgccttctctgtgagccacttctgctacctgctgtacaagaacctggagctgaccaactacctggaggacatcgagatctttgccctcttcatcagctgcatgtgccacgacctggaccaccggggcaccaacaacagcttccaggtggccagcaagtctgtgctggccgccctgtacagcagcgagggctctgtgatggagcggcaccactttgcccaggccatcgccatcctgaacacccacggctgcaacatctttgaccacttcagcaggaaggactaccagaggatgctggacctgatgagggacatcatcctggccacagacctggcccaccacctgcgcatcttcaaggacctgcagaagatggccgaggtgggctatgacaggaacaacaagcagcaccaccggctgctgctgtgcctgctgatgaccagctgtgacctgagtgaccagaccaagggctggaagaccaccaggaagattgctgagctgatctacaaggagttcttcagccagggcgacctggagaaggccatgggcaaccggcccatggagatgatggaccgggagaaggcctacatccctgagctgcagatctccttcatggagcacatcgccatgcccatctacaagctgctgcaggacctcttccccaaggctgctgagctgtatgaaagagtggccagcaaccgggagcactggaccaaggtgagccacaagttcaccatccggggcctgcccagcaacaacagcctggacttcctggatgaggagtatgaggtgcctgacctggatggcacccgggcccccatcaatggctgctgcagcctggatgctgagtag

SEQ ID NO: 36833 - DNA, 3426 bp, Artificial Sequence
  Description of Artificial Sequence: Synthetic coding sequence
atggctgtgcctggagatgctgcccgggtgcgggacaagcctgtgcacagcggcgtgtcccaggcccccacagctggccgggactgccaccacagagctgaccctgccagcccccgggacagcggctgccggggctgctggggagacctggtgctgcagcccctgcggagcagcaggaagctgagcagcgccctgtgtgccggcagcctgtccttcctgctggccctgctggtgcggctggtgcggggggaggtgggctgtgacctggagcagtgcaaggaggccgctgctgctgaggaggaggaggccgcccctggagctgagggcggcgtcttccctggcccccggggcggggcccctgggggcggggcccggctgagcccctggctgcagcccagcgccctgctcttcagcctgctgtgtgccttcttctggatgggcctgtacctgctgcgggccggcgtgcggctgcccctggccgtggccctgctggccgcctgctgcggcggggaggccctggtgcagatcggcctgggcgtgggggaggaccacctgctgagcctgcctgctgctggggtggtgctgagctgcctggccgccgccacctggctggtgctgcggctgcggctgggcgtgctgatgattgccctgaccagcgctgtgaggacagtgtccctcatcagcctggagcgcttcaaggtggcctggaggccctacctggcctacctggccggcgtgctgggcatcctgctggcccgctacgtggagcagatcctgccccagagcgctgaggccgccccccgggagcacctgggcagccagctgattgctggcaccaaggaggacatccctgtgttcaagagaagaagaagaagcagctctgtggtgtctgctgagatgagcggctgcagcagcaagagccacaggaggaccagcctgccctgcatcccccgggagcagctgatgggccacagcgagtgggaccacaagaggggcccccggggcagccagagcagcggcaccagcatcaccgtggacattgctgtgatgggagaggcccacggcctcatcacagacctgctggccgaccccagcctgcccccaaatgtgtgcaccagcctgcgggctgtgagcaacctgctgagcacccagctgaccttccaggccatccacaagccccgggtgaaccctgtgaccagcctgtctgagaactacacctgcagcgacagcgaggagagcagcgagaaggacaagctggccatccccaagaggctgcggcgcagcctgcccccaggcctgctgcggcgggtgagcagcacctggaccaccaccaccagcgccaccggcctgcccaccctggagcccgcccctgtgagaagagacaggagcaccagcatcaagctgcaggaggcccccagcagcagcccagacagctggaacaaccctgtgatgatgaccctgaccaagagccgctccttcaccagcagctatgccatctctgctgccaaccacgtgaaggccaagaagcagagcaggcctggggccctggccaagatcagccccctgagcagcccctgcagcagccccctgcagggcaccccagccagcagcctggtgtccaagatctctgctgtgcagtttcctgagagcgctgacaccacagccaagcagagcctgggcagccaccgggccctgacctacacccagagcgccccagacctgagcccccagatcctgaccccacctgtgatctgcagcagctgtggccggccctacagccagggcaacccagcagatgagcccctggagaggtctggagtggccaccaggacccccagcaggacagatgacacagcccaggtgaccagtgactatgagaccaacaacaacagcgacagcagtgacatcgtgcagaatgaagatgaaacagagtgcctgcgggagcccctgaggaaggccagcgcctgcagcacctacgcccctgagaccatgatgttcctggacaagcccatcctggcccctgagcccctggtgatggacaacctggacagcatcatggagcagctgaacacctggaacttccccatctttgacctggtggagaacattggaagaaaatgtggccgcatcctgagccaggtgtcctaccgcctgtttgaggacatgggcctgtttgaggccttcaagatccccatccgggagttcatgaactacttccacgccctggagatcggctacagagacatcccctaccacaaccgcatccacgccacagatgtgctgcatgctgtgtggtacctgaccacccagcccatccctggcctgagcaccgtcatcaatgaccacggcagcaccagtgacagcgacagcgacagcggcttcacccacggccacatgggctacgtgttcagcaagacctacaacgtgacagatgacaagtatggctgcctgagcggcaacatcccagccctggagctgatggccctgtatgtggccgccgccatgcatgactatgaccaccctggccgcaccaatgccttcctggtggccaccagcgccccccaggccgtgctgtacaatgacagatctgtgctggagaaccaccacgccgccgccgcctggaacctcttcatgagcaggcctgagtacaacttcctgatcaacctggaccacgtggagttcaagcacttccgcttcctggtgattgaggccatcctggccacagacctgaagaagcactttgattttgtggccaagttcaacgggaaggtgaatgatgatgtgggcatcgactggaccaatgaaaatgaccggctgctggtgtgccagatgtgcatcaagctggccgacatcaatggacctgccaagtgcaaggagctgcacctgcagtggacagatggcatcgtgaatgagttctatgagcagggagatgaggaggccagcctgggcctgcccatcagccccttcatggacagaagtgccccccagctggccaacctgcaggagagcttcatcagccacatcgtgggccccctgtgcaacagctatgacagcgctggcctgatgcctgggaagtgggtggaggacagtgatgaaagtggggacacagatgatcctgaggaggaggaggaggaggccccagccccaaatgaggaggagacctgtgagaacaatgaaagccccaagaagaagaccttcaagaggaggaagatctactgccagatcacccagcacctgctgcagaaccacaagatgtggaagaaggtgattgaggaggagcagaggctggccggcatcgagaaccagagcctggaccagaccccccagagccacagcagcgagcagatccaggccatcaaggaggaggaggaggagaagggcaagcccagaggagaggagatccccacccagaagccagaccagtag

SEQ ID NO: 36834 - DNA, 2670 bp, Artificial Sequence
  Description of Artificial Sequence: Synthetic coding sequence
atggccgagcggggccgcctgggcctgcccggggcccctggggccctgaacacccctgtgcccatgaacctgtttgccacctgggaggtggatggcagcagccccagctgtgtgccccggctgtgcagcctgaccctgaagaagctggtggtgttcaaggagctggagaaggagctgatctctgtggtgattgctgtgaagatgcagggcagcaagaggatcctgcggagccatgagatcgtgctgcccccatctggccaggtggagacagacctggccctgaccttcagcctgcagtacccccacttcctgaagcgggagggcaacaagctgcagatcatgctgcagaggaggaagcgctacaagaacagaaccatcctgggctacaagaccctggccgccggcagcatctccatggccgaggtgatgcagcaccccagcgagggcggccaggtgctgagcctgtgcagcagcatcaaggaggcccctgtgaaggctgctgagatctggatcgccagcctgagcagccagcccatcgaccacgaggacagcaccatgcaggccggccccaaggccaagagcacagacaactacagcgaggaggagtatgagagcttcagcagcgagcaggaggccagtgatgatgctgtgcagggccaggacctggatgaagatgactttgatgtgggcaagcccaagaagcagaggaggagcatcgtgaggaccacctccatgacccggcagcagaacttcaagcagaaggtggtggccctgctgcggcgcttcaaggtgtctgatgaggtgctggacagcgagcaggaccctgctgagcacatccctgaggccgaggaggacctggacctgctgtatgacaccctggacatggagcaccccagcgacagcggccctgacatggaggatgatgacagcgtgctgagcacccccaagcccaagctgcggccctactttgagggcctgagccacagcagcagccagacagaaattggcagcatccacagcgcccggagccacaaggagccccccagccctgcagatgtgcctgagaagaccaggagcctgggcggccggcagcccagcgacagcgtgtctgacacagtggccctgggcgtgcccggcccccgggagcaccctggccagcctgaggacagccctgaggccgaggccagcaccctggatgtgttcacagagcggctgccccccagcggccgcatcaccaagacagagagcctggtgatccccagcaccaggtctgagggcaagcaggccggcagaagaggccgcagcaccagcctgaaggagcggcaggccgcccggccccagaatgaaagagccaacagcctggacaatgaacgctgcccagatgcccggagccagctgcagatccccaggaagacagtgtatgaccagctgaaccacatcctgatcagtgatgaccagctgcctgagaacatcatcctggtgaacaccagtgactggcagggccagttcctgagtgatgtgctgcagaggcacaccctgcctgtggtgtgcacctgcagccctgcagatgtgcaggccgccttcagcaccatcgtgagccgcatccagcgctactgcaactgcaacagccagccccccacccctgtgaagattgctgtggccggggcccagcactacctgagcgccatcctgcggctgtttgtggagcagctgagccacaagaccccagactggctgggctacatgaggttcctggtgatccccctgggcagccaccctgtggcccgctacctgggctctgtggactaccgctacaacaacttcttccaggacctggcctggagggacctcttcaacaagctggaggcccagagcgctgtgcaggacaccccagacatcgtgagccgcatcacccagtacatcgccggggccaactgtgcccaccagctgcccatcgccgaggccatgctgacctacaagcagaagagcccagatgaggagagcagccagaagttcatcccctttgtgggcgtggtgaaggtgggcatcgtggagcccagcagcgccaccagcggggacagtgatgatgctgcccccagcggcagcggcaccctgagcagcaccccaccttctgccagccctgctgccaaggaggccagccccaccccacccagcagccccagcgtgtctgggggcctgagcagccccagccagggcgtgggcgctgagctgatgggcctgcaggtggactactggacagctgcccagcctgctgacaggaagagagatgctgagaagaaggacctgcctgtgaccaagaacaccctgaagtgcaccttccgcagcctgcaggtgtcccggctgcccagcagtggagaggccgccgccacccccaccatgtccatgacagtggtgaccaaggagaagaacaagaaggtgatgttcctgcccaagaaggccaaggacaaggatgtggagagcaagagccagtgcatcgagggcatcagccgcctcatctgcacagcccggcagcagcagaacatgctgcgggtgctgattgatggagtggagtgcagtgatgtgaagttcttccagctggccgcccagtggagcagccacgtgaagcacttccccatctgcatcttcggccacagcaaggccaccttctag

SEQ ID NO: 36835 - DNA, 2682 bp, Artificial Sequence
  Description of Artificial Sequence: Synthetic coding sequence
atggccgagcggggccgcctgggcctgcccggggcccctggggccctgaacacccctgtgcccatgaacctgtttgccacctgggaggtggatggcagcagccccagctgtgtgccccggctgtgcagcctgaccctgaagaagctggtggtgttcaaggagctggagaaggagctgatctctgtggtgattgctgtgaagatgcagggcagcaagaggatcctgcggagccatgagatcgtgctgcccccatctggccaggtggagacagacctggccctgaccttcagcctgcagtacccccacttcctgaagcgggagggcaacaagctgcagatcatgctgcagaggaggaagcgctacaagaacagaaccatcctgggctacaagaccctggccgccggcagcatctccatggccgaggtgatgcagcaccccagcgagggcggccaggtgctgagcctgtgcagcagcatcaaggaggcccctgtgaaggctgctgagatctggatcgccagcctgagcagccagcccatcgaccacgaggacagcaccatgcaggccggccccaaggccaagagcacagacaactacagcgaggaggagtatgagagcttcagcagcgagcaggaggccagtgatgatgctgtgcagggccaggacctggatgaagatgactttgatgtgggcaagcccaagaagcagaggaggagcatcgtgaggaccacctccatgacccggcagcagaacttcaagcagaaggtggtggccctgctgcggcgcttcaaggtgtctgatgaggtgctggacagcgagcaggaccctgctgagcacatccctgaggccgaggaggacctggacctgctgtatgacaccctggacatggagcaccccagcgacagcggccctgacatggaggatgatgacagcgtgctgagcacccccaagcccaagctgcggccctactttgagggcctgagccacagcagcagccagacagaaattggcagcatccacagcgcccggagccacaaggagccccccagccctgcagatgtgcctgagaagaccaggagcctgggcggccggcagcccagcgacagcgtgtctgacacagtggccctgggcgtgcccggcccccgggagcaccctggccagcctgaggacagccctgaggccgaggccagcaccctggatgtgttcacagagcggctgccccccagcggccgcatcaccaagacagagagcctggtgatccccagcaccaggtctgagggcaagcaggccggcagaagaggccgcagcaccagcctgaaggagcggcaggccgcccggccccagaatgaaagagccaacagcctggacaatgaacgctgcccagatgcccggagccagctgcaggtgcagctgcagatccccaggaagacagtgtatgaccagctgaaccacatcctgatcagtgatgaccagctgcctgagaacatcatcctggtgaacaccagtgactggcagggccagttcctgagtgatgtgctgcagaggcacaccctgcctgtggtgtgcacctgcagccctgcagatgtgcaggccgccttcagcaccatcgtgagccgcatccagcgctactgcaactgcaacagccagccccccacccctgtgaagattgctgtggccggggcccagcactacctgagcgccatcctgcggctgtttgtggagcagctgagccacaagaccccagactggctgggctacatgaggttcctggtgatccccctgggcagccaccctgtggcccgctacctgggctctgtggactaccgctacaacaacttcttccaggacctggcctggagggacctcttcaacaagctggaggcccagagcgctgtgcaggacaccccagacatcgtgagccgcatcacccagtacatcgccggggccaactgtgcccaccagctgcccatcgccgaggccatgctgacctacaagcagaagagcccagatgaggagagcagccagaagttcatcccctttgtgggcgtggtgaaggtgggcatcgtggagcccagcagcgccaccagcggggacagtgatgatgctgcccccagcggcagcggcaccctgagcagcaccccaccttctgccagccctgctgccaaggaggccagccccaccccacccagcagccccagcgtgtctgggggcctgagcagccccagccagggcgtgggcgctgagctgatgggcctgcaggtggactactggacagctgcccagcctgctgacaggaagagagatgctgagaagaaggacctgcctgtgaccaagaacaccctgaagtgcaccttccgcagcctgcaggtgtcccggctgcccagcagtggagaggccgccgccacccccaccatgtccatgacagtggtgaccaaggagaagaacaagaaggtgatgttcctgcccaagaaggccaaggacaaggatgtggagagcaagagccagtgcatcgagggcatcagccgcctcatctgcacagcccggcagcagcagaacatgctgcgggtgctgattgatggagtggagtgcagtgatgtgaagttcttccagctggccgcccagtggagcagccacgtgaagcacttccccatctgcatcttcggccacagcaaggccaccttctag

SEQ ID NO: 36836 - DNA, 2715 bp, Artificial Sequence
  Description of Artificial Sequence: Synthetic coding sequence
atggccgagcggggccgcctgggcctgcccggggcccctggggccctgaacacccctgtgcccatgaacctgtttgccacctgggaggtggatggcagcagccccagctgtgtgccccggctgtgcagcctgaccctgaagaagctggtggtgttcaaggagctggagaaggagctgatctctgtggtgattgctgtgaagatgcagggcagcaagaggatcctgcggagccatgagatcgtgctgcccccatctggccaggtggagacagacctggccctgaccttcagcctgcagtacccccacttcctgaagcgggagggcaacaagctgcagatcatgctgcagaggaggaagcgctacaagaacagaaccatcctgggctacaagaccctggccgccggcagcatctccatggccgaggtgatgcagcaccccagcgagggcggccaggtgctgagcctgtgcagcagcatcaaggaggcccctgtgaaggctgctgagatctggatcgccagcctgagcagccagcccatcgaccacgaggacagcaccatgcaggccggccccaaggccaagagcacagacaactacagcgaggaggagtatgagagcttcagcagcgagcaggaggccagtgatgatgctgtgcagggccaggacctggatgaagatgactttgatgtgggcaagcccaagaagcagaggaggagcatcgtgaggaccacctccatgacccggcagcagaacttcaagcagaaggtggtggccctgctgcggcgcttcaaggtgtctgatgaggtgctggacagcgagcaggaccctgctgagcacatccctgaggccgaggaggacctggacctgctgtatgacaccctggacatggagcaccccagcgacagcggccctgacatggaggatgatgacagcgtgctgagcacccccaagcccaagctgcggccctactttgagggcctgagccacagcagcagccagacagaaattggcagcatccacagcgcccggagccacaaggagccccccagccctgcagatgtgcctgagaagaccaggagcctgggcggccggcagcccagcgacagcgtgtctgacacagtggccctgggcgtgcccggcccccgggagcaccctggccagcctgaggacagccctgaggccgaggccagcaccctggatgtgttcacagagcggctgccccccagcggccgcatcaccaagacagagagcctggtgatccccagcaccaggtctgagggcaagcaggccggcagaagaggccgcagcaccagcctgaaggagcggcaggccgcccggccccagaatgaaagagccaacagcctggacaatgaacgctgcccagatgcccggagccagctgcaggtgcagctgcagatccccaggaagacagtgtatgaccagctgaaccacatcctgatcagtgatgaccagctgcctgagaacatcatcctggtgaacaccagtgactggcagggccagttcctgagtgatgtgctgcagaggcacaccctgcctgtggtgtgcacctgcagccctgcagatgtgcaggccgccttcagcaccatcgtgagccgcatccagcgctactgcaactgcaacagccagccccccacccctgtgaagattgctgtggccggggcccagcactacctgagcgccatcctgcggctgtttgtggagcagctgagccacaagaccccagactggctgggctacatgaggttcctggtgatccccctgggcagccaccctgtggcccgctacctgggctctgtggactaccgctacaacaacttcttccaggacctggcctggagggacctcttcaacaagctggaggcccagagcgctgtgcaggacaccccagacatcgtgagccgcatcacccagtacatcgccggggccaactgtgcccaccagctgcccatcgccgaggccatgctgacctacaagcagaagaggaagaagcacttccactttgacttcaccctgagcccagatgaggagagcagccagaagttcatcccctttgtgggcgtggtgaaggtgggcatcgtggagcccagcagcgccaccagcggggacagtgatgatgctgcccccagcggcagcggcaccctgagcagcaccccacccagcgccagccctgctgccaaggaggccagccccaccccacccagcagccccagcgtgtctgggggcctgagcagccccagccagggcgtgggcgctgagctgatgggcctgcaggtggactactggacagctgcccagcctgctgacaggaagagagatgctgagaagaaggacctgcctgtgaccaagaacaccctgaagtgcaccttccgcagcctgcaggtgtcccggctgcccagcagcggggaggccgccgccacccccaccatgtccatgacagtggtgaccaaggagaagaacaagaaggtgatgttcctgcccaagaaggccaaggacaaggatgtggagagcaagagccagtgcatcgagggcatcagccgcctcatctgcacagcccggcagcagcagaacatgctgcgggtgctgattgatggagtggagtgcagtgatgtgaagttcttccagctggccgcccagtggagcagccacgtgaagcacttccccatctgcatcttcggccacagcaaggccaccttctag

SEQ ID NO: 36837 - DNA, 768 bp, Artificial Sequence
  Description of Artificial Sequence: Synthetic coding sequence
atggccttccggcaggccctgcagctggccgcctgtggcctggccggcggcagcgctgctgtgctcttctctgctgtggccgtgggcaagcccagggctggaggagatgctgagcccaggcctgctgagcccccagcctgggccggcggggcccggcccggccctggggtgtgggaccccaactgggaccggcgggagcccctgagcctcatcaacgtgaggaagagaaatgtggagagcggggaggaggagctggccagcaagctggaccactacaaggccaaggccaccaggcacatcttcctgatccgccacagccagtaccacgtggatggcagcctggagaaggacaggaccctgacccccctgggccgggagcaggccgagctgaccggcctgcggctggccagcctgggcctgaagttcaacaagatcgtgcacagctccatgacccgggccatcgagaccacagacatcatcagccgccacctgcccggggtgtgcaaggtgtccacagacctgctgcgggagggcgcccccattgaaccagacccccctgtgagccactggaagccagaggccgtgcagtactatgaagatggagcccgcatcgaggccgccttcaggaactacatccacagagcagatgcccggcaggaggaggacagctatgagatcttcatctgccacgccaacgtcatccgctacatcgtgtgcagcatcccccccctgctgtctgctggggactttgtgctgctgggcagctag

SEQ ID NO: 36838 - DNA, 870 bp, Artificial Sequence
  Description of Artificial Sequence: Synthetic coding sequence
atggccttccggcaggccctgcagctggccgcctgtggcctggccggcggcagcgctgctgtgctcttctctgctgtggccgtgggcaagcccagggctggaggagatgctgagcccaggcctgctgagcccccagcctgggccggcggggcccggcccggccctggggtgtgggaccccaactgggaccggcgggagcccctgagcctcatcaacgtgaggaagagaaatgtggagagcggggaggaggagctggccagcaagctggaccactacaaggccaaggccaccaggcacatcttcctgatccgccacagccagtaccacgtggatggcagcctggagaaggacaggaccctgacccccctgggccgggagcaggccgagctgaccggcctgcggctggccagcctgggcctgaagttcaacaagatcgtgcacagctccatgacccgggccatcgagaccacagacatcatcagccgccacctgcccggggtgtgcaaggtgtccacagacctgctgcgggagggcgcccccattgaaccagacccccctgtgagccactggaagccagaggccgtgcagtactatgaagatggagcccgcatcgaggccgccttcaggaactacatccacagagcagatgcccggcaggaggaggacagctatgagatcttcatctgccacgccaacgtcatccgctacatcgtgtgccgggccctgcagtttcctcctgagggctggctgcggctgagcctgaacaacggcagcatcacccacctggtgatccggcccaacggccgggtggccctgcggaccctgggggacaccggcttcatgcccccagacaagatcaccaggagctag

SEQ ID NO: 36839 - DNA, 2418 bp, Artificial Sequence
  Description of Artificial Sequence: Synthetic coding sequence
atggccgccagcggcgtgccccggggctgtgacatcctgattgtgtacagcccagatgctgaggagtggtgccagtacctgcagaccctcttcctgagcagccggcaggtgcgcagccagaagatcctgacccaccggctgggccctgaggccagcttctctgctgaggacctgagcctcttcctgagcacccgctgtgtggtggtgctgctgtctgctgagctggtgcagcacttccacaagccagccctgctgcccctgctgcagagggccttccaccccccccaccgggtggtgcggctgctgtgtggggtgcgggacagcgaggagttcctggacttcttcccagactgggcccactggcaggagctgacctgtgatgatgagcctgagacctacgtggccgctgtgaagaaggccatcagtgaagattctggctgtgacagcgtgacagacacagagccagaagatgagaaggtggtgtcctacagcaagcagcagaacctgcccaccgtgaccagccctggcaacctgatggtggtgcagcctgaccgcatccgctgtggggctgagaccaccgtgtatgtgattgtgcgctgcaagctggatgacagagtggccacagaggccgagttctccccagaggacagccccagcgtgaggatggaggccaaggtggagaatgagtacaccatctctgtgaaggcccccaacctgagcagtggaaatgtgtccctgaagatctacagcggggacctggtggtgtgtgagaccgtcatctcctactacacagacatggaggagatcggcaacctgctgagcaatgctgccaaccctgtggagttcatgtgccaggccttcaagatcgtgccctacaacacagagaccctggacaagctgctgacagagagcctgaagaacaacatcccagccagcggcctgcacctgtttggcatcaaccagctggaggaggaggacatgatgaccaaccagagagatgaggagctgcccaccctgctgcactttgctgccaagtatggcctgaagaacctgacagccctgctgctgacctgccctggggccctgcaggcctacagcgtggccaacaagcacggccactaccccaacaccatcgccgagaagcacggcttccgggacctgcggcagttcattgatgaatatgtggagaccgtggacatgctgaagagccacatcaaggaggagctgatgcatggagaggaggctgatgctgtgtatgaatccatggcccacctgagcacagacctgctgatgaagtgcagcctgaaccctggctgtgatgaggacctgtatgagagcatggccgcctttgtgcctgctgccacagaggacctgtatgtggagatgctgcaggccagcaccagcaaccccatccctggagatggcttcagccgggccaccaaggacagcatgatcaggaagttcctggagggcaacagcatgggcatgaccaacctggagcgggaccagtgccacctgggccaggaggaggatgtgtaccacacagtggatgatgatgaggccttctctgtggacctggccagccggccccctgtgcctgtgcccaggcctgagaccacagcccctggggcccaccagctgcctgacaatgagccctacatcttcaaggtgtttgctgagaagagccaggagcggcccggcaacttctacgtgtcctctgagagcatcaggaagggcccccctgtgcggccctggagggaccggccccagagcagcatctatgacccctttgctggcatgaagaccccaggccagaggcagctgatcaccctgcaggagcaggtgaagctgggcatcgtgaatgtggatgaagctgtgctgcacttcaaggagtggcagctgaaccagaagaagaggtctgagagcttccgcttccagcaggagaacctgaagaggctgcgggacagcatcacccggcggcagcgggagaagcagaagagcggcaagcagacagacctggagatcaccgtgcccatccgccacagccagcacctgcctgccaaggtggagtttggagtgtatgagagcggccccaggaagagcgtcatcccccccaggacagagctgcggcggggggactggaagacagacagcaccagcagcacagccagcagcaccagcaacagaagcagcaccaggagcctgctgtctgtgagcagcggcatggagggggacaatgaagataatgaggtgcctgaggtgaccaggagccgcagccctggccccccccaggtggatggcacccccaccatgagcctggagcggcccccccgggtgccccccagggctgccagccagaggcctcccacccgggagaccttccaccccccacctcctgtgcccccccggggccgctag

SEQ ID NO: 36840 - DNA, 1215 bp, Artificial Sequence
  Description of Artificial Sequence: Synthetic coding sequence
atgaggttcttcacctctgtggcctgctacggcagctgcctgtttgccagcgagctgctgatccgctgcaaggactggctgaagggccgcccagccctcttcaccgccctgctggcctgtgtgctgtacctgtgtgagtggacaggagccaagcacgtgcccggcagcagctatgtggagatgctgcaggccagcaccagcaaccccatccctggagatggcttcagccgggccaccaaggacagcatgatcaggaagttcctggagggcaacagcatgggcatgaccaacctggagcgggaccagtgccacctgggccaggaggaggatgtgtaccacacagtggatgatgatgaggccttctctgtggacctggccagcaggcctcctgtgcctgtgcccaggcctgagaccacagcccctggggcccaccagctgcctgacaatgagccctacatcttcaaggtgtttgctgagaagagccaggagaggcctggcaacttctacgtgagcagcgagagcatcagaaaaggacctcctgtgcggccctggagggaccggccccagagcagcatctatgacccctttgctggcatgaagaccccaggccagaggcagctgatcaccctgcaggagcaggtgaagctgggcatcgtgaatgtggatgaggccgtgctgcacttcaaggagtggcagctgaaccagaagaagaggtctgagagcttccgcttccagcaggagaacctgaagaggctgcgggacagcatcacccggcggcagcgggagaagcagaagagcggcaagcagacagacctggagatcaccgtgcccatccgccacagccagcacctgcctgccaaggtggagtttggagtgtatgaaagtggccccaggaagagcgtcatcccccccaggacagagctgcggcggggggactggaagacagacagcaccagcagcacagccagcagcaccagcaacagaagcagcaccaggagcctgctgtctgtgagcagcggcatggagggggacaatgaagataatgaggtgcctgaggtgaccaggagccgcagccctggccccccccaggtggatggcacccccaccatgagcctggagaggcctccccgggtgcccccccgggccgccagccagaggcctcccacccgggagaccttccaccccccacctcctgtgcccccccggggccgctag

SEQ ID NO: 36841 - DNA, 1884 bp, Artificial Sequence
  Description of Artificial Sequence: Synthetic coding sequence
atggtggtgcagcctgaccgcatccgctgtggggctgagaccaccgtgtatgtgattgtgcgctgcaagctggatgacagagtggccacagaggccgagttctccccagaggacagccccagcgtgaggatggaggccaaggtggagaatgagtacaccatctctgtgaaggcccccaacctgagcagtggaaatgtgtccctgaagatctacagcggggacctggtggtgtgtgagaccgtcatctcctactacacagacatggaggagatcggcaacctgctgagcaatgctgccaaccctgtggagttcatgtgccaggccttcaagatcgtgccctacaacacagagaccctggacaagctgctgacagagagcctgaagaacaacatcccagccagcggcctgcacctgtttggcatcaaccagctggaggaggaggacatgatgaccaaccagagagatgaggagctgcccaccctgctgcactttgctgccaagtatggcctgaagaacctgacagccctgctgctgacctgccctggggccctgcaggcctacagcgtggccaacaagcacggccactaccccaacaccatcgccgagaagcacggcttccgggacctgcggcagttcattgatgaatatgtggagaccgtggacatgctgaagagccacatcaaggaggagctgatgcatggagaggaggctgatgctgtgtatgaatccatggcccacctgagcacagacctgctgatgaagtgcagcctgaaccctggctgtgatgaggacctgtatgagagcatggccgcctttgtgcctgctgccacagaggacctgtatgtggagatgctgcaggccagcaccagcaaccccatccctggagatggcttcagccgggccaccaaggacagcatgatcaggaagttcctggagggcaacagcatgggcatgaccaacctggagcgggaccagtgccacctgggccaggaggaggatgtgtaccacacagtggatgatgatgaggccttctctgtggacctggccagccggccccctgtgcctgtgcccaggcctgagaccacagcccctggggcccaccagctgcctgacaatgagccctacatcttcaaggtgtttgctgagaagagccaggagcggcccggcaacttctacgtgtcctctgagagcatcaggaagggcccccctgtgcggccctggagggaccggccccagagcagcatctatgacccctttgctggcatgaagaccccaggccagaggcagctgatcaccctgcaggagcaggtgaagctgggcatcgtgaatgtggatgaagctgtgctgcacttcaaggagtggcagctgaaccagaagaagaggtctgagagcttccgcttccagcaggagaacctgaagaggctgcgggacagcatcacccggcggcagcgggagaagcagaagagcggcaagcagacagacctggagatcaccgtgcccatccgccacagccagcacctgcctgccaaggtggagtttggagtgtatgagagcggccccaggaagagcgtcatcccccccaggacagagctgcggcggggggactggaagacagacagcaccagcagcacagccagcagcaccagcaacagaagcagcaccaggagcctgctgtctgtgagcagcggcatggagggggacaatgaagataatgaggtgcctgaggtgaccaggagccgcagccctggccccccccaggtggatggcacccccaccatgagcctggagcggcccccccgggtgccccccagggctgccagccagaggcctcccacccgggagaccttccaccccccacctcctgtgcccccccggggccgctag

SEQ ID NO: 36842 - DNA, 408 bp, Artificial Sequence
  Description of Artificial Sequence: Synthetic coding sequence
atggcctgtggcctggtggccagcaacctgaacctgaagccaggagagtgcctgcgggtgcggggggaggtggccccagatgccaagagctttgtgctgaacctgggcaaggacagcaacaacctgtgcctgcacttcaacccccgcttcaatgcccatggagatgccaacaccatcgtgtgcaacagcaaggatggaggagcctggggcacagagcagcgggaggccgtgttccccttccagcccggctctgtggccgaggtgtgcatcacctttgaccaggccaacctgactgtgaagctgcctgatggctatgagttcaagttccccaaccggctgaacctggaggccatcaactacatggctgctgatggagacttcaagatcaagtgtgtggcctttgattag

SEQ ID NO: 36843 - DNA, 705 bp, Artificial Sequence
  Description of Artificial Sequence: Synthetic coding sequence
atgctgctggcctgggtgcaggccttcctggtgagcaacatgctgctggccgaggcctacggcagcggcggctgcttctgggacaatggccacctgtaccgggaggaccagaccagccctgcccctggcctgcgctgcctgaactggctggatgcccagagcggcctggccagcgcccctgtgtctggggccggcaaccacagctactgcagaaatccagatgaggacccccggggcccctggtgctacgtgtctggagaggccggcgtgcctgagaagaggccctgtgaggacctgcgctgcccagagaccaccagccaggccctgcctgccttcaccacagagatccaggaggccagcgagggccctggagcagatgaggtgcaggtgtttgccccagccaatgccctgcctgcccggtctgaggccgctgctgtgcagcccgtcatcggcatcagccagagggtgaggatgaacagcaaggagaagaaggacctgggcaccctgggctacgtgctgggcatcaccatgatggtgatcatcatcgccatcggggccggcatcatcctgggctacagctacaagaggtctgtggccagcctgctgggccccctgcggaggagaggaggccgctacaccaagagcaactttgtggccttcctgcccaagaggaagcaggatgtggagaaccagctgaagatgtag

SEQ ID NO: 36844 - DNA, 726 bp, Artificial Sequence
  Description of Artificial Sequence: Synthetic coding sequence
atgctgctggcctgggtgcaggccttcctggtgagcaacatgctgctggccgaggcctacggcagcggcggctgcttctgggacaatggccacctgtaccgggaggaccagaccagccctgcccctggcctgcgctgcctgaactggctggatgcccagagcggcctggccagcgcccctgtgtctggggccggcaaccacagctactgcagaaatcctggagaggacctgcgctgcccagagaccaccagccaggccctgcctgccttcaccacagagatccaggaggccagcgagggccctggagcagatgaggtgcaggtgtttgccccagccaatgccctgcctgcccggtctgaggccgctgctgtgcagcccgtcatcggcatcagccagagggtgaggatgaacagcaaggagaagaaggacctgggcaccctgggctacgtgctgggcatcaccatgatggtgatcatcatcgccatcggggccggcatcatcctgggctacagctacaagaggggcaaggacctgaaggagcagcacgaccagaaggtgtgtgagcgggagatgcagaggatcaccctgcccctgagcgccttcaccaaccccacctgtgagatcgtggatgagaagacagtggtggtgcacaccagccagacccctgtggacccccaggagggcaccacccccctgatgggccaggccggcacccctggggcctag

SEQ ID NO: 36845 - DNA, 522 bp, Artificial Sequence
  Description of Artificial Sequence: Synthetic coding sequence
atgctgctggcctgggtgcaggccttcctggtgagcaacatgctgctggccgaggcctacggcagcggcggctgcttctgggacaatggccacctgtaccgggaggaccagaccagccctgcccctggcctgcgctgcctgaactggctggatgcccagagcggcctggccagcgcccctgtgtctggggccggcaaccacagctactgcagaaatccagatgaggacccccggggcccctggtgctacgtgtctggagaggccggcgtgcctgagaagaggccctgtgaggacctgcgctgcccagagaccaccagccaggccctgcctgccttcaccacagagatccaggaggccagcgagggccctggagcagatgaggtgcaggtgtttgccccagccaatgccctgcctgcccggtctgaggccgctgctgtgcagcccgtcatcggcatcagccagagggtgaggatgaacagcaaggagaagaaggacctgggcaccctgggcggccgcatctag

SEQ ID NO: 36846 - DNA, 555 bp, Artificial Sequence
  Description of Artificial Sequence: Synthetic coding sequence
atgctgctggcctgggtgcaggccttcctggtgagcaacatgctgctggccgaggcctacggcagcggggagaccaccagccaggccctgcctgccttcaccacagagatccaggaggccagcgagggccctggagcagatgaggtgcaggtgtttgccccagccaatgccctgcctgcccggtctgaggccgctgctgtgcagcctgtgattggcatcagccagagggtgaggatgaacagcaaggagaagaaggacctgggcaccctgggctacgtgctgggcatcaccatgatggtgatcatcatcgccatcggggccggcatcatcctgggctacagctacaagaggggcaaggacctgaaggagcagcacgaccagaaggtgtgtgagcgggagatgcagaggatcaccctgcccctgagcgccttcaccaaccccacctgtgaaattgtggatgagaagacagtggtggtgcacaccagccagacccctgtggacccccaggagggcaccacccccctgatgggccaggccggcacccctggggcctag

SEQ ID NO: 36847 - DNA, 2538 bp, Artificial Sequence
  Description of Artificial Sequence: Synthetic coding sequence
cagtttgtgcagcctgaggagcggcggcagggcagcctgctgggccctggcctgcccagccacgccctgggcaccctggccaaggtggccggccggcaggatgctgcccctcctgggggcagcgctgccagcgaggagcgggaggagggccccagcgtggaggccctggccgtgtccaaggctgactgctacgtgcagctgtggctgcccacagccagccccagccctgcccagaccagaattgtggccaactgcagcgaccctgagtggaatgagaccttccactaccagatccatggagctgtgaagaatgtgctggagctgaccctgtatgacaaggacatcctgggcagtgaccagctgagcctgctgctgtttgacctgcggagcctgaagtgtggccagccccacaagcacaccttccccctgaaccaccaggacagccaggagctgcaggtggagtttgtgctggagaagagccaggtgcctgccagcgaggtgatcaccaacggggtgctggtggcccacccctgcctgcgcatccagggcaccctgcggggagatggaacagccccccgggaggagtatggcagccggcagctgcagctggccgtgcctggggcctatgagaagccccagctgctgcccctgcagcccccaacagagcccggcctgccccccaccttcaccttccacgtgaaccctgtgctgagcagccggctgcacgtggagctgatggagctgctggccgctgtgcagagcggccccagcgctgagctggaggcccagaccagcaagctgggggagggcggcatcctgctgagcagcctgcccctgggccaggaggagcagtgcagcgtggccctgggggagggccaggaggtggccctgtccatgaaggtggagatgagcagcggggacctggacctgcggctgggctttgacctgagtgatggagagcaggagttcctggacaggaggaagcaggtggtgtccaaggccctgcagcaggtgctgggcctgtctgaggccctggacagcggccaggtgcctgtggtggccgtgctgggcagcggcggcggcacccgggccatgagcagcctgtatggcagcctggccggcctgcaggagctgggcctgctggacacagtgacctacctgagcggcgtgtctggcagcacctggtgcatcagcaccctgtacagagatcctgcctggagccaggtggccctgcagggccccatcgagcgggcccaggtgcacgtgtgcagcagcaagatgggcgccctgagcacagagcggctgcagtactacacccaggagctgggcgtgcgggagaggagcggccacagcgtgtccctgattgacctgtggggcctgctggtggagtacctgctgtaccaggaggagaacccagccaagctgagtgaccagcaggaggccgtgcggcagggccagaacccctaccccatctacacctctgtgaatgtgaggaccaacctgagcggggaggactttgctgagtggtgtgagttcaccccctatgaggtgggcttccccaagtacggggcctacgtgcccacagagctgtttggaagtgagctgttcatgggccgcctgctgcagctgcagcctgagccccgcatctgctacctgcagggcatgtggggcagcgcctttgccaccagcctggatgagatcttcctgaagacagctggcagcggcctgtccttcctggagtggtaccggggctctgtgaacatcacagatgactgccagaagccccagctgcacaaccccagccggctgcggacccggctgctgaccccccagggccccttcagccaggccgtgctggacatcttcaccagccgcttcaccagcgcccagagcttcaacttcacccggggcctgtgcctgcacaaggactatgtggccggccgggagtttgtggcctggaaggacacccacccagatgccttccccaaccagctgacccccatgagggactgcctgtacctggtggatggcggctttgccatcaacagccccttccccctggccctgctgccccagagagctgtggacctgatcctgagctttgactacagcctggaggccccctttgaggtgctgaagatgacagagaagtactgcctggaccggggcatccccttccccagcattgaggtgggccctgaggacatggaggaggcccgggagtgctacctgtttgccaaggccgaggaccccaggagccccatcgtgctgcacttccccctggtgaacagaaccttccgcacccacctggcccctggggtggagcggcagacagctgaggagaaggccttcggggactttgtgatcaacagaccagacaccccctacggcatgatgaacttcacctatgagccccaggacttctaccgcctggtggccctgagccgctacaacgtgctgaacaacgtggagaccctgaagtgtgccctgcagctggccctggacagacaccaggcccgggagagagctggggcctag

SEQ ID NO: 36848 - DNA, 1365 bp, Artificial Sequence
  Description of Artificial Sequence: Synthetic coding sequence
atgctgtgggccctgtggccccgctggctggccgacaagatgctgcccctgctgggcgctgtgctgctgcagaagcgggagaagaggggccccctgtggaggcactggaggcgggagacctacccctactatgacctgcaggtgaaggtgctgcgggccaccaacatccggggcacagacctgctgagcaaggctgactgctacgtgcagctgtggctgcccacagccagccccagccctgcccagaccagaattgtggccaactgcagcgaccctgagtggaatgagaccttccactaccagatccatggagctgtgaagaatgtgctggagctgaccctgtatgacaaggacatcctgggcagtgaccagctgagcctgctgctgtttgacctgcggagcctgaagtgtggccagccccacaagcacaccttccccctgaaccaccaggacagccaggagctgcaggtggagtttgtgctggagaagagccaggtgcctgccagcgaggtgatcaccaacggggtgctggtggcccacccctgcctgcgcatccagggcaccctgcggggagatggaacagccccccgggaggagtatggcagccggcagctgcagctggccgtgcctggggcctatgagaagccccagctgctgcccctgcagcccccaacagagcccggcctgccccccaccttcaccttccacgtgaaccctgtgctgagcagccggctgcacgtggagctgatggagctgctggccgctgtgcagagcggccccagcgctgagctggaggcccagaccagcaagctgggggagggcggcatcctgctgagcagcctgcccctgggccaggaggagcagtgcagcgtggccctgggggagggccaggaggtggccctgtccatgaaggtggagatgagcagcggggacctggacctgcggctgggctttgacctgagtgatggagagcaggagttcctggacaggaggaagcaggtggtgtccaaggccctgcagcaggtgctgggcctgtctgaggccctggacagcggccaggtgcctgtggtggccgtgctgggcagcggcggcggcacccgggccatgagcagcctgtatggcagcctggccggcctgcaggagctgggcctgctggacacagtgacctacctgagcggcgtgtctggcagcacctggtgcatcagcaccctgtacagagatcctgcctggagccaggtggccctgcagggccccatcgagcgggcccaggtgcacgtgtgcagcagcaaggtgggagatgtgcgggtgagcccctgccagctgccccggctgcacagcagcaacctggaccacagcctgtggtag

SEQ ID NO: 36849 - DNA, 2550 bp, Artificial Sequence
  Description of Artificial Sequence: Synthetic coding sequence
atgctgtgggccctgtggccccgctggctggccgacaagatgctgcccctgctgggcgctgtgctgctgcagaagcgggagaagaggggccccctgtggaggcactggaggcgggagacctacccctactatgacctgcaggtgaaggtgctgcgggccaccaacatccggggcacagacctgctgagcaaggctgactgctacgtgcagctgtggctgcccacagccagccccagccctgcccagaccagaattgtggccaactgcagcgaccctgagtggaatgagaccttccactaccagatccatggagctgtgaagaatgtgctggagctgaccctgtatgacaaggacatcctgggcagtgaccagctgagcctgctgctgtttgacctgcggagcctgaagtgtggccagccccacaagcacaccttccccctgaaccaccaggacagccaggagctgcaggtggagtttgtgctggagaagagccaggtgcctgccagcgaggtgatcaccaacggggtgctggtggcccacccctgcctgcgcatccagggcaccctgcggggagatggaacagccccccgggaggagtatggcagccggcagctgcagctggccgtgcctggggcctatgagaagccccagctgctgcccctgcagcccccaacagagcccggcctgccccccaccttcaccttccacgtgaaccctgtgctgagcagccggctgcacgtggagctgatggagctgctggccgctgtgcagagcggccccagcgctgagctggaggcccagaccagcaagctgggggagggcggcatcctgctgagcagcctgcccctgggccaggaggagcagtgcagcgtggccctgggggagggccaggaggtggccctgtccatgaaggtggagatgagcagcggggacctggacctgcggctgggctttgacctgagtgatggagagcaggagttcctggacaggaggaagcaggtggtgtccaaggccctgcagcaggtgctgggcctgtctgaggccctggacagcggccaggtgcctgtggtggccgtgctgggcagcggcggcggcacccgggccatgagcagcctgtatggcagcctggccggcctgcaggagctgggcctgctggacacagtgacctacctgagcggcgtgtctggcagcacctggtgcatcagcaccctgtacagagatcctgcctggagccaggtggccctgcagggccccatcgagcgggcccaggtgcacgtgtgcagcagcaagatgggcgccctgagcacagagcggctgcagtactacacccaggagctgggcgtgcgggagaggagcggccacagcgtgtccctgattgacctgtggggcctgctggtggagtacctgctgtaccaggaggagaacccagccaagctgagtgaccagcaggaggccgtgcggcagggccagaacccctaccccatctacacctctgtgaatgtgaggaccaacctgagcggggaggactttgctgagtggtgtgagttcaccccctatgaggtgggcttccccaagtacggggcctacgtgcccacagagctgtttggaagtgagctgttcatgggccgcctgctgcagctgcagcctgagccccgcatctgctacctgcagggcatgtggggcagcgcctttgccaccagcctggatgagatcttcctgaagacagctggcagcggcctgtccttcctggagtggtaccggggctctgtgaacatcacagatgactgccagaagccccagctgcacaaccccagccggctgcggacccggctgctgaccccccagggccccttcagccaggccgtgctggacatcttcaccagccgcttcaccagcgcccagagcttcaacttcacccggggcctgtgcctgcacaaggactatgtggccggccgggagtttgtggcctggaaggacacccacccagatgccttccccaaccagctgacccccatgagggactgcctgtacctggtggatggcggctttgccatcaacagccccttccccctggccctgctgccccagagagctgtggacctgatcctgagctttgactacagcctggaggccccctttgaggtgctgaagatgacagagaagtactgcctggaccggggcatccccttccccagcattgaggtgggccctgaggacatggaggaggcccgggagtgctacctgtttgccaaggccgaggaccccaggagccccatcgtgctgcacttccccctggtgaacagaaccttccgcacccacctggcccctggggtggagcggcagacagctgaggagaaggccttcggggactttgtgatcaacagaccagacaccccctacggcatgatgaacttcacctatgagccccaggacttctaccgcctggtggccctgagccgctacaacgtgctgaacaacgtggagaccctgaagtgtgccctgcagctggccctggacagacaccaggcccgggagagagctggggcctag

SEQ ID NO: 36850 - DNA, 2556 bp, Artificial Sequence
  Description of Artificial Sequence: Synthetic coding sequence
atgctgtgggccctgtggccccgctggctggccgacaagatgctgcccctgctgggcgctgtgctgctgcagaagcgggagaagaggggccccctgtggaggcactggaggcgggagacctacccctactatgacctgcaggtgaaggtgctgcgggccaccaacatccggggcacagacctgctgagcaaggctgactgctacgtgcagctgtggctgcccacagccagccccagccctgcccagaccagaattgtggccaactgcagcgaccctgagtggaatgagaccttccactaccagatccatggagctgtgaagaatgtgctggagctgaccctgtatgacaaggacatcctgggcagtgaccagctgagcctgctgctgtttgacctgcggagcctgaagtgtggccagccccacaagcacaccttccccctgaaccaccaggacagccaggagctgcaggtggagtttgtgctggagaagagccaggtgcctgccagcgaggtgatcaccaacggggtgctggtggcccacccctgcctgcgcatccagggcaccctgcggggagatggaacagccccccgggaggagtatggcagccggcagctgcagctggccgtgcctggggcctatgagaagccccagctgctgcccctgcagcccccaacagagcccggcctgccccccaccttcaccttccacgtgaaccctgtgctgagcagccggctgcacgtggagctgatggagctgctggccgctgtgcagagcggccccagcgctgagctggaggcccagaccagcaagctgggggagggcggcatcctgctgagcagcctgcccctgggccaggaggagcagtgcagcgtggccctgggggagggccaggaggtggccctgtccatgaaggtggagatgagcagcggggacctggacctgcggctgggctttgacctgagtgatggagagcaggagttcctggacaggaggaagcaggtggtgtccaaggccctgcagcaggtgctgggcctgtctgaggccctggacagcggccagacccaggtgcctgtggtggccgtgctgggcagcggcggcggcacccgggccatgagcagcctgtatggcagcctggccggcctgcaggagctgggcctgctggacacagtgacctacctgagcggcgtgtctggcagcacctggtgcatcagcaccctgtacagagatcctgcctggagccaggtggccctgcagggccccatcgagcgggcccaggtgcacgtgtgcagcagcaagatgggcgccctgagcacagagcggctgcagtactacacccaggagctgggcgtgcgggagaggagcggccacagcgtgtccctgattgacctgtggggcctgctggtggagtacctgctgtaccaggaggagaacccagccaagctgagtgaccagcaggaggccgtgcggcagggccagaacccctaccccatctacacctctgtgaatgtgaggaccaacctgagcggggaggactttgctgagtggtgtgagttcaccccctatgaggtgggcttccccaagtacggggcctacgtgcccacagagctgtttggaagtgagctgttcatgggccgcctgctgcagctgcagcctgagccccgcatctgctacctgcagggcatgtggggcagcgcctttgccaccagcctggatgagatcttcctgaagacagctggcagcggcctgtccttcctggagtggtaccggggctctgtgaacatcacagatgactgccagaagccccagctgcacaaccccagccggctgcggacccggctgctgaccccccagggccccttcagccaggccgtgctggacatcttcaccagccgcttcaccagcgcccagagcttcaacttcacccggggcctgtgcctgcacaaggactatgtggccggccgggagtttgtggcctggaaggacacccacccagatgccttccccaaccagctgacccccatgagggactgcctgtacctggtggatggcggctttgccatcaacagccccttccccctggccctgctgccccagagagctgtggacctgatcctgagctttgactacagcctggaggccccctttgaggtgctgaagatgacagagaagtactgcctggaccggggcatccccttccccagcattgaggtgggccctgaggacatggaggaggcccgggagtgctacctgtttgccaaggccgaggaccccaggagccccatcgtgctgcacttccccctggtgaacagaaccttccgcacccacctggcccctggggtggagcggcagacagctgaggagaaggccttcggggactttgtgatcaacagaccagacaccccctacggcatgatgaacttcacctatgagccccaggacttctaccgcctggtggccctgagccgctacaacgtgctgaacaacgtggagaccctgaagtgtgccctgcagctggccctggacagacaccaggcccgggagagagctggggcctag

SEQ ID NO: 36851 - DNA, 2598 bp, Artificial Sequence
  Description of Artificial Sequence: Synthetic coding sequence
atgctgtgggccctgtggccccgctggctggccgacaagatgctgcccctgctgggcgctgtgctgctgcagaagcgggagaagaggggccccctgtggaggcactggaggcgggagacctacccctactatgacctgcaggtgaaggtgctgcgggccaccaacatccggggcacagacctgctgagcaaggctgactgctacgtgcagctgtggctgcccacagccagccccagccctgcccagaccagaattgtggccaactgcagcgaccctgagtggaatgagaccttccactaccagatccatggagctgtgaagaatgtgctggagctgaccctgtatgacaaggacatcctgggcagtgaccagctgagcctgctgctgtttgacctgcggagcctgaagtgtggccagccccacaagcacaccttccccctgaaccaccaggacagccaggagctgcaggtggagtttgtgctggagaagagccaggtgcctgccagcgaggtgatcaccaacggggtgctggtggcccacccctgcctgcgcatccagggcaccctgcggggagatggaacagccccccgggaggagtatggcagccggcagctgcagctggccgtgcctggggcctatgagaagccccagctgctgcccctgcagcccccaacagagcccggcctgccccccaccttcaccttccacgtgaaccctgtgctgagcagccggctgcacgtggagctgatggagctgctggccgctgtgcagagcggccccagcgctgagctggaggcccagaccagcaagctgggggagggcggcatcctgctgagcagcctgcccctgggccaggaggagcagtgcagcgtggccctgggggagggccaggaggtggccctgtccatgaaggtggagatgagcagcggggacctggacctgcggctgggctttgacctgagtgatggagagcaggagttcctggacaggaggaagcaggtggtgtccaaggccctgcagcaggtgctgggcctgtctgaggccctggacagcggccaggtgcctgtggtggccgtgctgggcagcggcggcggcacccgggccatgagcagcctgtatggcagcctggccggcctgcaggagctgggcctgctggacacagtgacctacctgagcggcgtgtctggcagcacctggtgcatcagcaccctgtacagagatcctgcctggagccaggtggccctgcagggccccatcgagcgggcccaggtgcacgtgtgcagcagcaagatgggcgccctgagcacagagcggctgcagtactacacccaggagctgggcgtgcgggagaggagcggccacagcgtgtccctgattgacctgtggggcctgctggtggagtacctgctgtaccaggaggagaacccagccaagctgagtgaccagcaggaggccgtgcggcagggccagaacccctaccccatctacacctctgtgaatgtgaggaccaacctgagcggggaggactttgctgagtggtgtgagttcaccccctatgaggtgggcttccccaagtacggggcctacgtgcccacagagctgtttggaagtgagctgttcatgggccgcctgctgcagctgcagcctgagccccgcatctgctacctgcagggcatgtggggcagcgcctttgccaccagcctggatgagatcttcctgaagacagctggcagcggcctgtccttcctggagtggtaccggggctctgtgaacatcacagatgactgccagaagccccagctgcacaaccccagccggctgcggacccggctgctgaccccccagggccccttcagccaggccgtgctggacatcttcaccagccgcttcaccagcgcccagagcttcaacttcacccggggcctgtgcctgcacaaggactatgtggccggccgggagtttgtggcctggaaggacacccacccagatgccttccccaaccagctgacccccatgagggactgcctgtacctggtggatggcggctttgccatcaacagccccttccccctggccctgctgccccagagagctgtggacctgatcctgagctttgactacagcctggaggccccctttgaggtgctgaagatgacagagaagtactgcctggaccggggcatccccttccccagcattgaggtgggccctgaggacatggaggaggcccgggagtgctacctgtttgccaaggccgaggaccccaggagccccatcgtgctgcacttccccctggtgaacagaaccttccgcacccacctggcccctggggtggagcggcagacagctgaggagaaggccttcggggactttgtgatcaacagaccagacaccccctacggcatgatgaacttcacctatgagccccaggacttctaccgcctggtggccctgagccgctacaacgtgctgaacaacgtggagaccctgaagtgtgcccaccccaggcacaggaggaccagcgagggccccagcccccagacccacacagagcagggcctgcgggccctgcggagccagctgagcagcctgcactag

SEQ ID NO: 36852 - DNA, 1770 bp, Artificial Sequence
  Description of Artificial Sequence: Synthetic coding sequence
atggtgggccagatgtactgctacccaggcagccacctggcccgggccctgacccgggccctggccctggccctggtgctggccctgctggtgggccccttcctgagcggcctggccggggccatcccagcccctgggggccgctgggccagagatggccaggtgcccccagccagccgcagccgctctgtgctgctggatgtgtctgctggccagctgctgatggtggatggccgccacccagatgctgtggcctgggccaacctgaccaatgccatccgggagaccggctgggccttcctggagctgggcaccagcggccagtacaatgacagcctgcaggcctatgctgctggggtggtggaggccgctgtgtctgaggagctgatctacatgcactggatgaacacagtggtgaactactgcggcccctttgaatatgaggtgggctactgtgagcggctgaagagcttcctggaggccaacctggagtggatgcaggaggagatggagagcaacccagacagcccctactggcaccaggtgcggctgaccctgctgcagctgaagggcctggaggacagctatgagggccgggtgtccttccctgctgggaagttcaccatcaagcccctgggcttcctgctgctgcagctgagcggggacctggaggacctggagctggccctgaacaagaccaagatcaagcccagcctgggcagcggcagctgcagcgccctgatcaagctgctgcccggccagagcgacctgctggtggcccacaacacctggaacaactaccagcacatgctgcgggtcatcaagaagtactggctgcagttccgggagggcccctggggagactaccccctggtgcccggcaacaagctggtgttcagcagctacccaggcaccatcttcagctgtgatgacttctacatcctgggcagcggcctggtgaccctggagaccaccatcggcaacaagaacccagccctgtggaagtatgtgcggccccggggctgtgtgctggagtgggtgaggaacatcgtggccaaccggctggccagtgatggagccacctgggccgacatcttcaagcgcttcaacagcggcacctacaacaaccagtggatgattgtggactacaaggccttcatccctgggggccccagccctggcagccgggtgctgaccatcctggagcagatccctggcatggtggtggtggccgacaagaccagcgagctgtaccagaagacctactgggccagctacaacatccccagctttgaaacagtgttcaatgccagcggcctgcaggccctggtggcccagtatggagactggttctcctatgatggcagcccccgggcccagatcttcagaagaaaccagagcctggtgcaggacatggacagcatggtgcggctgatgagatacaatgacttcctgcatgaccccctgagcctgtgcaaggcctgcaacccccagcccaacggggagaatgccatcagcgcccggagtgacctgaacccagccaacggcagctaccccttccaggccctgcggcagaggagccacggcggcattgatgtgaaggtgacctccatgagcctggcccgcatcctgagcctgctggccgccagcggccccacctgggaccaggtgccccccttccagtggagcaccagccccttcagcggcctgctgcacatgggccagcctgacctgtggaagtttgcccctgtgaaggtgtcctgggactag

SEQ ID NO: 36853 - DNA, 1674 bp, Artificial Sequence
  Description of Artificial Sequence: Synthetic coding sequence
atggtgggccagatgtactgctacccaggcagccacctggcccgggccctgacccgggccctggccctggccctggtgctggccctgctggtgggccccttcctgagcggcctggccggggccatcccagcccctgggggccgctgggccagagatggccaggtgcccccagccagccgcagccgctctgtgctgctggatgtgtctgctggccagctgctgatggtggatggccgccacccagatgctgtggcctgggccaacctgaccaatgccatccgggagaccggctgggccttcctggagctgggcaccagcggccagtacaatgacagcctgcaggcctatgctgctggggtggtggaggccgctgtgtctgaggagctgatctacatgcactggatgaacacagtggtgaactactgcggcccctttgaatatgaggtgggctactgtgagcggctgaagagcttcctggaggccaacctggagtggatgcaggaggagatggagagcaacccagacagcccctactggcaccaggtgcggctgaccctgctgcagctgaagggcctggaggacagctatgagggccgggtgtccttccctgctgggaagttcaccatcaagcccctgggcttcctgctgctgcagctgagcggggacctggaggacctggagctggccctgaacaagaccaagatcaagcccagcctgggcagcggcagctgcagcgccctgatcaagctgctgcccggccagagcgacctgctggtggcccacaacacctggaacaactaccagcacatgctgcgggtcatcaagaagtactggctgcagttccgggagggcccctggggagactaccccctggtgcccggcaacaagctggtgttcagcagctacccaggcaccatcttcagctgtgatgacttctacatcctgggcagcggcctggtgaccctggagaccaccatcggcaacaagaacccagccctgtggaagtatgtgcggccccggggctgtgtgctggagtgggtgaggaacatcgtggccaaccggctggccagtgatggagccacctgggccgacatcttcaagcgcttcaacagcggcaccggcatggtggtggtggccgacaagaccagcgagctgtaccagaagacctactgggccagctacaacatccccagctttgaaacagtgttcaatgccagcggcctgcaggccctggtggcccagtatggagactggttctcctatgatggcagcccccgggcccagatcttcagaagaaaccagagcctggtgcaggacatggacagcatggtgcggctgatgagatacaatgacttcctgcatgaccccctgagcctgtgcaaggcctgcaacccccagcccaacggggagaatgccatcagcgcccggagtgacctgaacccagccaacggcagctaccccttccaggccctgcggcagaggagccacggcggcattgatgtgaaggtgacctccatgagcctggcccgcatcctgagcctgctggccgccagcggccccacctgggaccaggtgccccccttccagtggagcaccagccccttcagcggcctgctgcacatgggccagcctgacctgtggaagtttgcccctgtgaaggtgtcctgggactag

SEQ ID NO: 36854 - DNA, 1473 bp, Artificial Sequence
  Description of Artificial Sequence: Synthetic coding sequence
atgaagcccaagctgatgtaccaggagctgaaggtgcctgctgaggagcccgccaatgagctgcccatgaatgaaattgaggcctggaaggctgctgagaagaaggcccgctgggtgctgctggtgctgatcctggccgtggtgggctttggagccctgatgacccagctgttcctgtgggagtatggagacctgcacctgtttggccccaaccagaggcctgccccctgctatgacccctgtgaggccgtgctggtggagagcatccctgagggcctggacttccccaatgccagcacaggcaaccccagcaccagccaggcctggctgggcctgctggccggggcccacagcagcctggacatcgccagcttctactggaccctgaccaacaatgacacccacacccaggagcccagcgcccagcagggcgaggaggtgctgcggcagctgcagaccctggcccccaagggcgtgaatgtgagaattgctgtgtccaagcccagcggcccccagccccaggccgacctgcaggccctgctgcagagcggggcccaggtgaggatggtggacatgcagaagctgacccatggagtgctgcacaccaagttctgggtggtggaccagacccacttctacctgggcagcgccaacatggactggaggagcctgacccaggtgaaggagctgggcgtggtgatgtacaactgcagctgcctggcccgggacctgaccaagatctttgaggcctactggttcctgggccaggccggcagcagcatccccagcacctggccccgcttctatgacacccgctacaaccaggagacccccatggagatctgcctgaatggcaccccagccctggcctacctggccagcgcccccccacccctgtgccccagcggccgcaccccagacctgaaggccctgctgaatgtggtggacaatgcccggagcttcatctacgtggccgtgatgaactacctgcccaccctggagttcagccacccccaccgcttctggccagccattgatgatggcctgcggcgggccacctatgaaagaggagtgaaggtgcggctgctgatcagctgctggggccacagcgagcccagcatgagggccttcctgctgagcctggccgccctgcgggacaaccacacccacagcgacatccaggtgaagctgtttgtggtgcctgcagatgaggcccaggcccgcatcccctatgcccgggtgaaccacaacaagtacatggtgacagagcgggccacctacatcggcaccagcaactggagcggcaactacttcacagaaacagctggcaccagcctgctggtgacccagaatggccggggcggcctgcggagccagctggaggccatcttcctgcgggactgggacagcccctacagccatgacctggacaccagcgctgacagcgtgggcaatgcctgccgcctgctgtag

SEQ ID NO: 36855 - DNA, 534 bp, Artificial Sequence
  Description of Artificial Sequence: Synthetic coding sequence
atgaagcccaagctgatgtaccaggagctgaaggtgcctgctgaggagcccgccaatgagctgcccatgaatgaaattgaggcctggaaggctgctgagaagaaggcccgctgggtgctgctggtgctgatcctggccgtggtgggctttggagccctgatgacccagctgttcctgtgggagtatggagacctgcacctgtttggccccaaccagaggcctgccccctgctatgacccctgtgaggccgtgctggtggagagcatccctgagggcctggacttccccaatgccagcacaggcaaccccagcaccagccaggcctggctgggcctgctggccggggcccacagcagcctggacatcgccagcttctactggaccctgaccaacaatgacacccacacccaggagcccagcgcccagcagggcgaggaggtgctgcggcagctgcagaccctggcccccaagggcgtgaatgtgagaattgctgtgtccaagcccagcggcccccagccccaggccgacctgtag

SEQ ID NO: 36856 - DNA, 390 bp, Artificial Sequence
  Description of Artificial Sequence: Synthetic coding sequence
atgaagcccaagctgatgtaccaggagctgaaggtgcctgctgaggagcccgccaatgagctgcccatgaatgaaattgaggcctggaaggctgctgagaagaaggcccgctgggtgctgctggtgctgatcctggccgtggtgggctttggagccctgatgacccagctgttcctgtgggagtatggagacctgcacctgtttggccccaaccagaggcctgccccctgctatgacccctgtgaggccgtgctggtggagagcatccctgagggcctggacttccccaatgccagcacaggcaaccccagcaccagccaggcctggctgggcctgctggccggggcccacagcagcctggacatcgccagcttctactggaccctgtag

SEQ ID NO: 36857 - DNA, 1473 bp, Artificial Sequence; identical to SEQ ID NO: 36854
  Description of Artificial Sequence: Synthetic coding sequence

SEQ ID NO: 36858 - DNA, 1473 bp, Artificial Sequence; identical to SEQ ID NO: 36854
  Description of Artificial Sequence: Synthetic coding sequence

SEQ ID NO: 36859 - DNA, 1473 bp, Artificial Sequence; identical to SEQ ID NO: 36854
  Description of Artificial Sequence: Synthetic coding sequence

SEQ ID NO: 36860 - DNA, 1473 bp, Artificial Sequence; identical to SEQ ID NO: 36854
  Description of Artificial Sequence: Synthetic coding sequence

SEQ ID NO: 36861 - DNA, 1209 bp, Artificial Sequence
  Description of Artificial Sequence: Synthetic coding sequence
atgaagcccaagctgatgtaccaggagctgaaggtgcctgctgaggagcccgccaatgagctgcccatgaatgaaattgaggcctggaaggctgctgagaagaaggcccgctgggtgctgctggtgctgatcctggccgtggtgggctttggagccctgatgacccagctgttcctgtgggagtatggagacctgcacctgtttggccccaaccagaggcctgccccctgctatgacccctgtgaggccgtgctggtggagagcatccctgagggcctgctggccggggcccacagcagcctggacatcgccagcttctactggaccctgaccaacaatgacacccacacccaggagcccagcgcccagcagggcgaggaggtgctgcggcagctgcagaccctggcccccaagggcgtgaatgtgagaattgctgtgtccaagcccagcggcccccagccccaggccgacctgcaggccctgctgcagagcggggcccaggtgaggatggtggacatgcagaagctgacccacggcgtgctgcacaccaagttctgggtggtggaccagacccacttctacctgggcagcgccaacatggactggaggagcctgacccaggtgaaggagctgggcgtggtgatgtacaactgcagctgcctggcccgggacctgaccaagatctttgaggcctactggttcctgggccaggccggcagcagcatccccagcacctggccccgcttctatgacacccgctacaaccaggagacccccatggagatctgcctgaatggcaccccagccctggcctacctggccagcgcccccccacccctgtgccccagcggccgcaccccagacctgaaggccctgctgaatgtggtggacaatgcccgctccttcatctacgtggccgtgatgaactacctgcccaccctggagttcagccacccccaccgcttctggccagccattgatgatggcctgcggcgggccacctatgagcggggcgtgaaggtgcggctgctgatcagctgctggggccacagcgagcccagcatgagggccttcctgctgagcctggccgccctgcgggacaaccacacccacagcgacatccaggtgaagctgtttgtggtgcctgcagatgaggcccaggccctgagccctgccctgccccccctgcccccacctcctccagcctag

SEQ ID NO: 36862 - DNA, 1521 bp, Artificial Sequence
  Description of Artificial Sequence: Synthetic coding sequence
atgctgaagcccctgtggaaggctgctgtggcccccacctggccctgcagcatgcccccaagaagaccctgggaccgggaggccggcaccctgcaggtgctgggcgccctggccgtgctgtggctgggctctgtggccctgatctgcctgctgtggcaggtgcccaggcctcccacctggggccaggtgcagcccaaggatgtgcccaggtcctgggagcacggcagcagccctgcctgggagcccctggaggccgaggcccggcagcagagggacagctgccagctggtgctggtggagagcatcccccaggacctgcccagcgctgctggcagccccagcgcccagcccctgggccaggcctggctgcagctgctggacacagcccaggagagcgtgcacgtggccagctactactggagcctgactggaccagacattggagtgaatgacagcagcagccagctgggggaggccctgctgcagaagctgcagcagctgctgggcaggaacatcagcctggccgtggccaccagcagccccaccctggcccggaccagcacagacctgcaggtgctggccgcccggggggcccacgtgcggcaggtgcccatgggccgcctgacccggggcgtgctgcacagcaagttctgggtggtggatggccgccacatctacatgggcagcgccaacatggactggaggagcctgacccaggtgaaggagctgggcgctgtgatctacaactgcagccacctggcccaggacctggagaagaccttccagacctactgggtgctgggcgtgcccaaggctgtgctgcccaagacctggccccagaacttcagcagccacttcaaccgcttccagcccttccacggcctgtttgatggagtgcccaccacagcctacttcagcgccagccccccagccctgtgcccccagggccgcacccgggacctggaggccctgctggccgtgatgggcagcgcccaggagttcatctatgcctctgtgatggagtacttccccaccacccgcttcagccaccccccacgctactggcctgtgctggacaatgccctgcgggctgctgcctttggaaaaggagtgcgggtgcggctgctggtgggctgcggcctgaacacagaccccaccatgttcccctacctgcggagcctgcaggccctgagcaacccagctgccaacgtgtctgtggatgtgaaggtgttcatcgtgcctgtgggcaaccacagcaacatccccttcagccgggtgaaccacagcaagttcatggtgacagagaaggccgcctacatcggcaccagcaactggagcgaggactacttcagcagcacagctggggtgggcctggtggtgacccagagccctggggcccagcctgctggggccaccgtgcaggagcagctgcggcagctgtttgagcgggactggagcagccgctatgctgtgggcctggatggccaggcccctggccaggactgtgtgtggcagggctag

SEQ ID NO: 36863 - DNA, 1542 bp, Artificial Sequence
  Description of Artificial Sequence: Synthetic coding sequence
atgcctggctgccctgtgcagatgctgaagcccctgtggaaggctgctgtggcccccacctggccctgcagcatgccaccccggcggccctgggaccgggaggccggcaccctgcaggtgctgggcgccctggccgtgctgtggctgggctctgtggccctgatctgcctgctgtggcaggtgccccggccccccacctggggccaggtgcagcccaaggatgtgcccaggtcctgggagcacggcagcagccctgcctgggagcccctggaggccgaggcccggcagcagagggacagctgccagctggtgctggtggagagcatcccccaggacctgcccagcgctgctggcagccccagcgcccagcccctgggccaggcctggctgcagctgctggacacagcccaggagagcgtgcacgtggccagctactactggagcctgaccggccctgacatcggcgtgaatgacagcagcagccagctgggggaggccctgctgcagaagctgcagcagctgctgggcaggaacatcagcctggccgtggccaccagcagccccaccctggcccggaccagcacagacctgcaggtgctggccgcccggggggcccacgtgcggcaggtgcccatgggccgcctgacccggggcgtgctgcacagcaagttctgggtggtggatggccgccacatctacatgggcagcgccaacatggactggaggagcctgacccaggtgaaggagctgggcgccgtcatctacaactgcagccacctggcccaggacctggagaagaccttccagacctactgggtgctgggcgtgcccaaggctgtgctgcccaagacctggccccagaacttcagcagccacttcaaccgcttccagcccttccacggcctgtttgatggagtgcccaccacagcctacttcagcgccagccccccagccctgtgcccccagggccgcacccgggacctggaggccctgctggccgtgatgggcagcgcccaggagttcatctatgcctctgtgatggagtacttccccaccacccgcttcagccaccccccacgctactggcctgtgctggacaatgccctgcgggccgccgccttcggcaagggcgtgcgggtgcggctgctggtgggctgcggcctgaacacagaccccaccatgttcccctacctgcggagcctgcaggccctgagcaacccagctgccaacgtgtctgtggatgtgaaggtgttcatcgtgcctgtgggcaaccacagcaacatccccttcagccgggtgaaccacagcaagttcatggtgacagagaaggccgcctacatcggcaccagcaactggagcgaggactacttcagcagcacagctggggtgggcctggtggtgacccagagccctggggcccagcctgctggggccaccgtgcaggagcagctgcggcagctgtttgagcgggactggagcagccgctatgctgtgggcctggatggccaggcccctggccaggactgtgtgtggcagggctag

SEQ ID NO: 36864 - DNA, 1425 bp, Artificial Sequence
  Description of Artificial Sequence: Synthetic coding sequence
atgagccagcagaagtgcatcgtcatctttgccctggtgtgctgctttgccatcctggtggccctgatcttctctgctgtggacatcatgggagaagatgaagatggcctgtctgagaagaactgccagaacaagtgccgcatcgccctggtggagaacatccctgagggcctgaactacagtgaaaatgcccccttccacctgagcctcttccagggctggatgaacctgctgaacatggccaagaagtctgtggacatcgtgagcagccactgggacctgaaccacacccaccccagcgcctgccagggccagaggctgtttgagaagctgctgcagctgaccagccagaacatcgagatcaagctggtgtctgatgtgacagctgacagcaaggtgctggaggccctgaagctgaagggagctgaggtgacctacatgaacatgacagcctacaacaagggccgcctgcagagcagcttctggatcgtggacaagcagcacgtgtacatcggcagcgctggcctggactggcagagcctgggccagatgaaggagctgggcgtcatcttctacaactgcagctgcctggtgctggacctgcagaggatctttgccctgtacagcagcctgaagttcaagagccgggtgccccagacctggagcaagaggctgtatggagtgtatgacaatgagaagaagctgcagctgcagctgaatgagaccaagagccaggcctttgtgagcaacagccccaagctgttctgccccaagaacagaagctttgatattgatgccatctacagcgtgattgatgatgccaagcagtatgtgtacatcgctgtgatggactacctgcccatcagcagcaccagcaccaagaggacctactggccagacctggatgccaagatccgggaggccctggtgctgcggtctgtgcgggtgcggctgctgctgtccttctggaaggagacagaccccctgaccttcaacttcatcagcagcctgaaggccatctgcacagagatcgccaactgcagcctgaaggtgaagttctttgacctggagagagaaaatgcctgtgccaccaaggagcagaagaaccacaccttcccccggctgaacagaaacaagtacatggtgacagatggagctgcctacatcggcaactttgactgggtgggcaatgacttcacccagaatgccggcaccggcctggtgatcaaccaggctgatgtgaggaacaacagaagcatcatcaagcagctgaaggatgtgtttgagcgggactggtacagcccctatgccaagaccctgcagcccaccaagcagcccaactgcagcagcctcttcaagctgaagcccctgagcaacaagacagccacagatgacaccggcggcaaggaccccagaaatgtgtag

SEQ ID NO: 36865 - DNA, 1335 bp, Artificial Sequence
  Description of Artificial Sequence: Synthetic coding sequence
atgaggatggacagccagaagaagatcgccaagatcaacgtgggcaagagaattgccctggtggagaacatccctgagggcctgaactacagtgaaaatgcccccttccacctgagcctcttccagggctggatgaacctgctgaacatggccaagaagtctgtggacatcgtgagcagccactgggacctgaaccacacccaccccagcgcctgccagggccagaggctgtttgagaagctgctgcagctgaccagccagaacatcgagatcaagctggtgtctgatgtgacagctgacagcaaggtgctggaggccctgaagctgaagggagctgaggtgacctacatgaacatgacagcctacaacaagggccgcctgcagagcagcttctggatcgtggacaagcagcacgtgtacatcggcagcgctggcctggactggcagagcctgggccagatgaaggagctgggcgtcatcttctacaactgcagctgcctggtgctggacctgcagaggatctttgccctgtacagcagcctgaagttcaagagccgggtgccccagacctggagcaagaggctgtatggagtgtatgacaatgagaagaagctgcagctgcagctgaatgagaccaagagccaggcctttgtgagcaacagccccaagctgttctgccccaagaacagaagctttgatattgatgccatctacagcgtgattgatgatgccaagcagtatgtgtacatcgctgtgatggactacctgcccatcagcagcaccagcaccaagaggacctactggccagacctggatgccaagatccgggaggccctggtgctgcggtctgtgcgggtgcggctgctgctgtccttctggaaggagacagaccccctgaccttcaacttcatcagcagcctgaaggccatctgcacagagatcgccaactgcagcctgaaggtgaagttctttgacctggagagagaaaatgcctgtgccaccaaggagcagaagaaccacaccttcccccggctgaacagaaacaagtacatggtgacagatggagctgcctacatcggcaactttgactgggtgggcaatgacttcacccagaatgccggcaccggcctggtgatcaaccaggctgatgtgaggaacaacagaagcatcatcaagcagctgaaggatgtgtttgagcgggactggtacagcccctatgccaagaccctgcagcccaccaagcagcccaactgcagcagcctcttcaagctgaagcccctgagcaacaagacagccacagatgacaccggcggcaaggaccccagaaatgtgtag

SEQ ID NO: 36866 - DNA, 1611 bp, Artificial Sequence
  Description of Artificial Sequence: Synthetic coding sequence
atggagatccggcagcacgagtggctgagcgccagcccccatgagggctttgagcagatgaggctgaagagccggcccaaggagcccagccccagcctgaccagggtgggcgccaacttctacagctctgtgaagcagcaggactacagcgcctctgtgtggctgcggaggaaggacaagctggagcacagccagcagaagtgcatcgtcatctttgccctggtgtgctgctttgccatcctggtggccctgatcttctctgctgtggacatcatgggagaagatgaagatggcctgtctgagaagaactgccagaacaagtgccgcatcgccctggtggagaacatccctgagggcctgaactacagtgaaaatgcccccttccacctgagcctcttccagggctggatgaacctgctgaacatggccaagaagtctgtggacatcgtgagcagccactgggacctgaaccacacccaccccagcgcctgccagggccagaggctgtttgagaagctgctgcagctgaccagccagaacatcgagatcaagctggtgtctgatgtgacagctgacagcaaggtgctggaggccctgaagctgaagggagctgaggtgacctacatgaacatgacagcctacaacaagggccgcctgcagagcagcttctggatcgtggacaagcagcacgtgtacatcggcagcgctggcctggactggcagagcctgggccagatgaaggagctgggcgtcatcttctacaactgcagctgcctggtgctggacctgcagaggatctttgccctgtacagcagcctgaagttcaagagccgggtgccccagacctggagcaagaggctgtatggagtgtatgacaatgagaagaagctgcagctgcagctgaatgagaccaagagccaggcctttgtgagcaacagccccaagctgttctgccccaagaacagaagctttgatattgatgccatctacagcgtgattgatgatgccaagcagtatgtgtacatcgctgtgatggactacctgcccatcagcagcaccagcaccaagaggacctactggccagacctggatgccaagatccgggaggccctggtgctgcggtctgtgcgggtgcggctgctgctgtccttctggaaggagacagaccccctgaccttcaacttcatcagcagcctgaaggccatctgcacagagatcgccaactgcagcctgaaggtgaagttctttgacctggagagagaaaatgcctgtgccaccaaggagcagaagaaccacaccttcccccggctgaacagaaacaagtacatggtgacagatggagctgcctacatcggcaactttgactgggtgggcaatgacttcacccagaatgccggcaccggcctggtgatcaaccaggctgatgtgaggaacaacagaagcatcatcaagcagctgaaggatgtgtttgagcgggactggtacagcccctatgccaagaccctgcagcccaccaagcagcccaactgcagcagcctcttcaagctgaagcccctgagcaacaagacagccacagatgacaccggcggcaaggaccccagaaatgtgtag

SEQ ID NO: 36867 - DNA, 759 bp, Artificial Sequence
  Description of Artificial Sequence: Synthetic coding sequence
atgggccgcctgtcctggcaggtggccgctgctgctgctgtgggcctggccctgaccctggaggccctgccctgggtgctgcgctggctgcggagcagaagaagaagaccccggcgggaggccctcttcttccccagccaggtgacctgcacagaggccctgctgcgggcccctggagctgagctggccgagctgcctgagggctgcccctgtggcctgccccatggagagagcgccctgagccggctgctgcgggccctgctggccgcccgggccagcctggacctgtgcctgtttgccttcagcagcccccagctgggccgggctgtgcagctgctgcaccagaggggcgtgcgggtgcgggtggtgacagactgtgactacatggccctgaatggcagccagatcggcctgctgaggaaggccggcatccaggtgagacatgaccaggaccccggctacatgcaccacaagtttgccatcgtggacaagagggtgctgatcaccggcagcctgaactggaccacccaggccatccagaacaaccgggagaatgtgctgatcacagaagatgatgaatatgtgcggctcttcctggaggagtttgagcgcatctgggagcagttcaaccccaccaagtacaccttcttcccccccaagaagagccacggcagctgtgcccctcctgtgtccagagctgggggccgcctgctgtcctggcacaggacctgtggcaccagcagcgagagccagacctag

SEQ ID NO: 36868 - DNA, 528 bp, Artificial Sequence
  Description of Artificial Sequence: Synthetic coding sequence
atgggccgcctgtcctggcaggtggccgctgctgcccggggagctgtgctgcctgtgtctggggacctgtaccggggccctgctgctggcagcggcagaggagctggccgggccccccggggcctgcctgtgcggcctgccccccggcgggagcgggccaagcccccagctgcctgcccagctggccggccccggcagcccggcagcctgcctgtgcggctgctgcagcctgctgctggcccccggcgggctgtggccgccccagcctggggcgccagcgctggccgccaccggctgcggctgcacggcccccagaggctggccaacagatctgctgcccagggccgggaccccggccctgcccggagccggccccggctgcacgccagccaggtgtgccaccggggccaggagggcgcccaccactggctggcccagctggaccacgccagccaccctgagcagcagggcgagtgcagccaccacggcggcagaagagtgcgggccgccttcagcggccgcatctag

SEQ ID NO: 36869 - DNA, 678 bp, Artificial Sequence
  Description of Artificial Sequence: Synthetic coding sequence
atggtgagccacagcgagctgaggaagctgttctacagcgcagatgctgtgtgctttgatgtggacagcaccgtcatccgggaggagggcattgatgagctggccaagatctgtggggtggaggatgctgtgtctgagatgacccggcgggccatgggcggcgctgtgcccttcaaggccgccctgacagagcggctggccctgatccagcccagccgggagcaggtgcagaggctgattgctgagcagcccccccacctgaccccaggcatccgggagctggtgtcccggctgcaggagagaaatgtgcaggtgttcctgatcagcggcggcttccgcagcatcgtggagcacgtggccagcaagctgaacatcccagccaccaacgtgtttgccaaccggctgaagttctacttcaacggggagtatgccggctttgatgagacccagcccacagctgagagcggcggcaagggcaaggtgatcaagctgctgaaggagaagttccacttcaagaagatcatcatgattggagatggagccacagacatggaggcctgccccccagcagatgccttcatcggctttggaggaaatgtcatccggcagcaggtgaaggacaatgccaagtggtacatcacagactttgtggagctgctgggggagctggaggagtag

SEQ ID NO: 36870 - DNA, 678 bp, Artificial Sequence; identical to SEQ ID NO: 36869
  Description of Artificial Sequence: Synthetic coding sequence

SEQ ID NO: 36871 - DNA, 9 bp, Artificial Sequence
  Description of Artificial Sequence: Synthetic coding sequence
atggtgtag

SEQ ID NO: 36872 - DNA, 9 bp, Artificial Sequence
  Description of Artificial Sequence: Synthetic coding sequence
atggtgtag

SEQ ID NO: 36873 - DNA, 141 bp, Artificial Sequence
  Description of Artificial Sequence: Synthetic coding sequence
atggtgagccacagcgagctgaggaagctgttctacagcgcagatgctgtgtgctttgatgtggacagcaccgtcatccgggaggagggcattgatgagctggccaagatctgtggggtggaggatgctgtgtctgagtag

SEQ ID NO: 36874 - DNA, 141 bp, Artificial Sequence; identical to SEQ ID NO: 36873
  Description of Artificial Sequence: Synthetic coding sequence

SEQ ID NO: 36875 - DNA, 564 bp, Artificial Sequence
  Description of Artificial Sequence: Synthetic coding sequence
atggtgagccacagcgagctgaggaagctgttctacagcgcagatgctgtgtgctttgatgtggacagcaccgtcatccgggaggagggcattgatgagctggccaagatctgtggggtggaggatgctgtgtctgagatgacccggcgggccatgggcggcgctgtgcccttcaaggccgccctgacagagcggctggccctgatccagcccagccgggagcaggtgcagaggctgattgctgagcagcccccccacctgaccccaggcatccgggagctggtgtcccggctgcaggagagaaatgtgcaggtgttcctgatcagcggcggcttccgcagcatcgtggagcacgtggccagcaagctgaacatcccagccaccaacgtgtttgccaaccggctgaagttctacttcaacggggagtatgccggctttgatgagacccagcccacagctgagagcggcggcaagggcaaggtgatcaagctgctgaaggagaagttccacttcaagaagatcatcatgattggagatggagccacagacatggaggcctgctag

SEQ ID NO: 36876 - DNA, 33 bp, Artificial Sequence
  Description of Artificial Sequence: Synthetic coding sequence
atggtgagccacagcgagctgaggaagctgtag

SEQ ID NO: 36877 - DNA, 678 bp, Artificial Sequence; identical to SEQ ID NO: 36869
  Description of Artificial Sequence: Synthetic coding sequence

SEQ ID NO: 36878 - DNA, 1047 bp, Artificial Sequence
  Description of Artificial Sequence: Synthetic coding sequence
atgaagacagctgagaacatccggggcaccggcagtgatggccccaggaagaggggcctgtgtgtgctgtgtggcctgcctgctgctgggaagagcacctttgcccgggccctggcccaccggctgcagcaggagcagggctgggccatcggcgtggtggcctatgatgatgtgatgccagatgccttcctggccggggcccgggcccggcctgcccccagccagtggaagctgctgcggcaggagctgctgaagtacctggagtacttcctgatggctgtgatcaatggctgccagatgtctgtgccccccaacagaacagaggccatgtgggaggacttcatcacctgcctgaaggaccaggacctgatcttctctgctgcctttgaggcccagagctgctacctgctgaccaagacagctgtgtcccggcccctcttcctggtgctggatgacaacttctactaccagagcatgagatatgaggtgtaccagctggccaggaagtacagcctgggcttctgccagctgttcctggactgccccctggagacctgcctgcagagaaatggccagaggccccaggccctgcccccagagaccatccacctgatgggcaggaagctggagaagcccaaccctgagaagaatgcctgggagcacaacagcctgaccatccccagccctgcctgtgccagcgaggccagcctggaggtgacagacctgctgctgacagccctggagaaccctgtgaagtatgcagaggacaacatggagcagaaggacacagaccgcatcatctgcagcaccaacatcctgcacaagacagaccagaccctgcggagaattgtgtcccagaccatgaaggaggccaagggcaaccaggaggccttcagcgagatgaccttcaagcagcgctgggtgcgggccaaccacgccgccatctggaggatcatcctgggcaatgagcacatcaagtgccgcagcgccaaggtgggctggctgcagtgctgccgcatcgagaagaggcccctgagcactggatag

SEQ ID NO: 36879 - DNA, 870 bp, Artificial Sequence
  Description of Artificial Sequence: Synthetic coding sequence
atgaagacagctgagaacatccggggcaccggcagtgatggccccaggaagaggggcctgtgtgtgctgtgtggcctgcctgctgctgggaagagcacctttgcccgggccctggcccaccggctgcagcaggagcagggctgggccatcggcgtggtggcctatgatgatgtgatgccagatgccttcctggccggggcccgggcccggcctgcccccagccagtggaagctgctgcggcaggagctgctgaagtacctggagtacttcctgatggctgtgatcaatggctgccagatgtctgtgccccccaacagaacagaggccatgtgggaggacttcatcacctgcctgaaggaccaggacctgatcttctctgctgcctttgaggcccagagctgctacctgctgaccaagacagctgtgtcccggcccctcttcctggtgctggatgacaacttctactaccagagcatgagatatgaggtgtaccagctggccaggaagtacagcctgggcttctgccagctgttcctggactgccccctggagacctgcctgcagagaaatggccagaggccccaggccctgcccccagagaccatccacctgatgggcaggaagctggagaagcccaaccctgagaagaatgcctgggagcacaacagcctgaccatccccagccctgcctgtgccagcgaggccagcctggaggtgacagacctgctgctgacagccctggagaaccctgtgaagtatgcagaggacaacatggagcagaaggtgaacttccagtgcaagttcaacgtgaatgagaaggagcagctgtttgtgggccgcagctttgagcccaacatcaagtgtgagtag

SEQ ID NO: 36880 - DNA, 1080 bp, Artificial Sequence
  Description of Artificial Sequence: Synthetic coding sequence
tgaatgaagacagctgagaacatccggggcactggaagtgatggccccaggaagaggggcctgtgtgtgctgtgtggcctgcctgctgctgggaagagcacctttgcccgggccctggcccaccggctgcagcaggagcagggctgggccatcggcgtggtggcctatgatgatgtgatgccagatgccttcctggccggggcccgggcccggcctgcccccagccagtggaagctgctgcggcaggagctgctgaagtacctggagtacttcctgatggccgtcatcaatggctgccagatgtctgtgccccccaacagaacagaggccatgtgggaggacttcatcacctgcctgaaggaccaggacctgatcttctctgctgcctttgaggcccagagctgctacctgctgaccaagacagctgtgtcccggcccctcttcctggtgctggatgacaacttctactaccagagcatgagatatgaggtgtaccagctggccaggaagtacagcctgggcttctgccagctgttcctggactgccccctggagacctgcctgcagagaaatggccagaggccccaggccctgcccccagagaccatccacctgatgggcaggaagctggagaagcccaaccctgagaagaatgcctgggagcacaacagcctgaccatccccagccctgcctgtgccagcgaggccagcctggaggtgacagacctgctgctgacagccctggagaaccctgtgaagtatgcagaggacaacatggagcagaaggacacagaccgcatcatctgcagcaccaacatcctgcacaagacagaccagaccctgcggcgcatcgtgtcccagaccatgaaggaggccaaggatgagcaggtgctgccccacaacctgaagctgctggccgaggagctgaacaagctgaaggccgagttcctggaggacctgaagcagggcaacaagaagtacctgtgcttccagcagaccatcgacatcccagatgtgatctccttcttccactatgagaaggacaacatcgtgcagaagtacttcagcaagcagcactag

SEQ ID NO: 36881 - DNA, 7566 bp, Artificial Sequence
  Description of Artificial Sequence: Synthetic coding sequence
atggagccccacgtgctgggcgctgtgctgtactggctgctgctgccctgtgccctgctggccgcctgcctgctgcgcttcagcggcctgagcctggtgtacctgctcttcctgctgctgctgccctggttccctggccccacccgctgtggcctgcagggccacacaggccgcctgctgcgggccctgctgggcctgagcctgctcttcctggtggcccacctggccctgcagatctgcctgcacatcgtgccccggctggaccagctgctgggccccagctgcagccgctgggagaccctgagccgccacatcggcgtgacccggctggacctgaaggacatccccaatgccatccggctggtggccccagacctgggcatcctggtggtgtcctctgtgtgcctgggcatctgtggccgcctggccaggaacacccggcagagcccccacccccgggagctggatgatgatgaaagagatgtggatgccagccccacagctggcctgcaggaggccgccaccctggcccccacccggcgcagccggctggccgcccgcttccgggtgacagcccactggctgctggtggccgccggccgggtgctggccgtgaccctgctggccctggccggcatcgcccaccccagcgccctgagctctgtgtacctgctgctcttcctggccctgtgcacctggtgggcctgccacttccccatcagcacccggggcttcagccggctgtgtgtggccgtgggctgctttggagctggccacctgatctgcctgtactgctaccagatgcccctggcccaggccctgctgcccccagctggcatctgggcccgggtgctgggcctgaaggactttgtgggccccaccaactgcagcagcccccacgccctggtgctgaacacaggcctggactggcctgtgtatgccagccctggggtgctgctgctgctgtgctacgccacagccagcctgaggaagctgcgggcctaccggcccagcggccagaggaaggaggccgccaagggctatgaggcccgggagctggagctggccgagctggaccagtggccccaggagcgggagagtgaccagcacgtggtgcccacagccccagacacagaggccgacaactgcatcgtgcatgagctgaccggccagagctctgtgctgcggcggcctgtgcggcccaagagagctgagccccgggaggccagccccctgcacagcctgggccacctgatcatggaccagagctatgtgtgtgccctgattgccatgatggtgtggagcatcacctaccacagctggctgacctttgtgctgctgctgtgggcctgcctgatctggacagtgcgcagccgccaccagctggccatgctgtgcagcccctgcatcctgctgtatggcatgaccctgtgctgcctgcgctacgtgtgggccatggacctgcggcctgagctgcccaccaccctgggccctgtgtccctgcggcagctgggcctggagcacacccgctacccctgcctggacctgggcgccatgctgctgtacaccctgaccttctggctgctgctgcggcagtttgtgaaggagaagctgctgaagtgggccgagagccctgctgccctgacagaggtgacagtggccgacacagagcccaccaggacccagaccctgctgcagagcctgggggagctggtgaagggcgtgtatgccaagtactggatctacgtgtgtgccggcatgtttattgtggtgtcctttgctggccgcctggtggtgtacaagatcgtgtacatgttcctgttcctgctgtgcctgaccctcttccaggtgtactacagcctgtggaggaagctgctgaaggccttctggtggctggtggtggcctacaccatgctggtgctgattgctgtgtacaccttccagttccaggacttccctgcctactggaggaacctgaccggcttcacagatgagcagctgggggacctgggcctggagcagttctctgtgtctgagctgttcagcagcatcctggtgcccggcttcttcctgctggcctgcatcctgcagctgcactacttccaccggcccttcatgcagctgacagacatggagcacgtgtccctgcccggcacccggctgccccgctgggcccaccggcaggatgctgtgtctggcacccccctgctgcgggaggagcagcaggagcaccagcagcagcagcaggaggaggaggaggaggaggaggacagcagagatgagggcctgggcgtggccaccccccaccaggccacccaggtgcctgagggcgccgccaagtggggcctggtggccgagcggctgctggagctggccgccggcttcagtgatgtgctgagccgggtgcaggtgttcctgcggcggctgctggagctgcacgtgttcaagctggtggccctgtacacagtgtgggtggccctgaaggaggtgtctgtgatgaacctgctgctggtggtgctgtgggcctttgccctgccctacccccgcttccggcccatggccagctgcctgagcacagtgtggacctgtgtgatcatcgtgtgcaagatgctgtaccagctgaaggtggtgaacccccaggagtacagcagcaactgcacagagcccttccccaacagcaccaacctgctgcccacagagatcagccagagcctgctgtaccggggccctgtggaccctgccaactggtttggagtgaggaagggcttccccaacctgggctacatccagaaccacctgcaggtgctgctgctgctggtgtttgaggccatcgtgtaccgccggcaggagcactaccgccggcagcaccagctggcccccctgcctgcccaggccgtgtttgccagcggcacccggcagcagctggaccaggacctgctgggctgcctgaagtacttcatcaacttcttcttctacaagtttggcctggagatctgcttcctgatggctgtgaatgtgattggccagaggatgaacttcctggtgaccctgcacggctgctggctggtggccatcctgacccggcggcaccggcaggccatcgcccggctgtggcccaactactgcctcttcctggccctcttcctgctgtaccagtacctgctgtgcctgggcatgcccccagccctgtgcatcgactacccctggcgctggagcagagctgtgcccatgaacagcgccctgatcaagtggctgtacctgcctgacttcttccgggcccccaacagcaccaacctgatcagtgacttcctgctgctgctgtgtgccagccagcagtggcaggtgttttctgctgagaggacagaggagtggcagaggatggccggcgtgaacacagaccggctggagcccctgcggggggagcccaaccctgtgcccaacttcatccactgccgcagctacctggacatgctgaaggtggccgtgttccgctacctgttctggctggtgctggtggtggtgtttgtgactggagccacccgcatcagcatcttcggcctgggctacctgctggcctgcttctacctgctgctgtttggaacagccctgctgcagagggacacccgggcccggctggtgctgtgggactgcctgatcctgtacaacgtgaccgtcatcatcagcaagaacatgctgagcctgctggcctgtgtgtttgtggagcagatgcagacaggcttctgctgggtgatccagctgttcagcctggtgtgcaccgtgaagggctactatgaccccaaggagatgatggaccgggaccaggactgcctgctgcctgtggaggaggccggcatcatctgggacagcgtgtgcttcttcttcctgctgctgcagaggagggtcttcctgagccactactacctgcacgtgcgggctgacctgcaggccacagccctgctggccagccggggctttgccctgtacaatgctgccaacctgaagagcattgacttccaccggcgcatcgaggagaagagcctggcccagctgaagaggcagatggagcgcatccgggccaagcaggagaagcaccggcagggccgggtggacaggagccggccccaggacaccctgggccccaaggaccccggcctggagcccggccctgacagccctgggggcagcagccccccccggcggcagtggtggaggccctggctggaccacgccaccgtcatccacagcggggactacttcctgtttgaaagtgacagcgaggaggaggaggaggccgtgcctgaggacccccggcccagcgcccagagcgccttccagctggcctaccaggcctgggtgaccaatgcccaggccgtgctgcggcggcggcagcaggagcaggagcaggcccggcaggagcaggccggccagctgcccactggaggcggccccagccaggaggtggagcctgctgagggccctgaggaggccgccgccggccgcagccacgtggtgcagagggtgctgagcacagcccagttcctgtggatgctgggccaggccctggtggatgagctgacccgctggctgcaggagttcaccaggcaccacggcaccatgtctgatgtgctgcgggcagagcgctacctgctgacccaggagctgctgcagggcggggaggtgcacagaggagtgctggaccagctgtacaccagccaggccgaggccaccctgcccggccccacagaggccccaaatgcccccagcacagtgagcagcggcctgggcgctgaggagcccctgagctccatgacagatgacatgggcagccccctgagcacaggctaccacaccaggagcggcagcgaggaggccgtgacagaccccggggagcgggaggccggggccagcctgtaccagggcctgatgaggacagccagcgagctgctgctggaccggcggctgcgcatccctgagctggaggaggccgagctgtttgctgagggccagggccgggccctgcggctgctgcgggctgtgtaccagtgtgtggccgcccacagcgagctgctgtgctacttcatcatcatcctgaaccacatggtgacagccagcgctggcagcctggtgctgcctgtgctggtgttcctgtgggccatgctgagcatcccccggcccagcaagcgcttctggatgacagccatcgtgttcacagaaattgctgtggtggtgaagtacctgttccagtttggcttcttcccctggaacagccacgtggtgctgcggcgctatgagaacaagccctacttccccccacgcatcctgggcctggagaagacagatggctacatcaagtatgacctggtgcagctgatggccctcttcttccacaggagccagctgctgtgctacggcctgtgggaccacgaggaggacagccccagcaaggagcatgacaagagcggggaggaggagcagggcgctgaggagggccctggggtgcctgctgccaccacagaggaccacatccaggtggaggcccgggtgggccccacagatggcaccccagagccccaggtggagctgcggccccgggacacccggcgcatcagcctgcgcttcagaagaaggaagaaggagggccctgccaggaaaggagctgctgccattgaagctgaggaccgggaggaggaggagggggaggaggagaaggaggcccccaccggccgggagaagaggcccagccgcagcggcggccgggtgcgggctgctggaagaaggctgcagggcttctgcctgagcctggcccagggcacctaccggcccctgcggcgcttcttccatgacatcctgcacaccaagtaccgggccgccacagatgtgtatgccctgatgttcctggctgatgtggtggacttcatcatcatcatcttcggcttctgggccttcggcaagcacagcgctgccacagacatcaccagcagcctgagtgatgaccaggtgcctgaggccttcctggtgatgctgctgatccagttcagcaccatggtggtggaccgggccctgtacctgaggaagacagtgctgggcaagctggccttccaggtggccctggtgctggccatccacctgtggatgttcttcatcctgcctgctgtgacagagaggatgttcaaccagaatgtggtggcccagctgtggtactttgtgaagtgcatctactttgccctgagcgcctaccagatccgctgtggctaccccacccgcatcctgggcaacttcctgaccaagaagtacaaccacctgaacctcttcctgttccagggcttccggctggtgcccttcctggtggagctgcgggctgtgatggactgggtgtggacagacaccaccctgagcctgagctcctggatgtgtgtggaggacatctatgccaacatcttcatcatcaagtgcagccgggagacagagaagaagtacccccagcccaagggccagaagaagaagaagatcgtgaagtatggcatgggcggcctcatcatcctcttcctgattgccatcatctggttccccctgctcttcatgagcctggtgcgctctgtggtgggcgtggtgaaccagcccattgatgtgacagtgaccctgaagctgggcggctatgagcccctcttcaccatgtctgcccagcagcccagcatcatccccttcaccgcccaggcctatgaggagctgagccggcagtttgacccccagcccctggccatgcagttcatcagccagtacagcccagaagatattgtgacagcccagatcgagggcagcagcggggccctgtggaggatcagcccccccagccgggcccagatgaagcgggagctgtacaacggcacagctgacatcaccctgcgcttcacctggaacttccagagggacctggccaagggcggcaccgtggagtatgccaatgagaagcacatgctggccctggcccccaacagcacagcccggcggcagctggccagcctgctggagggcaccagtgaccagagcgtggtgatccccaacctcttccccaagtacatccgggcccccaacggccctgaggccaaccctgtgaagcagctgcagcccaatgaggaggccgactacctgggcgtgcgcatccagctgcggcgggagcagggcgctggggccaccggcttcctggagtggtgggtgattgagctgcaggagtgcaggacagactgcaacctgctgcccatggtgatcttcagtgacaaggtgtccccacccagcctgggcttcctggccggctacggcatcatgggcctgtatgtgtccatcgtgctggtgattggcaagtttgtgcggggcttcttcagcgagatcagccacagcatcatgtttgaggagctgccctgtgtggaccgcatcctgaagctgtgccaggacatcttcctggtgcgggagacccgggagctggagctggaggaggagctgtatgccaagctgatcttcctgtaccgcagccctgagaccatgatcaagtggacccgggagaaggagtag

SEQ ID NO: 36882 - DNA, 1122 bp, Artificial Sequence
  Description of Artificial Sequence: Synthetic coding sequence
atgaagatctgccccttcagcagcaagagcagcatcgtgctggccctgaagttccgcagcctcatccactttgagaagtacccccagcccaagggccagaagaagaagaagatcgtgaagtatggcatgggcggcctcatcatcctcttcctgattgccatcatctggttccccctgctcttcatgagcctggtgcgctctgtggtgggcgtggtgaaccagcccattgatgtgacagtgaccctgaagctgggcggctatgagcccctcttcaccatgtctgcccagcagcccagcatcatccccttcaccgcccaggcctatgaggagctgagccggcagtttgacccccagcccctggccatgcagttcatcagccagtacagcccagaagatattgtgacagcccagatcgagggcagcagcggggccctgtggaggatcagcccccccagccgggcccagatgaagcgggagctgtacaacggcacagctgacatcaccctgcgcttcacctggaacttccagagggacctggccaagggcggcaccgtggagtatgccaatgagaagcacatgctggccctggcccccaacagcacagcccggcggcagctggccagcctgctggagggcaccagtgaccagagcgtggtgatccccaacctcttccccaagtacatccgggcccccaacggccctgaggccaaccctgtgaagcagctgcagcccaatgaggaggccgactacctgggcgtgcgcatccagctgcggcgggagcagggcgctggggccaccggcttcctggagtggtgggtgattgagctgcaggagtgcaggacagactgcaacctgctgcccatggtgatcttcagtgacaagcaccacggggctgtgcgggtgcaccgggccggccaccggcaggtgcgggcccgcatcctgcagagggacctggccctgcactacgtgagaggagctgctgtgcggggcccccacccccaggccctgcccggccacctgcctggagctggggacagcggggccggggccggcggcggcgtggtgcggcaggcccacctgcccctgcccctgactggagaccatgaccaggtggacagctag

SEQ ID NO: 36883 - DNA, 7404 bp, Artificial Sequence
  Description of Artificial Sequence: Synthetic coding sequence
tgaacaggccgcctgctgcgggccctgctgggcctgagcctgctcttcctggtggcccacctggccctgcagatctgcctgcacatcgtgccccggctggaccagctgctgggccccagctgcagccgctgggagaccctgagccgccacatcggcgtgacccggctggacctgaaggacatccccaatgccatccggctggtggccccagacctgggcatcctggtggtgtcctctgtgtgcctgggcatctgtggccgcctggccaggaacacccggcagagcccccacccccgggagctggatgatgatgaaagagatgtggatgccagccccacagctggcctgcaggaggccgccaccctggcccccacccggcgcagccggctggccgcccgcttccgggtgacagcccactggctgctggtggccgccggccgggtgctggccgtgaccctgctggccctggccggcatcgcccaccccagcgccctgagctctgtgtacctgctgctcttcctggccctgtgcacctggtgggcctgccacttccccatcagcacccggggcttcagccggctgtgtgtggccgtgggctgctttggagctggccacctgatctgcctgtactgctaccagatgcccctggcccaggccctgctgcccccagctggcatctgggcccgggtgctgggcctgaaggactttgtgggccccaccaactgcagcagcccccacgccctggtgctgaacacaggcctggactggcctgtgtatgccagccctggggtgctgctgctgctgtgctacgccacagccagcctgaggaagctgcgggcctaccggcccagcggccagaggaaggaggccgccaagggctatgaggcccgggagctggagctggccgagctggaccagtggccccaggagcgggagagtgaccagcacgtggtgcccacagccccagacacagaggccgacaactgcatcgtgcatgagctgaccggccagagctctgtgctgcggcggcctgtgcggcccaagagagctgagccccgggaggccagccccctgcacagcctgggccacctgatcatggaccagagctatgtgtgtgccctgattgccatgatggtgtggagcatcacctaccacagctggctgacctttgtgctgctgctgtgggcctgcctgatctggacagtgcgcagccgccaccagctggccatgctgtgcagcccctgcatcctgctgtatggcatgaccctgtgctgcctgcgctacgtgtgggccatggacctgcggcctgagctgcccaccaccctgggccctgtgtccctgcggcagctgggcctggagcacacccgctacccctgcctggacctgggcgccatgctgctgtacaccctgaccttctggctgctgctgcggcagtttgtgaaggagaagctgctgaagtgggccgagagccctgctgccctgacagaggtgacagtggccgacacagagcccaccaggacccagaccctgctgcagagcctgggggagctggtgaagggcgtgtatgccaagtactggatctacgtgtgtgccggcatgtttattgtggtgtcctttgctggccgcctggtggtgtacaagatcgtgtacatgttcctgttcctgctgtgcctgaccctcttccaggtgtactacagcctgtggaggaagctgctgaaggccttctggtggctggtggtggcctacaccatgctggtgctgattgctgtgtacaccttccagttccaggacttccctgcctactggaggaacctgaccggcttcacagatgagcagctgggggacctgggcctggagcagttctctgtgtctgagctgttcagcagcatcctggtgcccggcttcttcctgctggcctgcatcctgcagctgcactacttccaccggcccttcatgcagctgacagacatggagcacgtgtccctgcccggcacccggctgccccgctgggcccaccggcaggatgctgtgtctggcacccccctgctgcgggaggagcagcaggagcaccagcagcagcagcaggaggaggaggaggaggaggaggacagcagagatgagggcctgggcgtggccaccccccaccaggccacccaggtgcctgagggcgccgccaagtggggcctggtggccgagcggctgctggagctggccgccggcttcagtgatgtgctgagccgggtgcaggtgttcctgcggcggctgctggagctgcacgtgttcaagctggtggccctgtacacagtgtgggtggccctgaaggaggtgtctgtgatgaacctgctgctggtggtgctgtgggcctttgccctgccctacccccgcttccggcccatggccagctgcctgagcacagtgtggacctgtgtgatcatcgtgtgcaagatgctgtaccagctgaaggtggtgaacccccaggagtacagcagcaactgcacagagcccttccccaacagcaccaacctgctgcccacagagatcagccagagcctgctgtaccggggccctgtggaccctgccaactggtttggagtgaggaagggcttccccaacctgggctacatccagaaccacctgcaggtgctgctgctgctggtgtttgaggccatcgtgtaccgccggcaggagcactaccgccggcagcaccagctggcccccctgcctgcccaggccgtgtttgccagcggcacccggcagcagctggaccaggacctgctgggctgcctgaagtacttcatcaacttcttcttctacaagtttggcctggagatctgcttcctgatggctgtgaatgtgattggccagaggatgaacttcctggtgaccctgcacggctgctggctggtggccatcctgacccggcggcaccggcaggccatcgcccggctgtggcccaactactgcctcttcctggccctcttcctgctgtaccagtacctgctgtgcctgggcatgcccccagccctgtgcatcgactacccctggcgctggagcagagctgtgcccatgaacagcgccctgatcaagtggctgtacctgcctgacttcttccgggcccccaacagcaccaacctgatcagtgacttcctgctgctgctgtgtgccagccagcagtggcaggtgttttctgctgagaggacagaggagtggcagaggatggccggcgtgaacacagaccggctggagcccctgcggggggagcccaaccctgtgcccaacttcatccactgccgcagctacctggacatgctgaaggtggccgtgttccgctacctgttctggctggtgctggtggtggtgtttgtgactggagccacccgcatcagcatcttcggcctgggctacctgctggcctgcttctacctgctgctgtttggaacagccctgctgcagagggacacccgggcccggctggtgctgtgggactgcctgatcctgtacaacgtgaccgtcatcatcagcaagaacatgctgagcctgctggcctgtgtgtttgtggagcagatgcagacaggcttctgctgggtgatccagctgttcagcctggtgtgcaccgtgaagggctactatgaccccaaggagatgatggaccgggaccaggactgcctgctgcctgtggaggaggccggcatcatctgggacagcgtgtgcttcttcttcctgctgctgcagaggagggtcttcctgagccactactacctgcacgtgcgggctgacctgcaggccacagccctgctggccagccggggctttgccctgtacaatgctgccaacctgaagagcattgacttccaccggcgcatcgaggagaagagcctggcccagctgaagaggcagatggagcgcatccgggccaagcaggagaagcaccggcagggccgggtggacaggagccggccccaggacaccctgggccccaaggaccccggcctggagcccggccctgacagccctgggggcagcagccccccccggcggcagtggtggaggccctggctggaccacgccaccgtcatccacagcggggactacttcctgtttgaaagtgacagcgaggaggaggaggaggccgtgcctgaggacccccggcccagcgcccagagcgccttccagctggcctaccaggcctgggtgaccaatgcccaggccgtgctgcggcggcggcagcaggagcaggagcaggcccggcaggagcaggccggccagctgcccactggaggcggccccagccaggaggtggagcctgctgagggccctgaggaggccgccgccggccgcagccacgtggtgcagagggtgctgagcacagcccagttcctgtggatgctgggccaggccctggtggatgagctgacccgctggctgcaggagttcaccaggcaccacggcaccatgtctgatgtgctgcgggcagagcgctacctgctgacccaggagctgctgcagggcggggaggtgcacagaggagtgctggaccagctgtacaccagccaggccgaggccaccctgcccggccccacagaggccccaaatgcccccagcacagtgagcagcggcctgggcgctgaggagcccctgagctccatgacagatgacatgggcagccccctgagcacaggctaccacaccaggagcggcagcgaggaggccgtgacagaccccggggagcgggaggccggggccagcctgtaccagggcctgatgaggacagccagcgagctgctgctggaccggcggctgcgcatccctgagctggaggaggccgagctgtttgctgagggccagggccgggccctgcggctgctgcgggctgtgtaccagtgtgtggccgcccacagcgagctgctgtgctacttcatcatcatcctgaaccacatggtgacagccagcgctggcagcctggtgctgcctgtgctggtgttcctgtgggccatgctgagcatcccccggcccagcaagcgcttctggatgacagccatcgtgttcacagaaattgctgtggtggtgaagtacctgttccagtttggcttcttcccctggaacagccacgtggtgctgcggcgctatgagaacaagccctacttccccccacgcatcctgggcctggagaagacagatggctacatcaagtatgacctggtgcagctgatggccctcttcttccacaggagccagctgctgtgctacggcctgtgggaccacgaggaggacagccccagcaaggagcatgacaagagcggggaggaggagcagggcgctgaggagggccctggggtgcctgctgccaccacagaggaccacatccaggtggaggcccgggtgggccccacagatggcaccccagagccccaggtggagctgcggccccgggacacccggcgcatcagcctgcgcttcagaagaaggaagaaggagggccctgccaggaaaggagctgctgccattgaagctgaggaccgggaggaggaggagggggaggaggagaaggaggcccccaccggccgggagaagaggcccagccgcagcggcggccgggtgcgggctgctggaagaaggctgcagggcttctgcctgagcctggcccagggcacctaccggcccctgcggcgcttcttccatgacatcctgcacaccaagtaccgggccgccacagatgtgtatgccctgatgttcctggctgatgtggtggacttcatcatcatcatcttcggcttctgggccttcggcaagcacagcgctgccacagacatcaccagcagcctgagtgatgaccaggtgcctgaggccttcctggtgatgctgctgatccagttcagcaccatggtggtggaccgggccctgtacctgaggaagacagtgctgggcaagctggccttccaggtggccctggtgctggccatccacctgtggatgttcttcatcctgcctgctgtgacagagaggatgttcaaccagaatgtggtggcccagctgtggtactttgtgaagtgcatctactttgccctgagcgcctaccagatccgctgtggctaccccacccgcatcctgggcaacttcctgaccaagaagtacaaccacctgaacctcttcctgttccagggcttccggctggtgcccttcctggtggagctgcgggctgtgatggactgggtgtggacagacaccaccctgagcctgagctcctggatgtgtgtggaggacatctatgccaacatcttcatcatcaagtgcagccgggagacagagaagaagtacccccagcccaagggccagaagaagaagaagatcgtgaagtatggcatgggcggcctcatcatcctcttcctgattgccatcatctggttccccctgctcttcatgagcctggtgcgctctgtggtgggcgtggtgaaccagcccattgatgtgacagtgaccctgaagctgggcggctatgagcccctcttcaccatgtctgcccagcagcccagcatcatccccttcaccgcccaggcctatgaggagctgagccggcagtttgacccccagcccctggccatgcagttcatcagccagtacagcccagaagatattgtgacagcccagatcgagggcagcagcggggccctgtggaggatcagcccccccagccgggcccagatgaagcgggagctgtacaacggcacagctgacatcaccctgcgcttcacctggaacttccagagggacctggccaagggcggcaccgtggagtatgccaatgagaagcacatgctggccctggcccccaacagcacagcccggcggcagctggccagcctgctggagggcaccagtgaccagagcgtggtgatccccaacctcttccccaagtacatccgggcccccaacggccctgaggccaaccctgtgaagcagctgcagcccaatgaggaggccgactacctgggcgtgcgcatccagctgcggcgggagcagggcgctggggccaccggcttcctggagtggtgggtgattgagctgcaggagtgcaggacagactgcaacctgctgcccatggtgatcttcagtgacaaggtgtccccacccagcctgggcttcctggccggctacggcatcatgggcctgtatgtgtccatcgtgctggtgattggcaagtttgtgcggggcttcttcagcgagatcagccacagcatcatgtttgaggagctgccctgtgtggaccgcatcctgaagctgtgccaggacatcttcctggtgcgggagacccgggagctggagctggaggaggagctgtatgccaagctgatcttcctgtaccgcagccctgagaccatgatcaagtggacccgggagaaggagtag

SEQ ID NO: 36884 - DNA, 1665 bp, Artificial Sequence
  Description of Artificial Sequence: Synthetic coding sequence
atgccagactaccgcacccgggccctgtttgtgcagagcaccctgggggacagcgctggccctgagctgcagctgctgagcatcgtgcccggccgggacctgcagcccagcgacagcttcaccgccagcagcagccccccaccttctgtgtggagcgagctggagcacatccggggcaagtctgaggccaccacagagctgaagaggcccagcctgcccggcagcatccacagctgcctgtgtggggtgtggtgtggggtgggcaagaggacccccagcagcctggtgagcagcctgcaggacctggagctgctgggccagaggcagaggcagctgtggatggagagcaccccccggcccccctacaaccccttcctggtgccctgcacccctgtgggcaagctgtctgctgagcacggcggccccaccaggaagatgcctccttctgccagcgctgtggacttcttccagctgtttgtgcctgacaacgtgctgaagaacatggtggtgcagaccaacatgtatgccaagaagttccaggagagatttggaagtgatggagcctgggtggaggtgaccctgacagagatgaaggccttcctgggctacatgatcagcaccagcatcagccactgtgagagcgtgctgagcatctggagcggcggcttctacagcaacagaagcctggccctggtgatgagccaggccaggtttgagaagatcctgaagtacttccacgtggtggccttccgcagcagccagaccacccacggcctgtacaaggtgcagcccttcctggacagcctgcagaacagctttgattctgccttccggcccagccagacccaggtgctgcacgagcccctgattgatgaggaccccgtcttcatcgccacctgcacagagcgggagctgaggaagaggaagaagaggaagttcagcctgtgggtgcggcagtgcagcagcacaggcttcatcatccagatctacgtgcacctgaaggagggcggcggcccagatggcctggatgccctgaagaacaagccccagctgcacagcatggtggcccggagcctgtgcagaaatgctgctgggaagaactacatcatcttcaccggccccagcatcaccagcctgaccctgtttgaggagtttgagaagcagggcatctactgctgcggcctgctgcgggccaggaagagtgactgcaccggcctgcccctgtccatgctgaccaacccagccaccccaccagcccggggccagtaccagatcaagatgaagggcaacatgagcctcatctgctggtacaacaagggccacttccgcttcctgaccaatgcctacagccctgtgcagcagggcgtcatcatcaagaggaagagcggggagatcccctgccccctggccgtggaggcctttgctgcccacctgagctacatctgccgctatgatgacaagtacagcaagtacttcatcagccacaagcccaacaagacctggcagcaggtgttctggtttgccatcagcatcgccatcaacaatgcctacatcctgtacaagatgtctgatgcctaccacgtgaagcgctacagccgggcccagtttggagagcggctggtgcgggagctgctgggcctggaggatgccagccccacccactag

SEQ ID NO: 36885 - DNA, 1368 bp, Artificial Sequence
  Description of Artificial Sequence: Synthetic coding sequence
atgccagactaccgcacccgggccctgtttgtgcagagcaccctgggggacagcgctggccctgagctgcagctgctgagcatcgtgcccggccgggacctgcagcccagcgacagcttcaccggccccaccaggaagatgccacccagcgccagcgctgtggacttcttccagctgtttgtgcctgacaacgtgctgaagaacatggtggtgcagaccaacatgtatgccaagaagttccaggagcgcttcggcagtgatggagcctgggtggaggtgaccctgacagagatgaaggccttcctgggctacatgatcagcaccagcatcagccactgtgagagcgtgctgagcatctggagcggcggcttctacagcaacagaagcctggccctggtgatgagccaggccaggtttgagaagatcctgaagtacttccacgtggtggccttccgcagcagccagaccacccacggcctgtacaaggtgcagcccttcctggacagcctgcagaacagctttgacagcgccttccggcccagccagacccaggtgctgcacgagcccctgattgatgaagatcctgtgttcatcgccacctgcacagagcgggagctgaggaagaggaagaagaggaagttcagcctgtgggtgcggcagtgcagcagcacaggcttcatcatccagatctacgtgcacctgaaggagggcggcggcccagatggcctggatgccctgaagaacaagccccagctgcacagcatggtggcccggagcctgtgcagaaatgctgctgggaagaactacatcatcttcaccggccccagcatcaccagcctgaccctgtttgaggagtttgagaagcagggcatctactgctgcggcctgctgcgggccaggaagagtgactgcaccggcctgcccctgtccatgctgaccaacccagccaccccaccagcccggggccagtaccagatcaagatgaagggcaacatgagcctcatctgctggtacaacaagggccacttccgcttcctgaccaatgcctacagccctgtgcagcagggcgtcatcatcaagaggaagtctggagagatcccctgccccctggccgtggaggcctttgctgcccacctgagctacatctgccgctatgatgacaagtacagcaagtacttcatcagccacaagcccaacaagacctggcagcaggtgttctggtttgccatcagcatcgccatcaacaatgcctacatcctgtacaagatgtctgatgcctaccacgtgaagcgctacagccgggcccagtttggagagcggctggtgcgggagctgctgggcctggaggatgccagccccacccactag

SEQ ID NO: 36886 - DNA, 3114 bp, Artificial Sequence
  Description of Artificial Sequence: Synthetic coding sequence
atgagcccccccctgtgccccctgctgctgctggccgtgggcctgcggctggccggcaccctgaaccccagcgaccccaacacctgcagcttctgggagagcttcaccaccaccaccaaggagagccacagccggcccttcagcctgctgcccagcgagccctgtgagcggccctgggagggcccccacacctgcccccagcccaccgtggtgtacagaacagtgtaccggcaggtggtgaagacagaccaccggcagaggctgcagtgctgccacggcttctatgagagccggggcttctgtgtgcccctgtgtgcccaggagtgtgtgcacggccgctgtgtggcccccaaccagtgccagtgtgtgcccggctggagaggagatgactgcagcagtgaatgtgcccctggcatgtggggcccccagtgtgacaagccctgcagctgtggcaacaacagcagctgtgaccccaagagcggcgtgtgcagctgccccagcggcctgcagccccccaactgcctgcagccctgcaccccaggctactacggccctgcctgccagttccgctgccagtgccacggggccccctgtgacccccagacaggagcctgcttctgcccagctgagaggacaggccccagctgtgatgtgtcctgcagccagggcaccagcggcttcttctgccccagcacccacagctgccagaatggaggagtcttccagaccccccagggcagctgcagctgccccccaggctggatgggcaccatctgcagcctgccctgcccagagggcttccacggccccaactgcagccaggagtgccgctgccacaacggcggcctgtgtgaccgcttcaccggccagtgccgctgtgcccctggctacaccggggaccgctgccgggaggagtgccctgtgggccgcttcggccaggactgtgccgagacctgtgactgtgccccagatgcccgctgcttccctgccaatggagcctgcctgtgtgagcacggcttcaccggggaccgctgcacagaccggctgtgcccagatggcttctacggcctgagctgccaggccccctgcacctgtgaccgggagcacagcctgagctgccaccccatgaatggagaatgtagctgcctgcccggctgggccggcctgcactgcaatgaaagctgcccccaggacacccacggccctggctgccaggagcactgcctgtgcctgcacggcggcgtgtgccaggccaccagcggcctgtgccagtgtgcccctggctacacaggcccccactgtgccagcctgtgccccccagacacctatggagtgaactgcagcgcccgctgcagctgtgaaaatgccatcgcctgcagccccattgatggagaatgtgtgtgcaaggagggctggcagaggggcaactgcagcgtgccctgccccccaggcacctggggcttcagctgcaatgccagctgccagtgtgcccacgaggccgtgtgcagcccccagacaggagcctgcacctgcaccccaggctggcacggggcccactgccagctgccctgccccaagggccagtttggagagggctgtgccagccgctgtgactgtgaccacagtgatggctgtgaccctgtgcacggccgctgccagtgccaggccggctggatgggcgcccgctgccacctgagctgcccagagggcctgtggggcgtgaactgcagcaacacctgcacctgcaagaatggaggcacctgcctgcctgaaaatggaaactgtgtgtgtgcccctggcttccggggccccagctgccagaggagctgccagcccggccgctatggcaagagatgtgtgccctgcaagtgtgccaaccacagcttctgccaccccagcaatggcacctgctactgcctggccggctggacaggccctgactgcagccagccctgccccccaggccactggggcgagaactgtgcccagacctgccagtgccaccacggcggcacctgccacccccaggacggcagctgcatctgccccctgggctggacaggccaccactgcctggagggctgccccctgggcaccttcggggccaactgcagccagccctgccagtgtggccctggagagaagtgccaccctgagaccggggcctgtgtgtgccccccaggccacagcggggccccctgccgcatcggcatccaggagcccttcaccgtgatgcccaccacccctgtggcctacaacagcctgggcgctgtgattggaattgctgtgctgggcagcctggtggtggccctggtggccctcttcatcggctaccgccactggcagaagggcaaggagcaccaccacctggccgtggcctacagcagcggccgcctggatggctctgaatatgtgatgccagatgtgccccccagctacagccactactacagcaaccccagctaccacaccctgagccagtgcagccccaaccccccaccacccaacaaggtgcccggccccctgtttgccagcctgcagaaccctgagaggcctgggggcgcccagggccatgacaaccacaccaccctgcctgctgactggaagcacagaagagagcccccacctggccccctggaccggggcagcagccggctggacaggagctacagctacagctacagcaatggacctggccccttctacaacaagggcctcatcagcgaggaggagctgggcgcctctgtggccagcctgagcagcgagaacccctatgccaccatccgggacctgcccagcctgcccggcggcccccgggagagcagctacatggagatgaagggccccccatctggcagccccccccggcagcccccccagttctgggacagccagaggcggcggcagccccagccccagagggacagcggcacctatgagcagcccagccccctcatccatgaccgggacagcgtgggcagccagccccccctgcccccaggcctgcccccaggccactatgacagccccaagaacagccacatccctggccactatgacctgccccctgtgcgccacccccccagcccccccctgcggcggcaggacagatag

SEQ ID NO: 36887 - DNA, 3114 bp, Artificial Sequence; identical to SEQ ID NO: 36886
  Description of Artificial Sequence: Synthetic coding sequence

SEQ ID NO: 36888 - DNA, 522 bp, Artificial Sequence
  Description of Artificial Sequence: Synthetic coding sequence
atgagcccccccctgtgccccctgctgctgctggccgtgggcctgcggctggccggcaccctgaaccccagcgaccccaacacctgcagcttctgggagagcttcaccaccaccaccaaggagagccacagccggcccttcagcctgctgcccagcgagccctgtgagcggccctgggagggcccccacacctgcccccagcccaccgtggtgtacagaacagtgtaccggcaggtggtgaagacagaccaccggcagaggctgcagtgctgccacggcttctatgagagccggggcttctgtgtgcccctgtgtgcccaggagtgtgtgcacggccgctgtgtggcccccaaccagtgccagtgtgtgcccggctggagaggagatgactgcagcagtgaatgtgcccctggcatgtggggcccccagtgtgacaagccctgcagctgtggcaacaacagcagctgtgaccccaagagcggcgtgtgcagctgccccagcggcctgcagccccccaactag

SEQ ID NO: 36889 - DNA, 2316 bp, Artificial Sequence
  Description of Artificial Sequence: Synthetic coding sequence
atggaggaggacaagctgctgtctgctgtgcctgaggagggagatgccacccgggaccccggccctgagcctgaggaggagcccggggtgagaaatggcatggccagcgagggcctgaacagcagcctgtgcagccctggccacgagcggcggggcaccccagctgacacagaggagcccaccaaggaccctgatgtggccttccacggcctgagcctgggcctgagcctgaccaacggcctggccctgggccctgacctgaacatcctggaggacagcgctgagagccggccctggagggctggggtgctggccgagggggacaatgccagccgcagcctgtacccagatgctgaggacccccagctgggcctggatggccctggagagccagatgtgagagatggcttcagcgccacctttgagaagatcctggagagcgagctgctgcggggcacccagtacagcagcctggacagcctggatggcctgagcctgacagatgaaagtgacagctgtgtgtcctttgaggcccccctgacccccctcatccagcagagggcccgggacagccctgagcccggggccggcctgggcatcggggacatggcctttgaaggagacatgggcgctgctggaggagatggagagctgggcagccccctgcggcgcagcatcagcagcagccgctcagaaaatgtgctgagccggctgagcctgatggccatgcccaacggcttccatgaagatggcccccagggccctggaggagatgaagatgatgatgaggaggacacagacaagctgctgaacagcgccagtgaccccagcctgaaggatggcctgagtgacagcgacagcgagctgagcagcagcgagggcctggagcccggcagcgctgaccccctggccaacggctgccagggcgtgtctgaggccgcccaccggctggcccggcggctgtaccacctggagggcttccagagatgtgatgtggcccggcagctgggcaagaacaatgagttcagccggctggtggccggggagtacctgtccttctttgacttcagcggcctgaccctggatggagccctgcggaccttcctgaaggccttccccctgatgggagagacccaggagcgggagcgggtgctgacccacttcagccgccgctactgccagtgcaacccagatgacagcaccagtgaagatggcatccacaccctgacctgtgccctgatgctgctgaacacagacctgcacggccacaacatcggcaagaagatgagctgccagcagttcatcgccaacctggaccagctgaatgatggccaggactttgccaaggacctgctgaagaccctgtacaacagcatcaagaatgagaagctggagtgggccattgatgaagatgagctgaggaagagcctgtctgagctggtggatgacaagtttggaacaggcaccaagaaggtgacccgcatcctggatggcggcaaccccttcctggatgtgccccaggccctgagcgccaccacctacaagcacggcgtgctgaccaggaagacccatgctgacatggatggcaagaggaccccccggggccggcggggctggaagaagttctatgctgtgctgaagggcaccatcctgtacctgcagaaggatgagtacagaccagacaaggccctgtctgagggggacctgaagaatgccatccgggtgcaccacgccctggccacccgggccagtgactacagcaagaagagcaatgtgctgaagctgaagacagctgactggagggtcttcctgttccaggcccccagcaaggaggagatgctgtcctggatcctgcgcatcaacctggtggccgccatcttcagcgccccagccttccctgctgctgtgtcctccatgaagaagttctgccggcccctgctgcccagctgcaccacccggctgtgccaggaggagcagctgcggagccatgagaacaagctgcggcagctgacagctgagctggccgagcaccgctgccaccctgtggagcggggcatcaagagcaaggaggccgaggagtaccgcctgaaggagcactacctgacctttgagaagagccgctatgagacctacatccacctgctggccatgaagatcaaggtgggcagtgatgacctggagagaattgaggcccggctggccaccctggagggagatgaccccagcctgaggaagacccacagcagccctgccctgagccagggccacgtgacaggcagcaagaccaccaaggatgccactggaccagacacctag

SEQ ID NO: 36890 - DNA, 2601 bp, Artificial Sequence
  Description of Artificial Sequence: Synthetic coding sequence
atggaggaggaggacaccaagcgggaggtgcccaaggaggatggagtgggagatgtgcagcactttgacagcagcaagatcatggaggagcacagctacatccagaaggagctggacctgcagaatggcagcctggaggaggacagcgtggtgcacagcgtggagaatgacagccagaacatgatggagagcctgagccccaagaagtacagcagcagcctgcgcttcaaggccaatggagactacagcggcagctacctgaccctgagccagcctgtgcctgccaagaggagccccagccccctgggcacctctgtgcgcagcagccccagcctggccaagatccagggcagcaagcagttctcctatgatggaacagacaagaacatccccatgaagccacccacccccctgctgaacaccaccagcagcctgagcggctaccccctgggccgggctgactttgaccactacacaggccgggacagcgagcgggccctgcggctgtctgagaagccaccctacagcaagtacagcagccgccacaagagccatgacaacgtgtacagcctgggcggcctggagggcaggaaggccagcggcagcctgctggccatgtggaatggcagcagcctgagtgatgctggccccccacccatcagccgctctggagctgcctccatgcccagcagccccaagcaggccaggaagatgagcatccaggacagcctggccctgcagcccaagctgaccaggcacaaggagctggccagcgagaacatcaacctgcggaccaggaagtacagcagcagcagcctgagccacatgggcgcctacagccgcagcctgccccggctgtaccgggccacagagaaccagctgacccccctgagcctgccccccaggaacagcctgggcaacagcaagaggaccaagctgggggagaaggacctgccccacagcgtgattgacaatgacaactacctgaacttcagcagcctgagcagcggggccctgccctacaagaccagcgccagcgagggcaacccctacgtgagcagcaccctgtctgtgcctgccagcccccgggtggccaggaagatgctgctggccagcaccagcagctgtgccagtgatgactttgaccaggccagctatgtgggcaccaaccccagccacagcctgctggccggggagagtgacagagtgtttgccaccaggaggaacttcagctgtggctctgtggagtttgatgaggccgacctggagagcctgcggcaggccagcggcaccccccagcctgccctgcgggagaggaagagcagcatcagcagcatcagcggcagagatgacctgatggactaccaccggcggcagcgggaggagcggctgcgggagcaggagatggagcggctggagcggcagaggctggagaccatcctgagcctgtgtgccgagtacaccaagccagacagccggctgagcacaggcaccaccgtggaggatgtgcagaagatcaacaaggagctggagaagctgcagctgagtgatgaggagagcgtgtttgaggaggccctgatgagcccagacacccgctaccgctgccacaggaaggacagcctgcctgatgctgacctggccagctgtggcagcctgagccagagcagcgccagcttcttcacccccaggagcaccagaaatgatgagctgctgagtgacctgaccaggaccccacctccacccagcagcaccttccccaaggccagcagcgagagcagctacctgagcatcctgcccaagaccccagagggcatcagcgaggagcagaggagccaggagctggccgccatggaggagacccgcatcgtcatcctgaacaacctggaggagctgaagcagaagatcaaggacatcaatgaccagatggatgagagcttccgggagctggacatggagtgtgccctgctggatggagagcagaagtctgagaccacagagctgatgaaggagaaggagatcctggaccacctgaacaggaagattgctgagctggagaagaacatcgtgggggagaagaccaaggatgctgacctgctggatgtggagagcaagcactttgaggacctggagttccagcagctggagcacgagagccggctggatgaggagaaggagaacctgacccagcagctgctgcgggaggtggccgagtaccagaggaacatcgtgtccaggaaggagaagatcagcgccctgaagaagcaggccaaccacatcgtgcagcaggcccagcgggagcaggaccactttgtgaaggagaagaacaacctgatcatgatgctgcagcgggagaaggagaacctgtgcaacctggagaagaagtacagcagcctgagcggcggcaagggcttccctgtgaaccccaacaccctgaaggagggctacatctctgtgaatgagatcaatgagccctgtggcaacagcaccaacctgagccccagcacccagtttcctgcagatgctgatgctgtggccacagagcccgccacagctgtgctggccagccagccccagagcaaggagcacttccagggcccctag

SEQ ID NO: 36891 - DNA, 3714 bp, Artificial Sequence
  Description of Artificial Sequence: Synthetic coding sequence
atggaggaggaggacaccaagcgggaggtgcccaaggaggatggagtgggagatgtgcagcactttgacagcagcaagatcatggaggagcacagctacatccagaaggagctggacctgcagaatggcagcctggaggaggacagcgtggtgcacagcgtggagaatgacagccagaacatgatggagagcctgagccccaagaagtacagcagcagcctgcgcttcaaggccaatggagactacagcggcagctacctgaccctgagccagcctgtgcctgccaagaggagccccagccccctgggcacctctgtgcgcagcagccccagcctggccaagatccagggcagcaagcagttctcctatgatggaacagacaagaacatccccatgaagccacccacccccctgctgaacaccaccagcagcctgagcggctaccccctgggccgggctgactttgaccactacacaggccgggacagcgagcgggccctgcggctgtctgagaagccaccctacagcaagtacagcagccgccacaagagccatgacaacgtgtacagcctgggcggcctggagggcaggaaggccagcggcagcctgctggccatgtggaatggcagcagcctgagtgatgctggccccccacccatcagccgctctggagctgcctccatgcccagcagccccaagcaggccaggaagatgagcatccaggacagcctggccctgcagcccaagctgaccaggcacaaggagctggccagcgagaacatcaacctgcggaccaggaagtacagcagcagcagcctgagccacatgggcgcctacagccgcagcctgccccggctgtaccgggccacagagaaccagctgacccccctgagcctgccccccaggaacagcctgggcaacagcaagaggaccaagctgggggagaaggacctgccccacagcgtgattgacaatgacaactacctgaacttcagcagcctgagcagcggggccctgccctacaagaccagcgccagcgagggcaacccctacgtgagcagcaccctgtctgtgcctgccagcccccgggtggccaggaagatgctgctggccagcaccagcagctgtgccagtgatgactttgaccaggccagctatgtgggcaccaaccccagccacagcctgctggccggggagagtgacagagtgtttgccaccaggaggaacttcagctgtggctctgtggagtttgatgaggccgacctggagagcctgcggcaggccagcggcaccccccagcctgccctgcgggagaggaagagcagcatcagcagcatcagcggcagagatgacctgatggactaccaccggcggcagcgggaggagcggctgcgggagcaggagatggagcggctggagcggcagaggctggagaccatcctgagcctgtgtgccgagtacaccaagccagacagccggctgagcacaggcaccaccgtggaggatgtgcagaagatcaacaaggagctggagaagctgcagctgagtgatgaggagagcgtgtttgaggaggccctgatgagcccagacacccgctaccgctgccacaggaaggacagcctgcctgatgctgacctggccagctgtggcagcctgagccagagcagcgccagcttcttcacccccaggagcaccagaaatgatgagctgctgagtgacctgaccaggaccccacctccacccagcagcaccttccccaaggccagcagcgagagcagctacctgagcatcctgcccaagaccccagagggcatcagcgaggagcagaggagccaggagctggccgccatggaggagacccgcatcgtcatcctgaacaacctggaggagctgaagcagaagatcaaggacatcaatgaccagatggatgagagcttccgggagctggacatggagtgtgccctgctggatggagagcagaagtctgagaccacagagctgatgaaggagaaggagatcctggaccacctgaacaggaagattgctgagctggagaagaacatcgtgggggagaagaccaaggatgctgacctgctggatgtggagagcaagcactttgaggacctggagttccagcagctggagcacgagagccggctggatgaggagaaggagaacctgacccagcagctgctgcgggaggtggccgagtaccagaggaacatcgtgtccaggaaggagaagatcagcgccctgaagaagcaggccaaccacatcgtgcagcaggcccagcgggagcaggaccactttgtgaaggagaagaacaacctgatcatgatgctgcagcgggagaaggagaacctgtgcaacctggagaagaagtacagcagcctgagcggcggcaagggcttccctgtgaaccccaacaccctgaaggagggctacatctctgtgaatgagatcaatgagccctgtggcaacagcaccaacctgagccccagcacccagtttcctgcagatgctgatgctgtggccacagagcccgccacagctgtgctggccagccagccccagagcaaggagcacttccgcagcctggaggagaggaagaagcagcacaaggagggcctgtacctgagtgacaccctgcccaggaagaagaccaccagcagcatcagcccccacttcagcagcgccaccatgggccgcagcatcacccccaaggcccacctgcccctgggccagagcaacagctgtggctctgtgctgccccccagcctggccgccatggccaaggacagcgagagcaggaggatgctgcggggctacaaccaccagcagatgtctgagggccaccggcagaagtctgagttctacaacagaacagccagcgagagcaatgtgtacctgaacagcttccactacccagaccacagctacaaggaccaggcctttgacaccctgagcctggacagcagtgacagcatggagaccagcatcagcgcctgcagcccagacaacatcagcagcgccagcaccagcaacatcgccagaattgaggagatggagcggctgctgaagcaggcccatgctgagaagacccggctgctggagagccgggagcgggagatggaggccaagaagagggccctggaggaggagaagagaagaagagagatcctggagaagaggctgcaggaggagaccagccagaggcagaagctgattgagaaggaggtgaagatccgggagcggcagagggcccaggcccggcccctgacccgctacctgcctgtgaggaaggaggactttgacctgcggagccacgtggagacagctggccacaacatcgacacctgctaccacgtgtccatcacagagaagacctgccggggcttcctgatcaagatgggcggcaagatcaagacctggaagaagcgctggtttgtgtttgacaggaacaagaggaccttctcctactatgctgacaagcatgagaccaagctgaagggcgtcatctacttccaggccatcgaggaggtgtactatgaccacctgaagaatgccaacaagagccccaaccccctgctgaccttctctgtgaagacccatgaccgcatctactacatggtggcccccagccctgaggccatgaggatctggatggatgtgattgtgactggagctgagggctacacccacttcctgctgtag

SEQ ID NO: 36892 - DNA, 3762 bp, Artificial Sequence
  Description of Artificial Sequence: Synthetic coding sequence
atggaggagcacagctacatccagaaggagctggacctgcagaatggcagcctggaggaggacagcgtggtgcacagcgtggagaatgacagccagaacatgatggagagcctgagccccaagaagtacagcagcagcctgcgcttcaaggccaacggggactacagcggcagctacctgaccctgagccagcctgtgcctgccaagaggagccccagccccctgggcacctctgtgcgcagcagccccagcctggccaagatccagggcagcaagcagttctcctatgatggaacagacaagaacatccccatgaagccacccacccccctgctgaacaccaccagcagcctgagcggctaccccctgggccgggctgactttgaccactacacaggccgggacagcgagcgggccctgcggctgtctgagaagccaccctacagcaagtacagcagccgccacaagagccatgacaacgtgtacagcctgggcggcctggagggcaggaaggccagcggcagcctgctggccatgtggaatggcagcagcctgagtgatgctggccccccacccatcagccgcagcggggccgcctccatgcccagcagccccaagcaggccaggaagatgagcatccaggacagcctggccctgcagcccaagctgaccaggcacaaggagctggccagcgagaacatcaacctgcggaccaggaagtacagcagcagcagcctgagccacatgggcgcctacagccgcagcctgccccggctgtaccgggccacagagaaccagctgacccccctgagcctgcccccaagaaacagcctgggcaacagcaagaggaccaagctgggggagaaggacctgccccacagcgtcatcgacaatgacaactacctgaacttcagcagcctgagcagcggggccctgccctacaagaccagcgccagcgagggcaacccctacgtgagcagcaccctgtctgtgcctgccagcccccgggtggccaggaagatgctgctggccagcaccagcagctgtgccagtgatgactttgaccaggccagctatgtgggcaccaaccccagccacagcctgctggccggggagagtgacagagtgtttgccaccaggaggaacttcagctgtggctctgtggagtttgatgaagctgacctggagagcctgcggcaggccagcggcaccccccagcctgccctgcgggagaggaagagcagcatcagcagcatcagcggcagagatgacctgatggactaccaccggcggcagcgggaggagcggctgcgggagcaggagatggagcggctggagcggcagaggctggagaccatcctgagcctgtgtgccgagtacaccaagccagacagccggctgagcacaggcaccaccgtggaggatgtgcagaagatcaacaaggagctggagaagctgcagctgagtgatgaggagagcgtgtttgaggaggccctgatgagcccagacacccgctaccgctgccacaggaaggacagcctgcctgatgctgacctggccagctgtggcagcctgagccagagcagcgccagcttcttcacccccaggagcaccagaaatgatgagctgctgagtgacctgaccaggaccccacctccacccagcagcaccttccccaaggccagcagcgagagcagctacctgagcatcctgcccaagaccccagagggcatcagcgaggagcagaggagccaggagctggccgccatggaggagaccagaattgtcatcctgaacaacctggaggagctgaagcagaagatcaaggacatcaatgaccagatggatgagagcttccgggagctggacatggagtgtgccctgctggatggagagcagaagtctgagaccacagagctgatgaaggagaaggagatcctggaccacctgaacaggaagattgctgagctggagaagaacatcgtgggggagaagaccaaggagaaggtgaagctggatgctgagcgggagaagctggagcggctgcaggagctgtacagcgagcagaagacccagctggacaactgcccagagagcatgagggagcagctgcagcagcagctgaagagagatgctgacctgctggatgtggagagcaagcactttgaggacctggagttccagcagctggagcacgagagccggctggatgaggagaaggagaacctgacccagcagctgctgcgggaggtggccgagtaccagaggaacatcgtgtccaggaaggagaagatcagcgccctgaagaagcaggccaaccacatcgtgcagcaggcccagcgggagcaggaccactttgtgaaggagaagaacaacctgatcatgatgctgcagcgggagaaggagaacctgtgcaacctggagaagaagtacagcagcctgagcggcggcaagggcttccctgtgaaccccaacaccctgaaggagggctacatctctgtgaatgagatcaatgagccctgtggcaacagcaccaacctgagccccagcacccagtttcctgcagatgctgatgctgtggccacagagcccgccacagctgtgctggccagccagccccagagcaaggagcacttccgcagcctggaggagaggaagaagcagcacaaggagggcctgtacctgagtgacaccctgcccaggaagaagaccaccagcagcatcagcccccacttcagcagcgccaccatgggccgcagcatcacccccaaggcccacctgcccctgggccagagcaacagctgtggctctgtgctgccccccagcctggccgccatggccaaggacagcgagagcaggaggatgctgcggggctacaaccaccagcagatgtctgagggccaccggcagaagtctgagttctacaacagaacagccagcgagagcaatgtgtacctgaacagcttccactacccagaccacagctacaaggaccaggcctttgacaccctgagcctggacagcagtgacagcatggagaccagcatcagcgcctgcagcccagacaacatcagcagcgccagcaccagcaacatcgccagaattgaggagatggagcggctgctgaagcaggcccatgctgagaagacccggctgctggagagccgggagcgggagatggaggccaagaagagggccctggaggaggagaagagaagaagagagatcctggagaagaggctgcaggaggagaccagccagaggcagaagctgattgagaaggaggtgaagatccgggagcggcagagggcccaggcccggcccctgacccgctacctgcctgtgaggaaggaggactttgacctgcggagccacgtggagacagctggccacaacatcgacacctgctaccacgtgtccatcacagagaagacctgccggggcttcctgatcaagatgggcggcaagatcaagacctggaagaagcgctggtttgtgtttgacaggaacaagaggaccttctcctactatgctgacaagcatgagaccaagctgaagggcgtcatctacttccaggccatcgaggaggtgtactatgaccacctgaagaatgccaacaagagccccaaccccctgctgaccttctctgtgaagacccatgaccgcatctactacatggtggcccccagccctgaggccatgaggatctggatggatgtgattgtgactggagctgagggctacacccacttcctgctgtag

SEQ ID NO: 36893 - DNA, 3633 bp, Artificial Sequence
  Description of Artificial Sequence: Synthetic coding sequence
atggaggagcacagctacatccagaaggagctggacctgcagaatggcagcctggaggaggacagcgtggtgcacagcgtggagaatgacagccagaacatgatggagagcctgagccccaagaagtacagcagcagcctgcgcttcaaggccaacggggactacagcggcagctacctgaccctgagccagcctgtgcctgccaagaggagccccagccccctgggcacctctgtgcgcagcagccccagcctggccaagatccagggcagcaagcagttctcctatgatggaacagacaagaacatccccatgaagccacccacccccctgctgaacaccaccagcagcctgagcggctaccccctgggccgggctgactttgaccactacacaggccgggacagcgagcgggccctgcggctgtctgagaagccaccctacagcaagtacagcagccgccacaagagccatgacaacgtgtacagcctgggcggcctggagggcaggaaggccagcggcagcctgctggccatgtggaatggcagcagcctgagtgatgctggccccccacccatcagccgcagcggggccgcctccatgcccagcagccccaagcaggccaggaagatgagcatccaggacagcctggccctgcagcccaagctgaccaggcacaaggagctggccagcgagaacatcaacctgcggaccaggaagtacagcagcagcagcctgagccacatgggcgcctacagccgcagcctgccccggctgtaccgggccacagagaaccagctgacccccctgagcctgcccccaagaaacagcctgggcaacagcaagaggaccaagctgggggagaaggacctgccccacagcgtcatcgacaatgacaactacctgaacttcagcagcctgagcagcggggccctgccctacaagaccagcgccagcgagggcaacccctacgtgagcagcaccctgtctgtgcctgccagcccccgggtggccaggaagatgctgctggccagcaccagcagctgtgccagtgatgactttgaccaggccagctatgtgggcaccaaccccagccacagcctgctggccggggagagtgacagagtgtttgccaccaggaggaacttcagctgtggctctgtggagtttgatgaagctgacctggagagcctgcggcaggccagcggcaccccccagcctgccctgcgggagaggaagagcagcatcagcagcatcagcggcagagatgacctgatggactaccaccggcggcagcgggaggagcggctgcgggagcaggagatggagcggctggagcggcagaggctggagaccatcctgagcctgtgtgccgagtacaccaagccagacagccggctgagcacaggcaccaccgtggaggatgtgcagaagatcaacaaggagctggagaagctgcagctgagtgatgaggagagcgtgtttgaggaggccctgatgagcccagacacccgctaccgctgccacaggaaggacagcctgcctgatgctgacctggccagctgtggcagcctgagccagagcagcgccagcttcttcacccccaggagcaccagaaatgatgagctgctgagtgacctgaccaggaccccacctccacccagcagcaccttccccaaggccagcagcgagagcagctacctgagcatcctgcccaagaccccagagggcatcagcgaggagcagaggagccaggagctggccgccatggaggagaccagaattgtcatcctgaacaacctggaggagctgaagcagaagatcaaggacatcaatgaccagatggatgagagcttccgggagctggacatggagtgtgccctgctggatggagagcagaagtctgagaccacagagctgatgaaggagaaggagatcctggaccacctgaacaggaagattgctgagctggagaagaacatcgtgggggagaagaccaaggatgctgacctgctggatgtggagagcaagcactttgaggacctggagttccagcagctggagcacgagagccggctggatgaggagaaggagaacctgacccagcagctgctgcgggaggtggccgagtaccagagaaatattgtgtccaggaaggagaagatcagcgccctgaagaagcaggccaaccacatcgtgcagcaggcccagcgggagcaggaccactttgtgaaggagaagaacaacctgatcatgatgctgcagcgggagaaggagaacctgtgcaacctggagaagaagtacagcagcctgagcggcggcaagggcttccctgtgaaccccaacaccctgaaggagggctacatctctgtgaatgagatcaatgagccctgtggcaacagcaccaacctgagccccagcacccagtttcctgcagatgctgatgctgtggccacagagcccgccacagctgtgctggccagccagccccagagcaaggagcacttccgcagcctggaggagaggaagaagcagcacaaggagggcctgtacctgagtgacaccctgcccaggaagaagaccaccagcagcatcagcccccacttcagcagcgccaccatgggccgcagcatcacccccaaggcccacctgcccctgggccagagcaacagctgtggctctgtgctgccccccagcctggccgccatggccaaggacagcgagagcaggaggatgctgcggggctacaaccaccagcagatgtctgagggccaccggcagaagtctgagttctacaacagaacagccagcgagagcaatgtgtacctgaacagcttccactacccagaccacagctacaaggaccaggcctttgacaccctgagcctggacagcagtgacagcatggagaccagcatcagcgcctgcagcccagacaacatcagcagcgccagcaccagcaacatcgcccgcatcgaggagatggagcggctgctgaagcaggcccacgccgagaagacccggctgctggagagccgggagcgggagatggaggccaagaagagggccctggaggaggagaagagaagaagagagatcctggagaagaggctgcaggaggagaccagccagaggcagaagctgattgagaaggaggtgaagatccgggagcggcagagggcccaggcccggcccctgacccgctacctgcctgtgaggaaagaagattttgacctgcggagccacgtggagacagctggccacaacatcgacacctgctaccacgtgtccatcacagagaagacctgccggggcttcctgatcaagatgggcggcaagatcaagacctggaagaagcgctggtttgtgtttgacaggaacaagaggaccttctcctactatgctgacaagcatgagaccaagctgaagggcgtcatctacttccaggccatcgaggaggtgtactatgaccacctgaagaatgccaacaagagccccaaccccctgctgaccttctctgtgaagacccatgaccgcatctactacatggtggcccccagccctgaggccatgaggatctggatggatgtgattgtgactggagctgagggctacacccacttcctgctgtag

SEQ ID NO: 36894 - DNA, 3762 bp, Artificial Sequence; identical to SEQ ID NO: 36892
  Description of Artificial Sequence: Synthetic coding sequence

SEQ ID NO: 36895 - DNA, 3633 bp, Artificial Sequence; identical to SEQ ID NO: 36893
  Description of Artificial Sequence: Synthetic coding sequence

SEQ ID NO: 36896 - DNA, 3348 bp, Artificial Sequence
  Description of Artificial Sequence: Synthetic coding sequence
atggaggagcacagctacatccagaaggagctggacctgcagaatggcagcctggaggaggacagcgtggtgcacagcgtggagaatgacagccagaacatgatggagagcctgagccccaagaagtacagcagcagcctgcgcttcaaggccaacggggactacagcggcagctacctgaccctgagccagcctgtgcctgccaagaggagccccagccccctgggcacctctgtgcgcagcagccccagcctggccaagatccagggcagcaagcagttctcctatgatggaacagacaagaacatccccatgaagccacccacccccctgctgaacaccaccagcagcctgagcggctaccccctgggccgggctgactttgaccactacacaggccgggacagcgagcgggccctgcggctgtctgagaagccaccctacagcaagtacagcagccgccacaagagccatgacaacgtgtacagcctgggcggcctggagggcaggaaggccagcggcagcctgctggccatgtggaatggcagcagcctgagtgatgctggccccccacccatcagccgcagcggggccgcctccatgcccagcagccccaagcaggccaggaagatgagcatccaggacagcctggccctgcagcccaagctgaccaggcacaaggagctggccagcgagaacatcaacctgcggaccaggaagtacagcagcagcagcctgagccacatgggcgcctacagccgcagcctgccccggctgtaccgggccacagagaaccagctgacccccctgagcctgcccccaagaaacagcctgggcaacagcaagaggaccaagctgggggagaaggacctgccccacagcgtcatcgacaatgacaactacctgaacttcagcagcctgagcagcggggccctgccctacaagaccagcgccagcgagggcaacccctacgtgagcagcaccctgtctgtgcctgccagcccccgggtggccaggaagatgctgctggccagcaccagcagctgtgccagtgatgactttgaccaggccagctatgtgggcaccaaccccagccacagcctgctggccggggagagtgacagagtgtttgccaccaggaggaacttcagctgtggctctgtggagtttgatgaagctgacctggagagcctgcggcaggccagcggcaccccccagcctgccctgcgggagaggaagagcagcatcagcagcatcagcggcagagatgacctgatggactaccaccggcggcagcgggaggagcggctgcgggagcaggagatggagcggctggagcggcagaggctggagaccatcctgagcctgtgtgccgagtacaccaagccagacagccggctgagcacaggcaccaccgtggaggatgtgcagaagatcaacaaggagctggagaagctgcagctgagtgatgaggagagcgtgtttgaggaggccctgatgagcccagacacccgctaccgctgccacaggaaggacagcctgcctgatgctgacctggccagctgtggcagcctgagccagagcagcgccagcttcttcacccccaggagcaccagaaatgatgagctgctgagtgacctgaccaggaccccacctccacccagcagcaccttccccaaggccagcagcgagagcagctacctgagcatcctgcccaagaccccagagggcatcagcgaggagcagaggagccaggagctggccgccatggaggagaccagaattgtcatcctgaacaacctggaggagctgaagcagaagatcaaggacatcaatgaccagatggatgagagcttccgggagctggacatggagtgtgccctgctggatggagagcagaagtctgagaccacagagctgatgaaggagaaggagatcctggaccacctgaacaggaagattgctgagctggagaagaacatcgtgggggagaagaccaaggatgctgacctgctggatgtggagagcaagcactttgaggacctggagttccagcagctggagcacgagagccggctggatgaggagaaggagaacctgacccagcagctgctgcgggaggtggccgagtaccagagaaatattgtgtccaggaaggagaagatcagcgccctgaagaagcaggccaaccacatcgtgcagcaggcccagcgggagcaggaccactttgtgaaggagaagaacaacctgatcatgatgctgcagcgggagaaggagaacctgtgcaacctggagaagaagtacagcagcctgagcggcggcaagggcttccctgtgaaccccaacaccctgaaggagggctacatctctgtgaatgagatcaatgagccctgtggcaacagcaccaacctgagccccagcacccagtttcctgcagatgctgatgctgtggccacagagcccgccacagctgtgctggccagccagccccagagcaaggagcacttccgcagcctggaggagaggaagaagcagcacaaggagggcctgtacctgagtgacaccctgcccaggaagaagaccaccagcagcatcagcccccacttcagcagcgccaccatgggccgcagcatcacccccaaggcccacctgcccctgggccagagcaacagctgtggctctgtgctgccccccagcctggccgccatggccaaggacagcgagagcaggaggatgctgcggggctacaaccaccagcagatgtctgagggccaccggcagaagtctgagttctacaacagaacagccagcgagagcaatgtgtacctgaacagcttccactacccagaccacagctacaaggaccaggcctttgacaccctgagcctggacagcagtgacagcatggagaccagcatcagcgcctgcagcccagacaacatcagcagcgccagcaccagcaacatcgcccgcatcgaggagatggagcggctgctgaagcaggcccacgccgagaagacccggctgctggagagccgggagcgggagatggaggccaagaagagggccctggaggaggagaagagaagaagagagatcctggagaagaggctgcaggaggagaccagccagaggcagaagctgattgagaaggaggtgaagatccgggagcggcagagggcccaggcccggcccctgacccgctacctgcctgtgaggaaagaagattttgacctgcggagccacgtggagacagctggccacaacatcgacacctgctaccacgtgtccatcacagagaagacctgccggggcttcctgatcaagatgggcggcaagatcaagtag

SEQ ID NO: 36897 - DNA, 5616 bp, Artificial Sequence
  Description of Artificial Sequence: Synthetic coding sequence
atgcccagcgtgtgcctgctgctgctgctcttcctggccgtgggcggggccctgggcaaccggcccttccgggcctttgtggtgacagacaccaccctgacccacctggccgtgcaccgggtgactggagaggtgtttgtgggcgctgtgaacagagtcttcaagctggcccccaacctgacagagctgcgggcccacgtgacaggccctgtggaggacaatgcccgctgctaccccccacccagcatgagggtgtgtgcccaccggctggcccctgtggacaacatcaacaagctgctgctgattgattatgctgcccggcggctggtggcctgtggcagcatctggcagggcatctgccagttcctgcggctggatgacctcttcaagctgggggagccccaccacaggaaggagcactacctgagcggggcccaggagccagacagcatggccggcgtgattgtggagcagggccagggccccagcaagctgtttgtgggcacagctgtggatggcaagtctgagtacttccccaccctgagcagcaggaagctgatcagtgatgaggacagcgctgacatgttcagcctggtgtaccaggatgaatttgtgagcagccagatcaagatccccagcgacaccctgagcctgtacccagcctttgacatctactacatctacggctttgtgtctgccagctttgtgtacttcctgaccctgcagctggacacccagcagaccctgctggacacagctggggagaagttcttcaccagcaagatcgtgaggatgtgtgccggggacagcgagttctacagctatgtggagttccccatcggctgctcctggaggggcgtggagtaccgcctggtgcagagcgcccacctggccaagccaggcctgctgctggcccaggccctgggcgtgcctgcagatgaagatgtgctcttcaccatcttcagccagggccagaagaacagagccagccccccccggcagaccatcctgtgcctcttcaccctgagcaacatcaatgcccacatcagaagacgcatccagagctgctacagaggagagggcaccctggccctgccctggctgctgaacaaggagctgccctgcatcaacacccccatgcagatcaatggaaacttctgtggcctggtgctgaaccagcccctgggcggcctgcacgtgattgagggcctgcccctgctggccgacagcacagatggcatggcctctgtggccgcctacacctaccggcagcacagcgtggtgttcatcggcaccaggagcggcagcctgaagaaggtgcgggtggatggcttccaggatgcccacctgtatgaaacagtgcctgtggtggatggcagccccatcctgcgggacctgctcttctccccagaccaccgccacatctacctgctgtctgagaagcaggtgtcccagctgcctgtggagacctgtgagcagtaccagagctgtgccgcctgcctgggcagcggggacccccactgcggctggtgtgtgctgcggcaccgctgctgccgggagggcgcctgcctgggcgccagcgccccccacggctttgctgaggagctgagcaaatgtgtgcaggtgcgggtgcggcccaacaacgtgtctgtgaccagccctggggtgcagctgactgtgaccctgcacaacgtgcctgacctgtctgctggggtgtcctgtgcctttgaggccgctgctgaaaatgaggccgtgctgctgcccagcggggagctgctgtgccccagccccagcctgcaggagctgcgggccctgacccggggccatggagccaccaggacagtgcggctgcagctgctgagcaaggagaccggggtgcgctttgctggagctgactttgtgttctacaactgcagcgtgctgcagagctgcatgagctgtgtgggcagcccctacccctgccactggtgcaagtaccgccacacctgcaccagccggccccatgaatgttccttccaggagggccgggtgcacagccctgagggctgcccagagatcctgcccagcggggacctgctgatccctgtgggcgtgatgcagcccctgaccctgcgggccaagaacctgccccagccccagagcggccagaagaactatgaatgtgtggtgcgggtgcagggccggcagcagagggtgcctgctgtgcgcttcaacagcagctctgtgcagtgccagaatgccagctacagctatgaaggagatgagcacggggacacagagctggacttctctgtggtgtgggatggagacttccccatcgacaagccacccagcttccgggccctgctgtacaagtgctgggcccagaggcccagctgtggcctgtgcctgaaggctgacccccgcttcaactgtggctggtgcatcagcgagcaccgctgccagctgcggacccactgcccagcccccaagaccaactggatgcacctgagccagaagggcacccgctgcagccacccccgcatcacccagatccaccccctggtgggccccaaggagggcggcaccagggtgaccatcgtgggggacaacctgggcctgctgagccgggaggtgggcctgcgggtggccggcgtgcgctgcaacagcatcccagctgagtacatctctgctgagcgcatcgtgtgtgagatggaggagagcctggtgcccagccccccacctggccctgtggagctgtgtgtgggggactgcagcgctgacttccgcacccagagcgagcaggtgtacagctttgtgacccccacctttgaccaggtgagccccagccggggccctgccagcggcggcacccggctgaccatcagcggcagcagcctggatgctggcagccgggtgacagtgacagtgcgggacagcgagtgccagtttgtgagaagagatgccaaggccatcgtgtgcatcagccccctgagcaccctgggccccagccaggcccccatcaccctggccatcgaccgggccaacatcagcagccctggcctcatctacacctacacccaggaccccaccgtgacccggctggagcccacctggagcatcatcaatggcagcacagccatcaccgtgtctggcacccacctgctgactgtgcaggagccccgggtgcgggccaagtaccggggcatcgagaccaccaacacctgccaggtgatcaatgacacagccatgctgtgcaaggcccctggcatcttcctgggccggccccagccccgggcccagggcgagcacccagatgaatttggcttcctgctggaccacgtgcagacagcccggagcctgaacagaagcagcttcacctactacccagaccccagctttgagcccctgggccccagcggcgtgctggatgtgaagccaggcagccacgtggtgctgaagggcaagaacctgatcccagctgctgctggcagcagccggctgaactacacagtgctgattggaggccagccctgcagcctgactgtgtctgacacccagctgctgtgtgacagccccagccagacaggccggcagcctgtgatggtgctggtgggcggcctggagttctggctgggcaccctgcacatctctgctgagcgggccctgaccctgcctgccatgatgggcctggccgccggcggcggcctgctgctgctggccatcacagctgtgctggtggcctacaagaggaagacccaggatgctgacaggaccctgaagaggctgcagctgcagatggacaacctggagagccgggtggccctggagtgcaaggaggcctttgctgagctgcagacagacatcaatgagctgaccaaccacatggatgaggtgcagatccccttcctggactaccgcacctatgctgtgcgggtgctcttccctggcatcgaggcccaccctgtgctgaaggagctggacaccccaccaaatgtggagaaggccctgcggctgtttggccagctgctgcacagccgggcctttgtgctgaccttcatccacaccctggaggcccagagcagcttctccatgagggaccggggcaccgtggccagcctgaccatggtggccctgcagagccggctggactatgccaccggcctgctgaagcagctgctggccgacctgattgagaagaacctggagagcaagaaccaccccaagctgctgctgcggaggacagagagcgtggccgagaagatgctgaccaactggttcaccttcctgctgcacaagttcctgaaggaatgtgccggggagcccctcttcctgctgtactgtgccatcaagcagcagatggagaagggccccattgatgccatcaccggggaggcccgctacagcctgtctgaggacaagctgatccggcagcagattgactacaagaccctgaccctgcactgtgtgtgcccagaaaatgaaggcagcgcccaggtgcctgtgaaggtgctgaactgtgacagcatcacccaggccaaggacaagctgctggacacagtgtacaagggcatcccctacagccagaggcccaaggccgaggacatggacctggagtggaggcagggccgcatgacccgcatcatcctgcaggatgaagatgtgaccaccaagattgaatgtgactggaagaggctgaacagcctggcccactaccaggtgacagatggcagcctggtggccctggtgcccaagcaggtgtctgcctacaacatggccaacagcttcaccttcaccaggagcctgagccgctatgagagcctgctgaggacagccagcagcccagacagcctgcggagccgggcccccatgatcaccccagaccaggagaccggcaccaagctgtggcacctggtgaagaaccacgaccacgccgaccaccgggagggggaccggggcagcaagatggtgtctgagatctacctgacccggctgctggccaccaagggcaccctgcagaagtttgtggatgacctgtttgaaacagtgttcagcacagcccaccggggcagcgccctgcccctggccatcaagtacatgtttgacttcctggatgagcaggccgaccagaggcagatcagtgaccctgatgtgcgccacacctggaagagcaactgcctgcccctgcgcttctgggtgaatgtcatcaagaacccccagtttgtgtttgacatccacaagaacagcatcacagatgcctgcctgtctgtggtggcccagaccttcatggacagctgcagcaccagcgagcaccggctgggcaaggacagccccagcaacaagctgctgtatgccaaggacatccccaactacaagtcctgggtggagcgctactacagagacatcgccaagatggccagcatcagtgaccaggacatggatgcctacctggtggagcagagccggctgcacgccagtgacttctctgtgctgagcgccctgaatgagctgtacttctacgtgaccaagtaccggcaggagatcctgacagccctggacagagatgccagctgcaggaagcacaagctgcggcagaagctggagcagatcatcagcctggtgtccagtgacagctag

SEQ ID NO: 36898 - DNA, 4707 bp, Artificial Sequence
  Description of Artificial Sequence: Synthetic coding sequence
atggaggtgtccaggaggaaggccccaccccggccccccaggcctgctgcccccctgcccctgctggcctacctgctggccctggccgcccctggaagaggagcagatgagcctgtgtggaggtctgagcaggccatcggggccatcgccgccagccaggaggatggagtgtttgtggccagcggcagctgcctggaccagctggactacagcctggagcacagcctgagccggctgtacagagaccaggccggcaactgcacagagcctgtgtccctggcccccccagcccggcccaggcctggcagcagcttcagcaagctgctgctgccctaccgggagggcgctgctggcctgggcggcctgctgctgaccggctggacctttgacagaggagcctgtgaggtgcggcccctgggcaacctgagcaggaacagcctgagaaatggaacagaggtggtgtcctgccacccccagggcagcacagctggggtggtgtacagagctggaagaaacaaccgctggtacctggccgtggccgccacctacgtgctgcctgagcctgagacagccagccgctgcaacccagctgccagtgaccatgacacagccatcgccctgaaggacacagagggccgcagcctggccacccaggagctgggccgcctgaagctgtgtgagggcgccggcagcctgcactttgtggatgccttcctgtggaatggcagcatctacttcccctactacccctacaactacaccagcggggccgccaccggctggcccagcatggccagaattgcccagagcacagaggtgctcttccagggccaggccagcctggactgtggccacggccacccagatggaagaaggctgctgctgagcagcagcctggtggaggccctggatgtgtgggccggggtcttctctgctgctgctggggagggccaggagcggcgcagccccaccaccacagccctgtgcctcttcaggatgtctgagatccaggcccgggccaagagggtgtcctgggacttcaagacagctgagagccactgcaaggagggggaccagcctgagcgggtgcagcccatcgccagcagcaccctcatccacagcgacctgacctctgtgtatggcaccgtggtgatgaacagaacagtgctcttcctgggcactggagatggccagctgctgaaggtgatcctgggggagaacctgaccagcaactgcccagaggtgatctatgagatcaaggaggagacccctgtgttctacaagctggtgcctgaccctgtgaagaacatctacatctacctgacagctgggaaggaggtgcggcgcatccgggtggccaactgcaacaagcacaagagctgcagtgaatgtctgacagccacagacccccactgcggctggtgccacagcctgcagcgctgcaccttccagggcgactgtgtgcacagcgagaacctggagaactggctggacatcagcagcggggccaagaagtgccccaagatccagatcatccgcagcagcaaggagaagaccaccgtgaccatggtgggcagcttcagccccaggcacagcaagtgcatggtgaagaatgtggacagcagccgggagctgtgccagaacaagagccagcccaacagaacctgcacctgcagcatccccacccgggccacctacaaggatgtgtctgtggtgaatgtgatgttctcctttggctcctggaacctgagtgaccgcttcaacttcaccaactgcagcagcctgaaggaatgtcctgcctgtgtggagaccggctgtgcctggtgcaagagcgcccggcgctgcatccaccccttcaccgcctgtgaccccagcgactatgaaagaaaccaggagcagtgccctgtggccgtggagaagaccagcggcggcggccggcccaaggaaaataaaggaaacagaaccaaccaggccctgcaggtgttctacatcaagagcattgagccccagaaggtgtccaccctgggcaagagcaatgtgattgtgactggagccaacttcacccgggccagcaacatcaccatgatcctgaagggcaccagcacctgtgacaaggatgtgatccaggtgagccacgtgctgaatgacacccacatgaagttcagcctgcccagcagcaggaaggagatgaaggatgtgtgcatccagtttgatggcggcaactgcagctctgtgggcagcctgagctacatcgccctgccccactgcagcctcatcttccctgccaccacctggatcagcggcggccagaacatcaccatgatgggcaggaactttgatgtgattgacaacctgatcatcagccatgagctgaagggcaacatcaacgtgtctgagtactgtgtggccacctactgcggcttcctggcccccagcctgaagagcagcaaggtgaggaccaacgtgacagtgaagctgcgggtgcaggacacctacctggactgtggcaccctgcagtaccgggaggacccccgcttcaccggctacagagtggagagcgaggtggacacagagctggaggtgaagatccagaaggaaaatgacaacttcaacatcagcaagaaggacatcgagatcaccctcttccatggagaaaatggccagctgaactgcagctttgagaacatcaccaggaaccaggacctgaccaccatcctgtgcaagatcaagggcatcaagacagccagcaccatcgccaacagcagcaagaaggtgcgggtgaagctgggcaacctggagctgtatgtggagcaggagagcgtgcccagcacctggtacttcctgattgtgctgcctgtgctgctggtgattgtcatctttgctgctgtgggcgtgaccaggcacaagagcaaggagctgagcaggaagcagagccagcagctggagctgctggagagcgagctgaggaaggagatcagagatggctttgctgagctgcagatggacaagctggatgtggtggacagctttggcaccgtgcccttcctggactacaagcactttgccctgcggaccttcttccctgagagcggcggcttcacccacatcttcacagaggacatgcacaacagagatgccaatgacaagaatgaaagcctgacagccctggatgccctgatctgcaacaagagcttcctggtgaccgtcatccacaccctggagaagcagaagaacttctctgtgaaggaccgctgcctgtttgccagcttcctgaccatcgccctgcagaccaagctggtgtacctgaccagcatcctggaggtgctgacccgggacctgatggagcagtgcagcaacatgcagcccaagctgatgctgcggaggacagaatctgtggtggagaagctgctgaccaactggatgtctgtgtgcctgagcggcttcctgcgggagaccgtgggggagcccttctacctgctggtgaccaccctgaaccagaagatcaacaagggccctgtggatgtgatcacctgcaaggccctgtacaccctgaatgaagactggctgctgtggcaggtgcctgagttcagcacagtggccctgaatgtggtgtttgagaagatcccagaaaatgaatctgcagatgtgtgcaggaacatctctgtgaatgtgctggactgtgacaccatcggccaggccaaggagaagatcttccaggccttcctgagcaagaatggcagcccctacggcctgcagctgaatgagatcggcctggagctgcagatgggcacccggcagaaggagctgctggacatcgacagcagcagcgtcatcctggaggatggcatcaccaagctgaacaccatcggccactatgagatcagcaatggcagcaccatcaaggtgttcaagaagatcgccaacttcaccagtgatgtggagtacagtgatgaccactgccacctgatcctgcctgattctgaggccttccaggatgtgcagggcaagaggcaccggggcaagcacaagttcaaggtgaaggagatgtacctgaccaagctgctgagcaccaaggtggccatccacagcgtgctggagaagctgttccgcagcatctggagcctgcccaacagccgggccccctttgccatcaagtacttctttgacttcctggatgcccaggccgagaacaagaagatcacagatcctgatgtggtgcacatctggaagaccaacagcctgcccctgcgcttctgggtgaacatcctgaagaacccccagtttgtgtttgacatcaagaagaccccccacattgatggctgcctgtctgtgattgcccaggccttcatggatgccttcagcctgacagagcagcagctgggcaaggaggcccccaccaacaagctgctgtatgccaaggacatccccacctacaaggaggaggtgaagagctactacaaggccatccgggacctgccccccctgagcagcagcgagatggaggagttcctgacccaggagagcaagaagcatgaaaatgagttcaatgaggaggtggccctgacagagatctacaagtacatcgtgaagtactttgatgagatcctgaacaagctggagcgggagcggggcctggaggaggcccagaagcagctgctgcacgtgaaggtgctgtttgatgagaagaagaagtgcaagtggatgtag

SEQ ID NO: 36899 - DNA, 1848 bp, Artificial Sequence
  Description of Artificial Sequence: Synthetic coding sequence
atgcagcacctgtgcctgctggccgctgtgggcgtgaccaggcacaagagcaaggagctgagcaggaagcagagccagcagctggagctgctggagagcgagctgaggaaggagatcagagatggctttgctgagctgcagatggacaagctggatgtggtggacagctttggaacagtgcccttcctggactacaagcactttgccctgcggaccttcttccctgagagcggcggcttcacccacatcttcacagaggacatgcacaacagagatgccaatgacaagaatgaaagcctgacagccctggatgccctgatctgcaacaagagcttcctggtgaccgtcatccacaccctggagaagcagaagaacttctctgtgaaggaccgctgcctgtttgccagcttcctgaccatcgccctgcagaccaagctggtgtacctgaccagcatcctggaggtgctgacccgggacctgatggagcagtgcagcaacatgcagcccaagctgatgctgcggaggacagagagcgtggtggagaagctgctgaccaactggatgtctgtgtgcctgagcggcttcctgcgggagaccgtgggggagcccttctacctgctggtgaccaccctgaaccagaagatcaacaagggccctgtggatgtgatcacctgcaaggccctgtacaccctgaatgaagactggctgctgtggcaggtgcctgagttcagcacagtggccctgaatgtggtgtttgagaagatcccagaaaatgaatctgcagatgtgtgcaggaacatctctgtgaatgtgctggactgtgacaccatcggccaggccaaggagaagatcttccaggccttcctgagcaagaatggcagcccctacggcctgcagctgaatgaaattggcctggagctgcagatgggcacccggcagaaggagctgctggacatcgacagcagcagcgtcatcctggaggatggcatcaccaagctgaacaccatcggccactatgagatcagcaatggcagcaccatcaaggtgttcaagaagatcgccaacttcaccagtgatgtggagtacagtgatgaccactgccacctgatcctgcctgacagcgaggccttccaggatgtgcagggcaagaggcaccggggcaagcacaagttcaaggtgaaggagatgtacctgaccaagctgctgagcaccaaggtggccatccacagcgtgctggagaagctgttccgcagcatctggagcctgcccaacagccgggccccctttgccatcaagtacttctttgacttcctggatgcccaggccgagaacaagaagatcacagatcctgatgtggtgcacatctggaagaccaacagcctgcccctgcgcttctgggtgaacatcctgaagaacccccagtttgtgtttgacatcaagaagaccccccacattgatggctgcctgagcgtcatcgcccaggccttcatggatgccttcagcctgacagagcagcagctgggcaaggaggcccccaccaacaagctgctgtatgccaaggacatccccacctacaaggaggaggtgaagagctactacaaggccatccgggacctgccccccctgagcagcagcgagatggaggagttcctgacccaggagagcaagaagcatgaaaatgagttcaatgaggaggtggccctgacagagatctacaagtacatcgtgaagtactttgatgagatcctgaacaagctggagcgggagcggggcctggaggaggcccagaagcagctgctgcacgtgaaggtgctgtttgatgagaagaagaagtgcaagtggatgtag

SEQ ID NO: 36900 - DNA, 1593 bp, Artificial Sequence
  Description of Artificial Sequence: Synthetic coding sequence
atgggccgcctgctgcgggccgcccggctgccccccctgctgagccccctgctgctgctgctggtgggcggggccttcctgggcgcctgtgtggccggcagtgatgagcccggccctgagggcctgaccagcaccagcctgctggacctgctgctgcccaccggcctggagcccctggacagcgaggagcccagcgagaccatgggcctgggcgccggcctgggcgcccctggcagcggcttccccagtgaagaaaatgaggagagccgcatcctgcagcccccccagtacttctgggaggaggaggaggagctgaatgacagcagcctggacctgggccccacagctgactatgtgtttcctgacctgacagagaaggccggcagcattgaggacaccagccaggcccaggagctgcccaacctgcccagccccctgcccaagatgaacctggtggagcccccctggcacatgccaccccgggaggaggaggaggaggaggaggaggaggaggagcgggagaaggaggaggtggagaagcaggaggaggaggaggaggaggagctgctgcctgtgaatggcagccaggaggaggccaagccccaggtgcgggacttcagcctgaccagcagcagccagacccctggggccaccaagagcagacatgaagattctggggaccaggccagcagtggagtggaggtggagagctccatgggccccagcctgctgctgcccagcgtgacccccaccaccgtgacccctggggaccaggacagcaccagccaggaggccgaggccaccgtgctgcctgctgctggcctgggcgtggagtttgaggccccccaggaggccagcgaggaggccacagctggagctgctggcctgagcggccagcacgaggaggtgcctgccctgcccagcttcccccagaccacagcccccagcggggctgagcacccagatgaggaccccctgggcagcaggaccagcgccagcagccccccccagctgctggccctggtggaggaggtgctgcccaggcatggcagcggccaccacggggcctggcacatcagcctgagcaagcccagcgagaaggagcagcacctgctgatgaccctggtgggggagcagggcgtggtgcccacccaggatgtgctgtccatgctgggggacatcagaagaagcctggaggagatcggcatccagaactacagcaccaccagcagctgccaggcccgggccagccaggtgcggagtgactatggcaccctgtttgtggtgctggtggtgattggagccatctgcatcatcatcatcgccctgggcctgctgtacaactgctggcagaggcggctgcccaagctgaagcacgtgagccacggggaggagctgcgctttgtggagaatggctgccacgacaaccccaccctggatgtggccagtgacagccagagcgagatgcaggagaagcaccccagcctgaatggaggaggagccctgaatggacctggctcctggggcgccctgatgggcggcaagagggaccctgaagattctgatgtgtttgaggaggacacccacctgtag

SEQ ID NO: 36901 - DNA, 1818 bp, Artificial Sequence
  Description of Artificial Sequence: Synthetic coding sequence
atgggccgcctgctgcgggccgcccggctgccccccctgctgagccccctgctgctgctgctggtgggcggggccttcctgggcgcctgtgtggccggcagtgatgagcccggccctgagggcctgaccagcaccagcctgctggacctgctgctgcccaccggcctggagcccctggacagcgaggagcccagcgagaccatgggcctgggcgccggcctgggcgcccctggcagcggcttccccagtgaagaaaatgaggagagccgcatcctgcagcccccccagtacttctgggaggaggaggaggagctgaatgacagcagcctggacctgggccccacagctgactatgtgtttcctgacctgacagagaaggccggcagcattgaggacaccagccaggcccaggagctgcccaacctgcccagccccctgcccaagatgaacctggtggagcccccctggcacatgccaccccgggaggaggaggaggaggaggaggaggaggaggagcgggagaaggaggaggtggagaagcaggaggaggaggaggaggaggagctgctgcctgtgaatggcagccaggaggaggccaagccccaggtgcgggacttcagcctgaccagcagcagccagacccctggggccaccaagagcagacatgaagattctggggaccaggccagcagtggagtggaggtggagagctccatgggccccagcctgctgctgcccagcgtgacccccaccaccgtgacccctggggaccaggacagcaccagccaggaggccgaggccaccgtgctgcctgctgctggcctgggcgtggagtttgaggccccccaggaggccagcgaggaggccacagctggagctgctggcctgagcggccagcacgaggaggtgcctgccctgcccagcttcccccagaccacagcccccagcggggctgagcacccagatgaggaccccctgggcagcaggaccagcgccagcagccccctggcccctggggacatggagctgacccccagcagcgccaccctgggccaggaggacctgaaccagcagctgctggagggccaggccgctgaggcccagagccgcatcccctgggacagcacccaggtgatctgcaaggactggagcaacctggccggcaagaactacatcatcctgaacatgacagagaacatcgactgtgaggtgttccggcagcaccggggcccccagctgctggccctggtggaggaggtgctgcccaggcatggcagcggccaccacggggcctggcacatcagcctgagcaagcccagcgagaaggagcagcacctgctgatgaccctggtgggggagcagggcgtggtgcccacccaggatgtgctgtccatgctgggggacatccgccgcagcctggaggagatcggcatccagaactacagcaccaccagcagctgccaggcccgggccagccaggtgcggagtgactatggcaccctgtttgtggtgctggtggtgattggagccatctgcatcatcatcatcgccctgggcctgctgtacaactgctggcagaggcggctgcccaagctgaagcacgtgtcccatggagaggagctgcgctttgtggagaatggctgccacgacaaccccaccctggatgtggccagtgacagccagagcgagatgcaggagaagcaccccagcctgaatggaggaggagccctgaatggacctggctcctggggcgccctgatgggcggcaagagggaccctgaggacagtgatgtgtttgaggaggacacccacctgtag

SEQ ID NO: 36902 - DNA, 717 bp, Artificial Sequence
  Description of Artificial Sequence: Synthetic coding sequence
atgctgacccccctgggcaagttcagcacagccaagtttgctgtgcggctgccccgggtgtgggaggcccgggcccccagcctgagcggggccccagcccccaccccaccagcccccccacccagccgcagcagccggctgggcctgtggccccgctgcttcctgatcttcccccagctgcgcatcctgctgctgggcccccaggagagcaacaacagcacaggcaccatgtggaaggtgtctgccctgctgtttgtgctgggcagcgccagcctgtgggtgctggccgagggcgccagcacaggccagccagaagatgacacagagaccaccggcctggagggcggcgtggccatgcctggagcagaagatgatgtggtgaccccaggcaccagtgaagatcgctacaagagcggcctgaccaccctggtggccacctctgtgaacagcgtgacaggcatcagaattgaggacctgcccaccagcgagagcacagtgcacgcccaggagcagagccccagcgccacagccagcaatgtggccaccagccacagcacagagaaggtggatggagacacccagaccaccgtggagaaggatggcctgagcacagtgaccctggtgggcatcatcgtgggcgtgctgctggccatcggcttcatcggggccatcatcgtggtggtgatgaggaagatgagcggccgctacagcccctag

SEQ ID NO: 36903 - DNA, 711 bp, Artificial Sequence
  Description of Artificial Sequence: Synthetic coding sequence
atgctgacccccctgggcaagttcagcacagccaagtttgctgtgcggctgccccgggtgtgggaggcccgggcccccagcctgagcggggccccagcccccaccccaccagcccccccacccagccgcagcagccggctgggcctgtggccccgctgcttcctgatcttcccccagctgcgcatcctgctgctgggcccccaggagagcaacaacagcacaggcaccatgtggaaggtgtctgccctgctgtttgtgctgggcagcgccagcctgtgggtgctggccgagggcgccagcacaggccagccagaagatgacacagagaccaccggcctggagggcggcgtggccatgcctggagcagaagatgatgtggtgaccccaggcaccagtgaagatcgctacaagagcggcctgaccaccctggtggccacctctgtgaacagcgtgacaggcatcagaattgaggacctgcccaccagcgagagcacagtgcacgcccaggagcagagccccagcgccacagccagcaatgtggccaccagccacagcacagagaaggtggatggagacacccagaccaccgtggagaaggatggcctgagcacagtgaccctggtgggcatcatcgtgggcgtgctgctggccatcggcttcatcggggccatcatcgtggtggtgatgaggaagatgagcggccggccctag

SEQ ID NO: 36904 - DNA, 363 bp, Artificial Sequence
  Description of Artificial Sequence: Synthetic coding sequence
atgcctggagcagaagatgatgtggtgaccccaggcaccagtgaagatcgctacaagagcggcctgaccaccctggtggccacctctgtgaacagcgtgacaggcatcagaattgaggacctgcccaccagcgagagcacagtgcacgcccaggagcagagccccagcgccacagccagcaatgtggccaccagccacagcacagagaaggtggatggagacacccagaccaccgtggagaaggatggcctgagcacagtgaccctggtgggcatcatcgtgggcgtgctgctggccatcggcttcatcggggccatcatcgtggtggtgatgaggaagatgagcggccgctacagcccctag

SEQ ID NO: 36905 - DNA, 357 bp, Artificial Sequence
  Description of Artificial Sequence: Synthetic coding sequence
atgcctggagcagaagatgatgtggtgaccccaggcaccagtgaagatcgctacaagagcggcctgaccaccctggtggccacctctgtgaacagcgtgacaggcatcagaattgaggacctgcccaccagcgagagcacagtgcacgcccaggagcagagccccagcgccacagccagcaatgtggccaccagccacagcacagagaaggtggatggagacacccagaccaccgtggagaaggatggcctgagcacagtgaccctggtgggcatcatcgtgggcgtgctgctggccatcggcttcatcggggccatcatcgtggtggtgatgaggaagatgagcggccggccctag

SEQ ID NO: 36906 - DNA, 363 bp, Artificial Sequence; identical to SEQ ID NO: 36904
  Description of Artificial Sequence: Synthetic coding sequence

SEQ ID NO: 36907 - DNA, 363 bp, Artificial Sequence; identical to SEQ ID NO: 36904
  Description of Artificial Sequence: Synthetic coding sequence

SEQ ID NO: 36908 - DNA, 981 bp, Artificial Sequence
  Description of Artificial Sequence: Synthetic coding sequence
atgaggacagaggcccaggtgcctgccctgcagcccccagagcccggcctggagggcgccatgggccacaggaccctggtgctgccctgggtgctgctgaccctgtgtgtgacagctggcaccccagaggtgtgggtgcaggtgaggatggaggccacagagctgagcagcttcaccatccgctgtggcttcctgggcagcggcagcatcagcctggtgacagtgtcctggggcggccccaatggagctgggggcaccaccctggccgtgctgcaccctgagcggggcatccggcagtgggccccagcccggcaggcccgctgggagacccagagcagcatcagcctcatcctggagggcagcggggccagcagcccctgtgccaacaccaccttctgctgcaagtttgccagcttccctgagggctcctgggaggcctgtggcagcctgccccccagcagtgaccccggcctgagcgccccacccaccccagcccccatcctgcgggctgacctggccggcatcctgggcgtgtctggagtgctgctgtttggctgtgtgtacctgctgcacctgctgcggcggcacaagcacaggcctgccccccggctgcagcccagcaggaccagcccccaggccccccgggcccgggcctgggcccccagccaggccagccaggccgccctgcacgtgccctatgccaccatcaacaccagctgcaggcctgccaccctggacacagcccacccccatggaggccccagctggtgggccagcctgcccacccacgccgcccaccggccccagggccctgctgcctgggccagcacccccatcccagcccggggcagctttgtgtctgtggagaatggcctgtatgcccaggccggggagcggcccccccacactggacctggcctgaccctcttcccagacccccggggcccccgggccatggagggccccctgggcgtgaggtag

SEQ ID NO: 36909 - DNA, 972 bp, Artificial Sequence
  Description of Artificial Sequence: Synthetic coding sequence
atgcagcccagcggctgggccgccgcccgggaggccgccggccgggacatgctggccgctgacctgcgctgcagcctgtttgccagcgccctgcagagctacaagagggacagcgtgctgcggcccttccctgccagctatgcccggggggactgcaaggactttgaggccctgctggctgatgccagcaagctgcccaacctgaaggagctgctgcagagcagcggggacaaccacaagagggcctgggacctggtgtcctggatcctgagcagcaaggtgctgaccatccacagcgctgggaaggccgagtttgagaagatccagaagctgaccggggccccccacacccctgtgcctgccccagacttcctgtttgaaattgagtactttgatcctgccaatgccaagttctatgagaccaagggggagcgggacctgatctatgccttccacggcagccggctggagaacttccacagcatcatccacaacggcctgcactgccacctgaacaagaccagcctgtttggagagggcacctacctgaccagtgacctgagcctggccctgatctacagcccccacggccacggctggcagcacagcctgctgggccccatcctgagctgtgtggccgtgtgtgaggtgattgaccacccagatgtgaagtgccagaccaagaagaaggacagcaaggagattgacagaagaagagcccgcatcaagcacagcgagggcggggacatcccccccaagtactttgtggtgaccaacaaccagctgctgcgggtgaagtacctgctggtgtacagccagaagccacccaagagccgggccagcagccagctgtcctggttcagcagccactggttcaccgtgatgatcagcctgtacctgctgctgctgctgattgtgtctgtcatcaacagcagcgccttccagcacttctggaacagagccaagaggtag

SEQ ID NO: 36910 - DNA, 1563 bp, Artificial Sequence
  Description of Artificial Sequence: Synthetic coding sequence
atgttctgcacccggggcctgctcttctttgccttcctggccggcctggacatcgagttcaccggcctgcggagcaacctgagcggcccccagcagatcagcctgtttgacctgcccagcgagtggtacctgaagacccggcagagcgtgcagcagttcaccgtgtgccagatcggcctgtctgtgttcagcgccatcgagggggaggccaacaagtacatcgcccacagctgcaacttctacctgttccccaccaccttcggcatcctggacagcgagttctccttccaggccagctctgtgcagttcctgaaccagtatggcttcaactacaacaagttcctgaagaatggcatcccctacatgaatgaggagcaggagaagaagatcagacatgacatcctgaccggcaactggagggtgcgcagcagcccagacaaggaccagatcaaggtggtgattgatgaggtgacccgctggctggagctggccaaggagggggactggatgaccctgcccggcatcaccggcttccaggcctttgaggtgcagctggtgctgcggcaggccctgcccaacatctggacagtgctgaaggatgagggcgtggtggtgaagaaggtgtccaagcagcaccgctggtacctgcagaacaccagctgtgaccgggagagctgctggaaggagaacatcctgctgagcgcccggggcttctctgtgttcttccagatgctggtgaaggcccagaagcccctggtgggccacaacatgatgatggacctgctgcacctgcacgagaagttcttccggcccctgcctgagagctatgaccagttcaagcagaacatccacagcctcttccctgtgctgattgacaccaagtctgtgaccaaggacatctggaaggagatgaacttcccccgggtgagcaacctgtctgaggtgtatgaggtgctgaacagcgacctgaaccccaccaagaacagcggccctgagatcgtgcacgccagccgctgtgagaagtatgtggagaccaagtgcccccatgaagctgcctatgatgccttcctgtgtggctctgtgctgctgaaggtggcccacctgctgctgcagaagatctaccacatcgaccctgtgcctgagagcagcttcccccagtacctggatgtgctggccccctacgtgaaccaggtgaacctgatccgggccggcgtgcccaagatcaacttcagcggccctgactaccccagcatccggccccccatcctgatcctgtctgtgaagcgctggccaggagtgtctgagcagcaggtgtaccacaagttccagaacctgtgcaagtttgatgtgcggcggctgaccaggagccagttcctgctgctgaccaacaagttcaaggatgccaggaacatcctgaaggagtacagagaccaccccaccctgtgcatcagcctgtaccgctactggaggcacagccccaacgtgaactgcctgctgcaggtgtgtggcatcgtgacagcctgggccctgctggccttcatcctgggccgcagcggcacctag

SEQ ID NO: 36911 - DNA, 792 bp, Artificial Sequence
  Description of Artificial Sequence: Synthetic coding sequence
atggacaacagctggaggctgggccctgccatcggcctgtctgctggccagagccagctgctggtgtccctgctgctgctgctgaccagggtgcagcctggaacagatgtggccgcccctgagcacatctcctatgtgccccagctgagcaatgacaccctggccggccgcctgaccctgagcaccttcaccctggagcagcccctgggccagttcagcagccacaacatcagtgacctggacaccatctggctggtggtggccctgagcaatgccacccagagcttcaccgcccccaggaccaaccaggacatcccagccccagccaacttcagccagaggggctactacctgaccctgcgggccaacagagtgctgtaccagacccggggccagctgcacgtgctgcgggtgggcaatgacacccactgccagcccaccaagattggctgcaaccaccccctgcccggccctggcccctacagagtgaagttcctggtgatgaatgatgagggccctgtggccgagaccaagtggagcagtgacacccggctgcagcaggcccaggccctgcgggctgtgcccggcccccagagccctggcaccgtggtgatcatcgccatcctgagcatcctgctggccgtgctgctgactgtgctgctggccgtgctgatctacacctgcttcaacagctgccgcagcaccagcctgagcggccctgaggaggccggctctgtgcggcgctacaccacccacctggccttcagcaccccagctgagggcgccagctag

SEQ ID NO: 36912 - DNA, 2352 bp, Artificial Sequence
  Description of Artificial Sequence: Synthetic coding sequence
atggccgcctgccgctactgctgcagctgcctgcggctgcggcccctgagtgatggccccttcctgctgccccggcgggaccgggccctgacccagctgcaggtgcgggccctgtggagcagcgctggcagcagagctgtggccgtggacctgggcaacaggaagctggagatcagcagcggcaagctggccaggtttgctgatggcagcgctgtggtgcagagcggggacacagctgtgatggtgacagctgtgtccaagaccaagcccagccccagccagttcatgcccctggtggtggactaccggcagaaggctgctgctgctggccgcatccccaccaactacctgcggcgggagatcggcaccagtgacaaggagatcctgaccagccgcatcatcgacaggagcatccggcccctcttccctgctggctacttctatgacacccaggtgctgtgcaacctgctggccgtggatggagtgaatgaaccagatgtgctggccatcaatggagcctctgtggccctgagcctgagtgacatcccctggaatggacctgtgggcgctgtgagaattggcatcattgatggagaatatgtggtgaaccccaccaggaaggagatgagcagcagcaccctgaacctggtggtggccggggcccccaagagccagatcgtgatgctggaggccagcgctgagaacatcctgcagcaggacttctgccacgccatcaaggtgggcgtgaagtacacccagcagatcatccagggcatccagcagctggtgaaggagaccggggtgaccaagaggaccccccagaagctgttcacccccagccctgagatcgtgaagtacacccacaagctggccatggagcggctgtatgctgtgttcacagattatgaacatgacaaggtgtccagagatgaggccgtgaacaagatccggctggacacagaggagcagctgaaggagaagtttcctgaggccgacccctatgagatcatcgagagcttcaacgtggtggccaaggaggtgttccgcagcatcgtgctgaatgagtacaagagatgtgatggccgggacctgaccagcctgagaaatgtgtcctgtgaggtggacatgttcaagaccctgcacggcagcgccctcttccagaggggccagacccaggtgctgtgcaccgtgacctttgacagcctggagagcggcatcaagagtgaccaggtgatcacagccatcaatggcatcaaggacaagaacttcatgctgcactatgagttccccccctatgccaccaatgaaattggcaaggtgacaggcctgaacagaagagagctgggccacggggccctggccgagaaggccctgtaccctgtgatcccccgggacttccccttcaccatccgggtgaccagcgaggtgctggagagcaatggcagcagctccatggccagcgcctgtggcggcagcctggccctgatggacagcggcgtgcccatcagcagcgctgtggccggcgtggccatcggcctggtgaccaagacagatcctgagaagggggagattgaggactaccgcctgctgacagacatcctgggcatcgaggactacaacggggacatggacttcaagattgctggcaccaacaagggcatcacagccctgcaggccgacatcaagctgcccggcatccccatcaagatcgtgatggaggccatccagcaggcctctgtggccaagaaggagatcctgcagatcatgaacaagaccatcagcaagccccgggccagcaggaaagaaaatggacctgtggtggagaccgtgcaggtgcccctgagcaagagggccaagtttgtgggccctgggggctacaacctgaagaagctgcaggccgagactggagtgaccatcagccaggtggatgaggagaccttctctgtgtttgcccccaccccatctgccatgcatgaggcccgggacttcatcacagagatctgcaaggatgaccaggagcagcagctggagtttggagctgtgtacacagccaccatcacagagatccgggacaccggggtgatggtgaagctgtaccccaacatgacagctgtgctgctgcacaacacccagctggaccagaggaagatcaagcaccccacagccctgggcctggaggtgggccaggagatccaggtgaagtacttcggccgggaccctgcagatggccgcatgaggctgagcaggaaggtgctgcagagccctgccaccaccgtggtgaggaccctgaatgacaggagcagcatcgtgatgggagagcccatcagccagagcagcagcaacagccagtag

SEQ ID NO: 36913 - DNA, 2352 bp, Artificial Sequence; identical to SEQ ID NO: 36912
  Description of Artificial Sequence: Synthetic coding sequence

SEQ ID NO: 36914 - DNA, 2955 bp, Artificial Sequence
  Description of Artificial Sequence: Synthetic coding sequence
atggtgtgcagccctgtgacagtgcgcatcgcccccccagaccggcgcttcagccgcagcgccatccctgagcagatcatcagcagcaccctgagcagccccagcagcaatgccccagacccctgtgccaaggagaccgtgctgagcgccctgaaggagaaggagaagaagaggacagtggaggaggaggaccagatcttcctggatggccaggagaacaagagaagaagacatgacagcagcggcagcggccacagcgcctttgagcccctggtggccaacggggtgcctgccagctttgtgcccaagccaggcagcctgaagaggggcctgaacagccagagcagtgatgaccacctgaacaagaggagccgcagcagctccatgagcagcctgactggagcctatgccagcggcatccccagcagcagcagaaatgccatcaccagcagctacagcagcacccggggcatcagccagctgtggaagagaaatggccccagcagcagccccttcagcagccctgccagcagccgcagccagaccccagagaggcctgccaagaagatccgggaggaggagctgtgccaccacagcagcagcagcacccccctggccgctgaccgggagagccagggcgagaaggctgctgacaccacccccaggaagaagcagaacagcaacagccagagcaccccaggcagcagcggccagaggaagaggaaggtgcagctgctgcccagcagaagaggagagcagctgaccctgcccccaccaccccagctgggctacagcatcacagctgaggacctggacctggagaagaaggccagcctgcagtggttcaaccaggccctggaggacaagagtgatgctgccagcaacagcgtgacagagaccccacccatcacccagcccagcttcaccttcaccctgcctgctgctgccccagccagcccccccaccagcctgctggcccccagcaccaaccccctgctggagagcctgaagaagatgcagaccccacccagcctgcccccctgcccagagagcgctggggccgccaccacagaggccctgagcccccccaagacccccagcctgctgccccccctgggcctgagccagagcggccccccaggcctgctgcccagccccagctttgacagcaagccacccaccaccctgctgggcctcatcccagcccccagcatggtgcctgccacagacaccaaggccccacccaccctgcaggccgagacagccaccaagccccaggccaccagcgcccccagccctgcccccaagcagagcttcctgtttggcacccagaacaccagccccagcagccctgctgccccagctgccagcagcgccccacccatgttcaagcccatcttcaccgccccacccaagtctgagaaggagggccccaccccacctggccccagcgtgacagccacagcccccagcagcagcagcctgcccaccaccaccagcaccacagcccccaccttccagcccgtcttcagctccatgggccccccagcctctgtgcccctgcctgcccccttcttcaagcagaccaccaccccagccacagcccccaccaccacagcccccctcttcaccggcctggccagcgccaccagcgctgtggcccccatcaccagcgccagccccagcacagattctgccagcaagccagcctttggatttggcatcaacagcgtgagcagcagctctgtgtccaccaccaccagcacagccacagctgccagccagcccttcctgtttggagccccccaggccagcgctgccagcttcaccccagccatgggcagcatcttccagtttgggaagcccccagccctgcccaccaccaccaccgtgaccaccttcagccagagcctgcacacagctgtgcccacagccaccagcagcagcgctgctgacttcagcggcttcggcagcaccctggccaccagcgccccagccaccagcagccagcccaccctgaccttcagcaacaccagcacccccaccttcaacatccccttcggcagcagcgccaagagccccctgcccagctacccaggggccaacccccagcctgcctttggagctgctgagggccagcccccaggagctgccaagccagccctggcccccagctttggcagcagcttcaccttcggcaacagcgctgccccagctgctgcccccaccccagccccacccagcatgatcaaggtggtgcctgcctacgtgcccacccccatccaccccatctttggaggagccacccacagcgccttcggcctgaaggccacagccagcgccttcggggccccagccagcagccagcctgccttcggcggcagcacagctgtgttcttcggggccgccaccagcagcggctttggagccaccacccagacagccagcagcggcagcagcagctctgtgtttggcagcaccacccccagccccttcaccttcggcggcagcgctgccccagctggcagcggcagctttggcatcaacgtggccaccccaggcagcagcaccaccactggagccttctcctttggagctggccagagcggcagcacagccaccagcaccccatttgctgggggcctgggccagaatgccctgggcaccaccggccagagcaccccatttgccttcaacgtgagcagcaccacagagagcaagcctgtgtttggaggaacagccacccccaccttcggcctgaacaccccagcccctggggtgggcaccagcggcagcagcctgagctttggagccagcagcgccccagcccagggctttgtgggcgtggcccccttcggcagcgctgccctgtccttcagcattggagctggcagcaagacccctggggcccggcagaggctgcaggcccggcggcagcacaccaggaagaagtag

SEQ ID NO: 36915 - DNA, 2955 bp, Artificial Sequence; identical to SEQ ID NO: 36914
  Description of Artificial Sequence: Synthetic coding sequence

SEQ ID NO: 36916 - DNA, 3000 bp, Artificial Sequence
  Description of Artificial Sequence: Synthetic coding sequence
atggtgtgcagccctgtgacagtgcgcatcgcccccccagaccggcgcttcagccgcagcgccatccctgagcagatcatcagcagcaccctgagcagccccagcagcaatgccccagacccctgtgccaaggagaccgtgctgagcgccctgaaggagaaggagaagaagaggacagtggaggaggaggaccagatcttcctggatggccaggagaacaagagaagaagacatgacagcagcggcagcggccacagcgcctttgagcccctggtggccaacggggtgcctgccagctttgtgcccaagccaggcagcctgaagaggggcctgaacagccagagcagtgatgaccacctgaacaagaggagccgcagcagctccatgagcagcctgactggagcctatgccagcggcatccccagcagcagcagaaatgccatcaccagcagctacagcagcacccggggcatcagccagctgtggaagagaaatggccccagcagcagccccttcagcagccctgccagcagccgcagccagaccccagagaggcctgccaagaagatccgggaggaggagctgtgccaccacagcagcagcagcacccccctggccgctgaccgggagagccagggcgagaaggctgctgacaccacccccaggaagaagcagaacagcaacagccagagcaccccaggcagcagcggccagaggaagaggaaggtgcagctgctgcccagcagaagaggagagcagctgaccctgcccccaccaccccagctgggctacagcatcacagctgaggacctggacctggagaagaaggccagcctgcagtggttcaaccaggccctggaggacaagagtgatgctgccagcaacagcgtgacagagaccccacccatcacccagcccagcttcaccttcaccctgcctgctgctgccccagccagcccccccaccagcctgctggcccccagcaccaaccccctgctggagagcctgaagaagatgcagaccccacccagcctgcccccctgcccagagagcgctggggccgccaccacagaggccctgagcccccccaagacccccagcctgctgccccccctgggcctgagccagagcggccccccaggcctgctgcccagccccagctttgacagcaagccacccaccaccctgctgggcctcatcccagcccccagcatggtgcctgccacagacaccaaggccccacccaccctgcaggccgagacagccaccaagccccaggccaccagcgcccccagccctgcccccaagcagagcttcctgtttggcacccagaacaccagccccagcagccctgctgccccagctgccagcagcgccccacccatgttcaagcccatcttcaccgccccacccaagtctgagaaggagggccccaccccacctggccccagcgtgacagccacagcccccagcagcagcagcctgcccaccaccaccagcaccacagcccccaccttccagcccgtcttcagctccatgggccccccagcctctgtgcccctgcctgcccccttcttcaagcagaccaccaccccagccacagcccccaccaccacagcccccctcttcaccggcctggccagcgccaccagcgctgtggcccccatcaccagcgccagccccagcacagattctgccagcaagccagcctttggatttggcatcaacagcgtgagcagcagctctgtgtccaccaccaccagcacagccacagctgccagccagcccttcctgtttggagccccccaggccagcgctgccagcttcaccccagccatgggcagcatcttccagtttgggaagcccccagccctgcccaccaccaccaccgtgaccaccttcagccagagcctgcacacagctgtgcccacagccaccagcagcagcgctgctgacttcagcggcttcggcagcaccctggccaccagcgccccagccaccagcagccagcccaccctgaccttcagcaacaccagcacccccaccttcaacatccccttcggcagcagcgccaagagccccctgcccagctacccaggggccaacccccagcctgcctttggagctgctgagggccagcccccaggagctgccaagccagccctggcccccagctttggcagcagcttcaccttcggcaacagcgctgccccagctgctgcccccaccccagccccacccagcatgatcaaggtggtgcctgcctacgtgcccacccccatccaccccatctttggaggagccacccacagcgccttcggcctgaaggccacagccagcgccttcggggccccagccagcagccagcctgccttcggcggcagcacagctgtgttcttcggggccgccaccagcagcggctttggagccaccacccagacagccagcagcggcagcagcagctctgtgtttggcagcaccacccccagccccttcaccttcggcggcagcgctgccccagctggcagcggcagctttggcatcaacgtggccaccccaggcagcagcaccaccactggagccttctcctttggagctggccagagcggcagcacagccaccagcaccccatttgctgggggcctgggccagaatgccctgggcaccaccggccagagcaccccatttgccttcaacgtgagcagcaccacagagagcaagcctgtgtttggaggaacagccacccccaccttcggcctgaacaccccagcccctggggtgggcaccagcggcagcagcctgagctttggagccagcagcgccccagcccagggctttgtgggcgtggcccccttcggcaacacctttgcccaccagcaggagcacagccccaggaagggccccaacaacctgagcaagaggaagctgctgcctgctgtgcgggcccagggcctgccccggcggggccaggccagcagcttccccaccaggaaggagtag

SEQ ID NO: 36917 - DNA, 3750 bp, Artificial Sequence
  Description of Artificial Sequence: Synthetic coding sequence
atgagccctgctgctgctgctgctggggccggggagcggcggcggcccatcgcctctgtgagagatggccggggccggggctgcggcggccctgcccgggctgtgctgctgggcctgagcctggtgggcctgctgctgtacctggtgcctgctgctgctgccctggcctggctgactgtgggcgccacagctgcctggtggggcctgagccgggagccccggggcagccggcccctgagcagctttgtgaggaaggcccggcacagaagacccctgagcagctttgtgaggaaggcccggcacaggaggaccctgtttgccagccccctggccaagagcacagccaacggcaacctgctggagcccaggaccctgctggagggccctgaccctgctgagctgctgctgatgggcagctacctgggcaagccaggccccccccagcctgctgctgcccctgagggccaggacctgcgggaccggcccggccggcggcccccagcccggcctgcccccaggagccccccacccaggagccccccacccaggagccccccacccagcccccccacccaccgggcccaccacgtgtaccccagcctgcccacccccctgctgcggcccagccggcggcccagcccccgggactgtggcaccctgcccaaccgcttcgtcatcaccccaagaagacgctaccccatccaccaggcccagtacagctgcctgggcgtgctgcccaccgtgtgctggaatggctaccacaagaaggctgtgctgagccccaggaacagcaggatggtgtgcagccctgtgacagtgagaattgcccccccagaccggcgcttcagccgcagcgccatccctgagcagatcatcagcagcaccctgagcagccccagcagcaatgccccagacccctgtgccaaggagaccgtgctgagcgccctgaaggagaaggagaagaagaggacagtggaggaggaggaccagatcttcctggatggccaggagaacaagagaagaagacatgacagcagcggcagcggccacagcgcctttgagcccctggtggccaatggagtgcctgccagctttgtgcccaagccaggcagcctgaagaggggcctgaacagccagagcagtgatgaccacctgaacaagaggagccgcagcagctccatgagcagcctgaccggggcctatgccagcggcatccccagcagcagcagaaatgccatcaccagcagctacagcagcacccggggcatcagccagctgtggaagagaaatggccccagcagcagccccttcagcagccctgccagcagccgcagccagaccccagagaggcctgccaagaagatccgggaggaggagctgtgccaccacagcagcagcagcacccccctggccgctgaccgggagagccagggcgagaaggctgctgacaccacccccaggaagaagcagaacagcaacagccagagcaccccaggcagcagcggccagaggaagaggaaggtgcagctgctgcccagccggcggggggagcagctgaccctgcccccaccaccccagctgggctacagcatcacagctgaggacctggacctggagaagaaggccagcctgcagtggttcaaccaggccctggaggacaagagtgatgctgccagcaacagcgtgacagagaccccacccatcacccagcccagcttcaccttcaccctgcctgctgctgccccagccagcccccccaccagcctgctggcccccagcaccaaccccctgctggagagcctgaagaagatgcagaccccacccagcctgcccccctgcccagagagcgctggagctgccaccacagaggccctgagcccccccaagacccccagcctgctgccccccctgggcctgagccagagcggccccccaggcctgctgcccagccccagctttgacagcaagccacccaccaccctgctgggcctcatcccagcccccagcatggtgcctgccacagacaccaaggccccacccaccctgcaggccgagacagccaccaagccccaggccaccagcgcccccagccctgcccccaagcagagcttcctgtttggcacccagaacaccagccccagcagccctgctgccccagctgccagcagcgccccacccatgttcaagcccatcttcaccgccccacccaagtctgagaaggagggccccaccccacctggccccagcgtgacagccacagcccccagcagcagcagcctgcccaccaccaccagcaccacagcccccaccttccagcctgtgttcagctccatgggccccccagcctctgtgcccctgcctgcccccttcttcaagcagaccaccaccccagccacagcccccaccaccacagcccccctcttcaccggcctggccagcgccaccagcgctgtggcccccatcaccagcgccagccccagcacagacagcgccagcaagccagccttcggcttcggcatcaacagcgtgagcagcagctctgtgtccaccaccaccagcacagccacagctgccagccagcccttcctgtttggagccccccaggccagcgctgccagcttcaccccagccatgggcagcatcttccagtttgggaagcccccagccctgcccaccaccaccaccgtgaccaccttcagccagagcctgcacacagctgtgcccacagccaccagcagcagcgctgctgacttcagcggcttcggcagcaccctggccaccagcgccccagccaccagcagccagcccaccctgaccttcagcaacaccagcacccccaccttcaacatccccttcggcagcagcgccaagagccccctgcccagctacccaggggccaacccccagcctgccttcggggctgctgagggccagcccccaggggccgccaagccagccctggcccccagctttggcagcagcttcacctttggaaacagcgctgccccagctgctgcccccaccccagcccctccttccatgatcaaggtggtgcctgcctacgtgcccacccccatccaccccatctttggaggagccacccacagcgccttcggcctgaaggccacagccagcgcctttggagccccagccagcagccagcctgcctttggaggcagcacagctgtgttctttggagctgccaccagcagcggctttggagccaccacccagacagccagcagcggcagcagcagctctgtgtttggcagcaccacccccagccccttcacctttggaggcagcgctgccccagctggcagcggcagctttggcatcaacgtggccaccccaggcagcagcaccaccaccggggccttctcctttggagctggccagagcggcagcacagccaccagcaccccatttgctgggggcctgggccagaatgccctgggcaccaccggccagagcaccccatttgccttcaacgtgagcagcaccacagagagcaagcctgtgtttggaggaacagccacccccaccttcggcctgaacaccccagcccctggggtgggcaccagcggcagcagcctgagctttggagccagcagcgccccagcccagggctttgtgggcgtggccccctttggatctgctgccctgtccttcagcatcggggccggcagcaagacccctggggcccggcagaggctgcaggcccggcggcagcacaccaggaagaagtag

SEQ ID NO: 36918 - DNA, 3000 bp, Artificial Sequence; identical to SEQ ID NO: 36916
  Description of Artificial Sequence: Synthetic coding sequence

SEQ ID NO: 36919 - DNA, 3690 bp, Artificial Sequence
  Description of Artificial Sequence: Synthetic coding sequence
atgagccctgctgctgctgctgctggggccggggagcggcggcggcccatcgcctctgtgagagatggccggggccggggctgcggcggccctgctggggccgccctgctgggcctgagcctggtgggcctgctgctgtacctggtgcctgctgctgctgccctggcctggctggccgtgggcaccacagctgcctggtggggcctgagccgggagccccggggcagccggcccctgagcagctttgtgcagaaggcccggcacaggaggaccctgtttgccagccccccagccaagagcacagccaatggaaacctgctggagcccaggaccctgctggagggccctgaccctgctgagctgctgctgatgggcagctacctgggcaagccaggccccccccagcctgccccagcccctgagggccaggacctgaggaacagacctggaagaagacctccagcccggcctgcccccaggagcaccccacccagcccccccacccaccgggtgcaccacttctaccccagcctgcccacccccctgctgcggcccagcggccggcccagcccccgggaccggggcaccctgcctgacagatttgtgatcaccccccggcggcgctaccccatccaccagacccagtacagctgccctggggtgctgcccaccgtgtgctggaatggctaccacaagaaggctgtgctgagccccaggaacagcaggatggtgtgcagccctgtgacagtgcgcatcgcccccccagaccggcgcttcagccgcagcgccatccctgagcagatcatcagcagcaccctgagcagccccagcagcaatgccccagacccctgtgccaaggagaccgtgctgagcgccctgaaggagaagaagaagaagaggacagtggaggaggaggaccagatcttcctggatggccaggagaacaagagaagaagacatgacagcagcggcagcggccacagcgcctttgagcccctggtggccagcggcgtgcctgccagctttgtgcccaagccaggcagcctgaagaggggcctgaacagccagagcagtgatgaccacctgaacaagaggagccgcagcagctccatgagcagcctgactggagcctacaccagcggcatccccagcagcagcagaaatgccatcaccagcagctacagcagcacccggggcatcagccagctgtggaagagaaatggccccagcagcagccccttcagcagccctgccagcagccgcagccagaccccagagaggcctgccaagaagatccgggaggaggagctgtgccaccacagcagcagcagcacccccctggccgctgacaaggagagccagggcgagaaggctgctgacaccacccccaggaagaagcagaacagcaacagccagagcaccccaggcagcagcggccagaggaagaggaaggtgcagctgctgcccagcagaagaggagagcagctgaccctgcccccaccaccccagctgggctacagcatcacagctgaggacctggacctggagaagaaggccagcctgcagtggttcaaccaggccctggaggacaagagtgatgctgccagcaacagcgtgacagagaccccacccaccacccagcccagcttcaccttcaccctgcctgctgctgccacagccagcccccccaccagcctgctggcccccagcaccaaccccctgctggagagcctgaagaagatgcagaccccacccagcctgcccccctgcccagagagcgctggggccgccaccacagaggccctgagcccccccaagacccccagcctgctgccccccctgggcctgagccagagcggccccccaggcctgctgcccagccccagctttgacagcaagccacccaccaccctgctgggcctcatcccagcccccagcatggtgcctgccacagacaccaaggccccacccaccctgcaggccgagacagccaccaagccccaggccaccagcgcccccagccctgcccccaagcagagcttcctgtttggcacccagaacaccagccccagcagccctgctgccccagctgccagcagcgccagccccatgttcaagcccatcttcaccgccccacccaagtctgagaaggagggccccaccccacctggccccagcgtgacagccacagcccccagcagcagcagcctgcccaccaccaccagcaccacagcccccaccttccagcccgtcttcagctccatgggccccccagcctctgtgcccctgcctgcccccttcttcaagcagaccaccaccccagccacagcccccaccaccacagcccccctcttcaccggcctggccagcgccaccagcgctgtggcccccatcaccagcgccagccccagcacagattctgccagcaagccagcctttggatttggcatcaacagcgtgagcagcagctctgtgtccaccaccaccagcacagccacagctgccagccagcccttcctgtttggagccccccaggccagcgctgccagcttcaccccagccatgggcagcatcttccagtttgggaagcccccagccctgcccaccaccaccaccgtgaccaccttcagccagagcctgcccacagctgtgcccacagccaccagcagcagcgctgctgacttcagcggcttcggcagcaccctggccaccagcgccccagccaccagcagccagcccaccctgaccttcagcaacaccagcacccccaccttcaacatccccttcggcagcagcgccaagagccccctgcccagctacccaggggccaacccccagcctgcctttggagctgctgagggccagcccccaggagctgccaagccagccctgacccccagctttggcagcagcttcaccttcggcaacagcgctgccccagccccagccacagcccccaccccagccccagccagcaccatcaagatcgtgcctgcccacgtgcccacccccatccagcccacctttggaggagccacccacagcgccttcggcctgaaggccacagccagcgccttcggggccccagccagcagccagcctgccttcggcggcagcacagctgtgttctcctttggagctgccaccagcagcggctttggagccaccacccagacagccagcagcggcagcagcagctctgtgtttggcagcaccacccccagccccttcacctttggaggcagcgctgccccagctggcagcggcagctttggcatcaacgtggccaccccaggcagcagcgccaccaccggggccttctcctttggagctggccagagcggcagcacagccaccagcacccccttcaccggcggcctgggccagaatgccctgggcaccaccggccagagcaccccatttgccttcaacgtgggcagcaccacagagagcaagcctgtgtttggaggaacagccacccccaccttcggccagaacaccccagcccctggggtgggcaccagcggcagcagcctgagctttggagccagcagcgccccagcccagggctttgtgggcgtgggcccctttggatctgctgcccccagcttcagcatcggggccggcagcaagacccctggggcccggcagaggctgcaggcccggcggcagcacaccaggaagaagtag

SEQ ID NO: 36920 - DNA, 129 bp, Artificial Sequence
  Description of Artificial Sequence: Synthetic coding sequence
atggtgtgcagccctgtgacagtgcgcatcgcccccccagaccggcgcttcagccgcagcgccatccctgagcagatcatcagcagcaccctgagcagccccagcagcaatgccccagacccctgctag

SEQ ID NO: 36921 - DNA, 2964 bp, Artificial Sequence
  Description of Artificial Sequence: Synthetic coding sequence
atggtgtgcagccctgtgacagtgcgcatcgcccccccagaccggcgcttcagccgcagcgccatccctgagcagatcatcagcagcaccctgagcagccccagcagcaatgccccagacccctgtgccaaggagaccgtgctgagcgccctgaaggagaagaagaagaagaggacagtggaggaggaggaccagatcttcctggatggccaggagaacaagagaagaagacatgacagcagcggcagcggccacagcgcctttgagcccctggtggccagcggcgtgcctgccagctttgtgcccaagccaggcagcctgaagaggggcctgaacagccagagcagtgatgaccacctgaacaagaggagccgcagcagctccatgagcagcctgactggagcctacaccagcggcatccccagcagcagcagaaatgccatcaccagcagctacagcagcacccggggcatcagccagctgtggaagagaaatggccccagcagcagccccttcagcagccctgccagcagccgcagccagaccccagagaggcctgccaagaagatccgggaggaggagctgtgccaccacagcagcagcagcacccccctggccgctgacaaggagagccagggcgagaaggctgctgacaccacccccaggaagaagcagaacagcaacagccagagcaccccaggcagcagcggccagaggaagaggaaggtgcagctgctgcccagcagaagaggagagcagctgaccctgcccccaccaccccagctgggctacagcatcacagctgaggacctggacctggagaagaaggccagcctgcagtggttcaaccaggccctggaggacaagagtgatgctgccagcaacagcgtgacagagaccccacccaccacccagcccagcttcaccttcaccctgcctgctgctgccacagccagcccccccaccagcctgctggcccccagcaccaaccccctgctggagagcctgaagaagatgcagaccccacccagcctgcccccctgcccagagagcgctggggccgccaccacagaggccctgagcccccccaagacccccagcctgctgccccccctgggcctgagccagagcggccccccaggcctgctgcccagccccagctttgacagcaagccacccaccaccctgctgggcctcatcccagcccccagcatggtgcctgccacagacaccaaggccccacccaccctgcaggccgagacagccaccaagccccaggccaccagcgcccccagccctgcccccaagcagagcttcctgtttggcacccagaacaccagccccagcagccctgctgccccagctgccagcagcgccagccccatgttcaagcccatcttcaccgccccacccaagtctgagaaggagggccccaccccacctggccccagcgtgacagccacagcccccagcagcagcagcctgcccaccaccaccagcaccacagcccccaccttccagcccgtcttcagctccatgggccccccagcctctgtgcccctgcctgcccccttcttcaagcagaccaccaccccagccacagcccccaccaccacagcccccctcttcaccggcctggccagcgccaccagcgctgtggcccccatcaccagcgccagccccagcacagattctgccagcaagccagcctttggatttggcatcaacagcgtgagcagcagctctgtgtccaccaccaccagcacagccacagctgccagccagcccttcctgtttggagccccccaggccagcgctgccagcttcaccccagccatgggcagcatcttccagtttgggaagcccccagccctgcccaccaccaccaccgtgaccaccttcagccagagcctgcccacagctgtgcccacagccaccagcagcagcgctgctgacttcagcggcttcggcagcaccctggccaccagcgccccagccaccagcagccagcccaccctgaccttcagcaacaccagcacccccaccttcaacatccccttcggcagcagcgccaagagccccctgcccagctacccaggggccaacccccagcctgcctttggagctgctgagggccagcccccaggagctgccaagccagccctgacccccagctttggcagcagcttcaccttcggcaacagcgctgccccagccccagccacagcccccaccccagccccagccagcaccatcaagatcgtgcctgcccacgtgcccacccccatccagcccacctttggaggagccacccacagcgccttcggcctgaaggccacagccagcgccttcggggccccagccagcagccagcctgccttcggcggcagcacagctgtgttctcctttggagctgccaccagcagcggctttggagccaccacccagacagccagcagcggcagcagcagctctgtgtttggcagcaccacccccagccccttcacctttggaggcagcgctgccccagctggcagcggcagctttggcatcaacgtggccaccccaggcagcagcgccaccaccggggccttctcctttggagctggccagagcggcagcacagccaccagcacccccttcaccggcggcctgggccagaatgccctgggcaccaccggccagagcaccccatttgccttcaacgtgggcagcaccacagagagcaagcctgtgtttggaggaacagccacccccaccttcggccagaacaccccagcccctggggtgggcaccagcggcagcagcctgagctttggagccagcagcgccccagcccagggctttgtgggcgtgggcccctttggatctgctgcccccagcttcagcatcggggccggcagcaagacccctggggcccggcagaggctgcaggcccggcggcagcacaccaggaagaagtag

SEQ ID NO: 36922 - DNA, 948 bp, Artificial Sequence
  Description of Artificial Sequence: Synthetic coding sequence
atgtaccaggtgcccctgcccctggacagagatggcaccctggtgcggctgcgcttcaccatggtggccctggtgacagtgtgctgccccctggtggccttcctgttctgcatcctgtggagcctgctcttccacttcaaggagaccacagccacccactgtggggccaccccctgcaggatgttttctgctgccagccagcccctggaccctgatggcaccctcttccggctgcgcttcaccgccatggtgtggtgggccatcaccttccctgtgtttggcttcttcttctgcatcatctggagcctggtgttccactttgagtacacagtggccacagactgtggggtgcccaactacctgcccagcgtgagcagcgccatcggcggggaggtgccccagcgctacgtgtggaggttctgcatcggcctgcacagcgccccccgcttcctggtggcctttgcctactggaaccactacctgagctgcaccagcccctgcagctgctaccggcccctgtgccgcctgaactttggcctgaatgtggtggagaacctggccctgctggtgctgacctacgtgagcagcagcgaggacttcaccatccatgaaaatgccttcatcgtgttcatcgccagcagcctgggccacatgctgctgacctgcatcctgtggaggctgaccaagaagcacacagtgtcccaggaggacaggaagagctacagctggaagcagaggctcttcatcatcaacttcatctccttcttcagcgccctggccgtgtacttccgccacaacatgtactgtgaggccggcgtgtacaccatctttgccatcctggagtacacagtggtgctgaccaacatggccttccacatgacagcctggtgggactttggaaacaaggagctgctgatcaccagccagcctgaggagaagcgcttctag

SEQ ID NO: 36923 - DNA, 924 bp, Artificial Sequence
  Description of Artificial Sequence: Synthetic coding sequence
atggcccggctgggcagcactggaggagtgtctggccgggtggtgacccagcaccgggacagcgcccccttcctgggcgccccccggctgggcctgcgggagctgggccccatccggggcacagcccctgagtggcacggccgctggaatgctgctgagaggagtgacaagatgtaccaggtgcccctgcccctggacagagatggcaccctggtgcggctgcgcttcaccatggtggccctggtgacagtgtgctgccccctggtggccttcctgttctgcatcctgtggagcctgctcttccacttcaaggagaccacagccacccactgcggcgtgcccaactacctgcccagcgtgagcagcgccatcggcggggaggtgccccagcgctacgtgtggaggttctgcatcggcctgcacagcgccccccgcttcctggtggcctttgcctactggaaccactacctgagctgcaccagcccctgcagctgctaccggcccctgtgccgcctgaactttggcctgaatgtggtggagaacctggccctgctggtgctgacctacgtgagcagcagcgaggacttcaccatccatgaaaatgccttcatcgtgttcatcgccagcagcctgggccacatgctgctgacctgcatcctgtggaggctgaccaagaagcacacagacaggaagagctacagctggaagcagaggctcttcatcatcaacttcatctccttcttcagcgccctggccgtgtacttccgccacaacatgtactgtgaggccggcgtgtacaccatctttgccatcctggagtacacagtggtgctgaccaacatggccttccacatgacagcctggtgggactttggaaacaaggagctgctgatcaccagccagcctgaggagaagcgcttctag

SEQ ID NO: 36924 - DNA, 948 bp, Artificial Sequence; identical to SEQ ID NO: 36922
  Description of Artificial Sequence: Synthetic coding sequence

SEQ ID NO: 36925 - DNA, 486 bp, Artificial Sequence
  Description of Artificial Sequence: Synthetic coding sequence
atggtggatggcacccagctgcggggggcccagctgcctgccctgggggagctgagccacagaagaggaggagccccagccctgcgggtggccttcctgcacaggcctgccctgggcgccagcctgctgggcggcctgcggctgctggagcccctgccccagctgcacctgcccgtcttcctgctgagccctgccctgcccccccagctgcggccccagtgccgcggggagccccgggtggccagcgcccacctgtgcctgctgctgcggggcctgcaccaccccaggaagtgcttccactgtgtgcactgcctgatcccccgggcccacgccccccacctgcacagcctggccgtggaccaggaggcccacagcaagagcggcggcagccaggtgctgcagctggagacagctgccctgcaccaccagctgcacctgctgctgctgggcgccggctgcctgctgagcgcccagcacgtgctgtag

SEQ ID NO: 36926 - DNA, 765 bp, Artificial Sequence
  Description of Artificial Sequence: Synthetic coding sequence
atgtaccaggtgcccctgcccctggacagagatggcaccctggtgcggctgcgcttcaccatggtggccctggtgacagtgtgctgccccctggtggccttcctgttctgcatcctgtggagcctgctcttccacttcaaggagaccacagccacccactgcggcgtgcccaactacctgcccagcgtgtcctctgccatcggcggggaggtgccccagagatatgtgtggaggttctgcatcggcctgcacagcgccccccgcttcctggtggcctttgcctactggaaccactacctgagctgcaccagcccctgcagctgctaccggcccctgtgccgcctgaactttggcctgaatgtggtggagaacctggccctgctggtgctgacctacgtgagcagcagcgaggacttcaccatccatgaaaatgccttcatcgtgttcatcgccagcagcctgggccacatgctgctgacctgcatcctgtggaggctgaccaagaagcacacagtgtcccaggaggacaggaagagctacagctggaagcagaggctcttcatcatcaacttcatctccttcttcagcgccctggccgtgtacttccgccacaacatgtactgtgaggccggcgtgtacaccatctttgccatcctggagtacacagtggtgctgaccaacatggccttccacatgacagcctggtgggactttggaaacaaggagctgctgatcaccagccagcctgaggagaagcgcttctag

SEQ ID NO: 36927 - DNA, 1038 bp, Artificial Sequence
  Description of Artificial Sequence: Synthetic coding sequence
tgaagactgggcctgcgggagctgggccccatccggggcacagcccctgagtggcacggccgctggaatgctgctgagaggagtgacaagatgtaccaggtgcccctgcccctggacagagatggcaccctggtgcggctgcgcttcaccatggtggccctggtgacagtgtgctgccccctggtggccttcctgttctgcatcctgtggagcctgctcttccacttcaaggagaccacagccacccactgtggggccaccccctgcaggatgttttctgctgccagccagcccctggaccctgatggcaccctcttccggctgcgcttcaccgccatggtgtggtgggccatcaccttccctgtgtttggcttcttcttctgcatcatctggagcctggtgttccactttgagtacacagtggccacagactgtggggtgcccaactacctgcccagcgtgagcagcgccatcggcggggaggtgccccagcgctacgtgtggaggttctgcatcggcctgcacagcgccccccgcttcctggtggcctttgcctactggaaccactacctgagctgcaccagcccctgcagctgctaccggcccctgtgccgcctgaactttggcctgaatgtggtggagaacctggccctgctggtgctgacctacgtgagcagcagcgaggacttcaccatccatgaaaatgccttcatcgtgttcatcgccagcagcctgggccacatgctgctgacctgcatcctgtggaggctgaccaagaagcacacagtgtcccaggaggacaggaagagctacagctggaagcagaggctcttcatcatcaacttcatctccttcttcagcgccctggccgtgtacttccgccacaacatgtactgtgaggccggcgtgtacaccatctttgccatcctggagtacacagtggtgctgaccaacatggccttccacatgacagcctggtgggactttggaaacaaggagctgctgatcaccagccagcctgaggagaagcgcttctag

SEQ ID NO: 36928 - DNA, 624 bp, Artificial Sequence
  Description of Artificial Sequence: Synthetic coding sequence
atgttttctgctgccagccagcccctggaccctgatggcaccctcttccggctgcgcttcaccgccatggtgtggtgggccatcaccttccctgtgtttggcttcttcttctgcatcatctggagcctggtgttccactttgagtacacagtggccacagactgtggggtgtctgccagcagccctgcccctggcagcggccctggccaggaggtggccgtgcgggtggagctggacagcggggaggaggtggaggaccagcgggagggcaagggccagggagatggcggccgggtgggcaagtctgagagcgagatcatccacggcggccgcctgcgggagaaccgcatcaccgtgctgcctgagctggaggatgatgacagaaatgcccgggagatgaccggggctgtggcccacacctgcaacctgagcaccagcggcggccgcagccagtggatcaccagggtgcagtttgagaccagcctgggcaacatggtgaagccccggctgtacaagaagtgcaagaagatctcctgggtgccctggcacgcccctgtggtgcctgccacctgggaggccaaggccggggagctgctggaggccggccgctggaccttccagtag

SEQ ID NO: 36929 - DNA, 936 bp, Artificial Sequence
  Description of Artificial Sequence: Synthetic coding sequence
atggcccggctgggcagcactggaggagtgtctggccgggtggtgacccagcaccgggacagcgcccccttcctgggcgccccccggctgggcctgcgggagctgggccccatccggggcacagcccctgagtggcacggccgctggaatgctgctgagaggagtgacaagatgtaccaggtgcccctgcccctggacagagatggcaccctggtgcggctgcgcttcaccatggtggccctggtgacagtgtgctgccccctggtggccttcctgttctgcatcctgtggagcctgctcttccacttcaaggagaccacagccacccactgcggcgtgcccaactacctgcccagcgtgagcagcgccatcggcggggaggtgccccagcgctacgtgtggaggttctgcatcggcctgcacagcgccccccgcttcctggtggcctttgcctactggaaccactacctgagctgcaccagcccctgcagctgctaccggcccctgtgccgcctgaactttggcctgaatgtggtggagaacctggccctgctggtgctgacctacgtgagcagcagcgaggacttcaccatccatgaaaatgccttcatcgtgttcatcgccagcagcctgggccacatgctgctgacctgcatcctgtggaggctgaccaagaagcacacagtgtcccaggaggacaggaagagctacagctggaagcagaggctcttcatcatcaacttcatctccttcttcagcgccctggccgtgtacttccgccacaacatgtactgtgaggccggcgtgtacaccatctttgccatcctggagtacacagtggtgctgaccaacatggccttccacatgacagcctggtgggactttggaaacaaggagctgctgatcaccagccagcctgaggagaagcgcttctag

SEQ ID NO: 36930 - DNA, 699 bp, Artificial Sequence
  Description of Artificial Sequence: Synthetic coding sequence
atgtaccaggtgcccctgcccctggacagagatggcaccctggtgcggctgcgcttcaccatggtggccctggtgacagtgtgctgccccctggtggccttcctgttctgcatcctgtggagcctgctcttccacttcaaggagaccacagccacccactgcggcgtgcccaactacctgcccagcgtgtcctctgccatcggcggggaggtgccccagagatatgtgtggaggttctgcatcggcctgcacagcgccccccgcttcctggtggcctttgcctactggaaccactacctgagctgcaccagcccctgcagctgctaccggcccctgtgccgcctgaactttggcctgaatgtggtggagaacctggccctgctggtgctgacctacgtgagcagcagcgaggacttcaccatccatgaaaatgccttcatcgtgttcatcgccagcagcctgggccacatgctgctgacctgcatcctgtggaggctgaccaagaagcacacagtgtcccaggaggtgcgcagcatccccagcggcggcagcaaggccgcccagaagaagatcaaggacatctgcccccaggacagcggcagccaggtgctgcagctggagacagctgccctgcaccaccagctgcacctgctgctgctgggcgccggctgcctgctgagcgcccagcacgtgctgtag

SEQ ID NO: 36931 - DNA, 171 bp, Artificial Sequence
  Description of Artificial Sequence: Synthetic coding sequence
atgtaccaggtgcccctgcccctggacagagatggcaccctggtgcggctgcgcttcaccatggtggccctggtgacagtgtgctgccccctggtggccttcctgttctgcatcctgtggagcctgctcttccacttcaaggagaccacagccacccactgtggggactag

SEQ ID NO: 36932 - DNA, 963 bp, Artificial Sequence
  Description of Artificial Sequence: Synthetic coding sequence
atggccggcctggccgcccggctggtgctgctggccggggctgctgccctggccagcggcagccagggcgaccgggagcctgtgtacagagactgtgtgctgcagtgtgaggagcagaactgcagcggcggggccctgaaccacttccgcagccggcagcccatctacatgagcctggccggctggacctgcagagatgactgcaagtatgagtgcatgtgggtgacagtgggcctgtacctgcaggagggccacaaggtgccccagttccacggcaagtggcccttcagccgcttcctgttcttccaggagcccgccagcgctgtggccagcttcctgaatggcctggccagcctggtgatgctgtgccgctaccgcacctttgtgcctgccagcagccccatgtaccacacctgtgtggcctttgcctgggtgtccctgaatgcctggttctggagcaccgtcttccacacccgggacacagacctgacagagaagatggactacttctgtgccagcaccgtcatcctgcacagcatctacctgtgctgcgtgaggacagtgggcctgcagcaccctgctgtggtgtctgccttccgggccctgctgctgctgatgctgactgtgcacgtgtcctacctgagcctcatccgctttgattatggctacaacctggtggccaacgtggccatcggcctggtgaatgtggtgtggtggctggcctggtgcctgtggaaccagaggcggctgccccacgtgaggaaatgtgtggtggtggtgctgctgctgcagggcctgagcctgctggagctgctggacttccccccactcttctgggtgctggatgcccacgccatctggcacatcagcaccatccctgtgcacgtgctcttcttctccttcctggaggatgacagcctgtacctgctgaaggagagcgaggacaagttcaagctggactag

SEQ ID NO: 36933 - DNA, 795 bp, Artificial Sequence
  Description of Artificial Sequence: Synthetic coding sequence
atgagcctggccggctggacctgcagagatgactgcaagtatgagtgcatgtgggtgacagtgggcctgtacctgcaggagggccacaaggtgccccagttccacggcaagtggcccttcagccgcttcctgttcttccaggagcccgccagcgctgtggccagcttcctgaatggcctggccagcctggtgatgctgtgccgctaccgcacctttgtgcctgccagcagccccatgtaccacacctgtgtggcctttgcctgggtgtccctgaatgcctggttctggagcaccgtcttccacacccgggacacagacctgacagagaagatggactacttctgtgccagcaccgtcatcctgcacagcatctacctgtgctgcgtgaggacagtgggcctgcagcaccctgctgtggtgtctgccttccgggccctgctgctgctgatgctgactgtgcacgtgtcctacctgagcctcatccgctttgattatggctacaacctggtggccaacgtggccatcggcctggtgaatgtggtgtggtggctggcctggtgcctgtggaaccagaggcggctgccccacgtgaggaaatgtgtggtggtggtgctgctgctgcagggcctgagcctgctggagctgctggacttccccccactcttctgggtgctggatgcccacgccatctggcacatcagcaccatccctgtgcacgtgctcttcttctccttcctggaggatgacagcctgtacctgctgaaggagagcgaggacaagttcaagctggactag

SEQ ID NO: 36934 - DNA, 810 bp, Artificial Sequence
  Description of Artificial Sequence: Synthetic coding sequence
atggccggcctggccgcccggctggtgctgctggccggggctgctgccctggccagcggcagccagggcgaccgggagcctgtgtacagagactgtgtgctgcagtgtgaggagcagaactgcagcggcggggccctgaaccacttccgcagccggcagcccatctacatgagcctggccggctggacctgcagagatgactgcaagtatgagtgcatgtgggtgacagtgggcctgtacctgcaggagggccacaaggtgccccagttccacggcaaggtgtccctgaatgcctggttctggagcacagtgttccacacccgggacacagacctgacagagaagatggactacttctgtgccagcaccgtcatcctgcacagcatctacctgtgctgcgtgaggacagtgggcctgcagcaccctgctgtggtgtctgccttccgggccctgctgctgctgatgctgactgtgcacgtgtcctacctgagcctcatccgctttgattatggctacaacctggtggccaacgtggccatcggcctggtgaatgtggtgtggtggctggcctggtgcctgtggaaccagaggcggctgccccacgtgaggaaatgtgtggtggtggtgctgctgctgcagggcctgagcctgctggagctgctggacttccccccactcttctgggtgctggatgcccacgccatctggcacatcagcaccatccctgtgcacgtgctcttcttctccttcctggaggatgacagcctgtacctgctgaaggagagcgaggacaagttcaagctggactag

SEQ ID NO: 36935 - DNA, 900 bp, Artificial Sequence
  Description of Artificial Sequence: Synthetic coding sequence
atggccggcctggccgcccggctggtgctgctggccggggctgctgccctggccagcggcagccagggcgaccgggagcctgtgtacagagactgtgtgctgcagtgtgaggagcagaactgcagcggcggggccctgaaccacttccgcagccggcagcccatctacatgagcctggccggctggacctgcagagatgactgcaagtatgagtgcatgtgggtgacagtgggcctgtacctgcaggagggccacaaggtgccccagttccacggcaagtggcccttcagccgcttcctgttcttccaggagcccgccagcgctgtggccagcttcctgaatggcctggccagcctggtgatgctgtgccgctaccgcacctttgtgcctgccagcagccccatgtaccacacctgtgtggcctttgcctggaagatggactacttctgtgccagcaccgtcatcctgcacagcatctacctgtgctgcgtgaggacagtgggcctgcagcaccctgctgtggtgtctgccttccgggccctgctgctgctgatgctgactgtgcacgtgtcctacctgagcctcatccgctttgattatggctacaacctggtggccaacgtggccatcggcctggtgaatgtggtgtggtggctggcctggtgcctgtggaaccagaggcggctgccccacgtgaggaaatgtgtggtggtggtgctgctgctgcagggcctgagcctgctggagctgctggacttccccccactcttctgggtgctggatgcccacgccatctggcacatcagcaccatccctgtgcacgtgctcttcttctccttcctggaggatgacagcctgtacctgctgaaggagagcgaggacaagttcaagctggactag

SEQ ID NO: 36936 - DNA, 819 bp, Artificial Sequence
  Description of Artificial Sequence: Synthetic coding sequence
atgagcagccaggagctggtgaccctgaatgtgggcggcaagatcttcaccacccgcttcagcaccatcaagcagtttcctgccagccggctggccaggatgctggatggccgggaccaggagttcaagatggtgggcggccagatctttgtggacagagatggagacctcttctccttcatcctggacttcctgcggacccaccagctgctgctgcccacagagttcagtgactacctgcggctgcagcgggaggccctcttctatgagctgcggagcctggtggacctgctgaacccctacctgctgcagcccaggcctgccctggtggaggtgcacttcctgagcaggaacacccaggccttcttccgggtgtttggcagctgcagcaagaccatcgagatgctgaccggccgcatcaccgtcttcacagagcagcccagcgcccccacctggaatggaaacttcttccccccccagatgaccctgctgcccctgcccccccagaggcccagctaccatgacctggtgttccagtgtggcagtgacagcaccacagacaaccagacaggagtgcgctacgtgtccatcaagccagacaacaggaagctggccaacggcaccaacgtgctgggcctgctgattgacaccctgctgaaggagggcttccacctggtgtccaccaggacagtgtcctctgaggacaagacagagtgctacagctttgagcgcatcaagagccctgaggtgctgatcaccaatgagacccccaagccagagaccatcatcatccctgagcagagccagatcaagaagtag

SEQ ID NO: 36937 - DNA, 690 bp, Artificial Sequence
  Description of Artificial Sequence: Synthetic coding sequence
atgagcagccaggagctggtgaccctgaatgtgggcggcaagatcttcaccacccgcttcagcaccatcaagcagtttcctgccagccggctggccaggatgctggatggccgggaccaggagttcaagatggtgggcggccagatctttgtggacagagatggagacctcttctccttcatcctggacttcctgcggacccaccagctgctgctgcccacagagttcagtgactacctgcggctgcagcgggaggccctcttctatgagctgcggagcctggtggacctgctgaacccctacctgctgcagcccaggcctgccctggtggaggtgcacttcctgagcaggaacacccaggccttcttccgggtgtttggcagctgcagcaagaccatcgagatgctgaccggccgcatcaccgtcttcacagagcagcccagcgcccccacctggaatggaaacttcttccccccccagatgaccctgctgcccctgcccccccagaggcccagctaccatgacctggtgttccagtgtggcagtgacagcaccacagacaaccagacaggagtgcggctggtgtgcaatggagtcatcagcgcccaccacaacctgcggctgtggggcagcagtgacagccctgccagcgccagccgggtggccggcatcaccggcatgttcctgtag

SEQ ID NO: 36938 - DNA, 978 bp, Artificial Sequence
  Description of Artificial Sequence: Synthetic coding sequence
atggccctggccgacagcacccggggcctgcccaacggcggcggcggcggcggcggcagcggcagcagcagcagcagcgctgagcccccactcttcccagacatcgtggagctgaatgtgggcggccaggtgtatgtgacccggcgctgcaccgtggtgtctgtgcctgacagcctgctgtggaggatgttcacccagcagcagccccaggagctggcccgggacagcaagggccgcttcttcctggacagagatggcttcctgttccgctacatcctggactacctgcgggacctgcagctggtgctgcctgactacttccctgagaggagccggctgcagcgggaggccgagtactttgagctgcctgagctggtgcggcggctgggcgccccccagcagcccggccctggccccccacccagcagaagaggagtgcacaaggagggcagcctgggagatgagctgctgcccctgggctacagcgagcctgagcagcaggagggcgccagcgctggggcccccagccccaccctggagctggccagccgcagccccagcggcggcgctgctggccccctgctgacccccagccagagcctggatggcagcagaagaagtggctacatcaccatcggctaccggggcagctacaccatcggcagagatgcccaggctgatgccaagttcagaagagtggcccgcatcaccgtgtgtgggaagaccagcctggccaaggaggtgtttggagacaccctgaatgaaagccgggaccctgaccggcccccagagcgctacaccagccgctactacctgaagttcaacttcctggagcaggcctttgacaagctgtctgagagcggcttccacatggtggcctgcagcagcacaggcacctgtgcctttgccagcagcacagaccagagcgaggacaagatctggaccagctacacagaatatgtgttctgccgggagtag

SEQ ID NO: 36939 - DNA, 978 bp, Artificial Sequence; identical to SEQ ID NO: 36938
  Description of Artificial Sequence: Synthetic coding sequence

SEQ ID NO: 36940 - DNA, 768 bp, Artificial Sequence
  Description of Artificial Sequence: Synthetic coding sequence
atgtggcagggctgtgctgtggagaggcctgtgggccgcatgaccagccagacccccctgccccagagcccccggccccggcggcccaccatgagcacagtggtggagctgaatgtgggcggggagttccacaccaccaccctgggcaccctgaggaagtttcctggcagcaagctggccgagatgttcagcagcctggccaaggccagcacagatgctgagggccgcttcttcatcgaccggcccagcacctacttccggcccatcctggactacctgaggacaggccaggtgcccacccagcacatccctgaggtgtaccgggaggcccagttctatgagatcaagcccctggtgaagctgctggaggacatgccccagatctttggagagcaggtgtccaggaagcagttcctgctgcaggtgcccggctacagcgagaacctggagctgatggtgcggctggcccgggcagaggccatcacagccaggaagagctctgtgctggtgtgcctggtggagacagaggagcaggatgcctactacagcgaggtgctgtgcttcctgcaggacaagaagatgttcaagtctgtggtgaagtttggcccctggaaggctgtgctggacaacagcgacctgatgcactgcctggagatggacatcaaggcccagggctacaaggtgttcagcaagttctacctgacctaccccaccaagagaaatgagttccacttcaacatctacagcttcaccttcacctggtggtag

SEQ ID NO: 36941 - DNA, 678 bp, Artificial Sequence
  Description of Artificial Sequence: Synthetic coding sequence
atgagcacagtggtggagctgaatgtgggcggggagttccacaccaccaccctgggcaccctgaggaagtttcctggcagcaagctggccgagatgttcagcagcctggccaaggccagcacagatgctgagggccgcttcttcatcgaccggcccagcacctacttccggcccatcctggactacctgaggacaggccaggtgcccacccagcacatccctgaggtgtaccgggaggcccagttctatgagatcaagcccctggtgaagctgctggaggacatgccccagatctttggagagcaggtgtccaggaagcagttcctgctgcaggtgcccggctacagcgagaacctggagctgatggtgcggctggcccgggcagaggccatcacagccaggaagagctctgtgctggtgtgcctggtggagacagaggagcaggatgcctactacagcgaggtgctgtgcttcctgcaggacaagaagatgttcaagtctgtggtgaagtttggcccctggaaggctgtgctggacaacagcgacctgatgcactgcctggagatggacatcaaggcccagggctacaaggtgttcagcaagttctacctgacctaccccaccaagagaaatgagttccacttcaacatctacagcttcaccttcacctggtggtag

SEQ ID NO: 36942 - DNA, 861 bp, Artificial Sequence
  Description of Artificial Sequence: Synthetic coding sequence
gatgcccagatgccccacaggaaggagcggcccagcggcagcagcctgcacacccacggcagcactggaacagctgagggcggcaacatgagccggctgagcctgaccaggagccctgtgagccccctggccgcccagggcatccccctgcctgcccagctgaccaagagcaatgcccctgtgcacattgatgtgggcggccacatgtacaccagcagcctggccaccctgaccaagtacccagacagccgcatcagccgcctcttcaacggcacagagcccatcgtgctggacagcctgaagcagcactacttcatcgacagagatggagagatcttccgctacgtgctgtccttcctgcggaccagcaagctgctgctgcctgatgacttcaaggacttcagcctgctgtatgaggaggcccgctactaccagctgcagcccatggtgcgggagctggagcgctggcagcaggagcaggagcagaggcggcgcagccgggcctgtgactgcctggtggtgcgggtgaccccagacctgggggagcgcatcgccctgtctggagagaaggccctgattgaggaggtgtttcctgagactggagatgtgatgtgcaacagcgtgaatgccggctggaaccaggaccccacccacgtgatccgcttccccctgaatggctactgccgcctgaacagcgtgcaggtgctggagcggctcttccagaggggcttctctgtggccgccagctgtggcggcggcgtggacagcagccagttctctgaatatgtgctgtgccgggaggagcggcggccccagcccacccccacagctgtgcgcatcaagcaggagcccctggactag

SEQ ID NO: 36943 - DNA, 852 bp, Artificial Sequence
  Description of Artificial Sequence: Synthetic coding sequence
atgccccacaggaaggagcggcccagcggcagcagcctgcacacccacggcagcactggaacagctgagggcggcaacatgagccggctgagcctgaccaggagccctgtgagccccctggccgcccagggcatccccctgcctgcccagctgaccaagagcaatgcccctgtgcacattgatgtgggcggccacatgtacaccagcagcctggccaccctgaccaagtacccagacagccgcatcagccgcctcttcaatggaacagagcccatcgtgctggacagcctgaagcagcactacttcatcgacagagatggagagatcttccgctacgtgctgtccttcctgcggaccagcaagctgctgctgcctgatgacttcaaggacttcagcctgctgtatgaggaggcccgctactaccagctgcagcccatggtgcgggagctggagcgctggcagcaggagcaggagcagaggagaagaagccgggcctgtgactgcctggtggtgcgggtgaccccagacctgggggagagaattgccctgagcggggagaaggccctgattgaggaggtgtttcctgagactggagatgtgatgtgcaacagcgtgaatgccggctggaaccaggaccccacccacgtgatccgcttccccctgaatggctactgccgcctgaacagcgtgcaggtgctggagcggctcttccagaggggcttctctgtggccgccagctgtggcggcggcgtggacagcagccagttctctgaatatgtgctgtgccgggaggagcggcggccccagcccacccccacagctgtgcgcatcaagcaggagcccctggactag

SEQ ID NO: 36944 - DNA, 894 bp, Artificial Sequence
  Description of Artificial Sequence: Synthetic coding sequence
atgcagacccccaggcctgccatgaggatggaggccggggaggccgcccctcctgctggagctgggggccgggccgccggcggctggggcaagtgggtgcggctgaatgtgggcggcaccgtcttcctgaccacccggcagaccctgtgccgggagcagaagagcttcctgagccggctgtgccagggcgaggagctgcagagcgacagagatgaaacaggagcctacctgattgaccgggaccccacctacttcggccccatcctgaacttcctgcggcacggcaagctggtgctggacaaggacatggccgaggagggcgtgctggaggaggccgagttctacaacatcggccccctcatccgcatcatcaaggacaggatggaggagaaggactacacagtgacccaggtgccccccaagcacgtgtacagagtgctgcagtgccaggaggaggagctgacccagatggtgtccaccatgtctgatggctggaggtttgagcagctggtgaacatcggcagcagctacaactacggcagcgaggaccaggccgagttcctgtgtgtggtgtccaaggagctgcacagcacccccaacggcctgagcagcgagagcagcaggaagaccaagagcacagaggagcagctggaggagcagcagcagcaggaggaggaggtggaggaggtggaggtggagcaggtgcaggtggaggctgatgcccaggagaagggcagccggccccaccccctgcggcctgaggccgagctggccgtgcgggccagcccccggcccctggcccggccccagagctgccacccctgctgctacaagccagaggcccctggctgtgaggccccagaccacctgcagggcctgggcgtgcccatctag

SEQ ID NO: 36945 - DNA, 966 bp, Artificial Sequence
  Description of Artificial Sequence: Synthetic coding sequence
atgcagacccccaggcctgccatgaggatggaggccggggaggccgcccctcctgctggagctgggggccgggccgccggcggctggggcaagtgggtgcggctgaatgtgggcggcaccgtcttcctgaccacccggcagaccctgtgccgggagcagaagagcttcctgagccggctgtgccagggcgaggagctgcagagcgacagagatgaaacaggagcctacctgattgaccgggaccccacctacttcggccccatcctgaacttcctgcggcacggcaagctggtgctggacaaggacatggccgaggagggcgtgctggaggaggccgagttctacaacatcggccccctcatccgcatcatcaaggacaggatggaggagaaggactacacagtgacccaggtgccccccaagcacgtgtacagagtgctgcagtgccaggaggaggagctgacccagatggtgtccaccatgtctgatggctggaggtttgagcagctggtgaacatcggcagcagctacaactacggcagcgaggaccaggccgagttcctgtgtgtggtgtccaaggagctgcacagcacccccaacggcctgagcagcgagagcagcaggaagaccaagagcacagaggagcagctggaggagcagcagcagcaggaggaggaggtggaggaggtggaggtggagcaggtgcaggtggaggctgatgcccaggagaaggcccagagcagccaggaccctgccaacctcttcagcctgccccccctgcccccaccacccctgcctgctgggggcagccggccccaccccctgcggcctgaggccgagctggccgtgcgggccagcccccggcccctggcccggccccagagctgccacccctgctgctacaagccagaggcccctggctgtgaggccccagaccacctgcagggcctgggcgtgcccatctag

SEQ ID NO: 36946 - DNA, 192 bp, Artificial Sequence
  Description of Artificial Sequence: Synthetic coding sequence
atgaccagcaaggtgtcctgcccccccagcgtgaccctgcgctgctgcggcctgtggcaggtggccagccccctgaatgtgtctgacctgagtgatgagaccggggcctacctgattgaccgggaccccacctacttcggccccatcctgaacttcctgcggcacggcaagctggtgctggacaaggactag

SEQ ID NO: 36947 - DNA, 543 bp, Artificial Sequence
  Description of Artificial Sequence: Synthetic coding sequence
tgacagaccctgtgccgggagcagaagagcttcctgagccggctgtgccagggcgaggagctgcagagcgacagagatgagaccggggcctacctgattgaccgggaccccacctacttcggccccatcctgaacttcctgcggcacggcaagctggtgctggacaaggacatggccgaggagggcgtgctggaggaggccgagttctacaacatcggccccctcatccgcatcatcaaggacaggatggaggagaaggactacacagtgacccaggtgccccccaagcacgtgtacagagtgctgcagtgccaggaggaggagctgacccagatggtgtccaccatgtctgatggctggaggtttgagcagctggtgaacatcggcagcagctacaactacggcagcgaggaccaggccgagttcctgtgtgtggtgtccaaggagctgcacagcaccccaaatggcctgagcagcgagagcagcaggaagaccaaggtgcctgtgaggaccctgagtgacctgcggctgagcctgcagtag

SEQ ID NO: 36948 - DNA, 1281 bp, Artificial Sequence
  Description of Artificial Sequence: Synthetic coding sequence
atggagggccacaaggccgaggaggaggtgctggatgtgctgcggctgaatgtgggcggctgcatctacacagcccggcgggagagcctgtgccgcttcaaggacagcatgctggcctccatgttttctggccgcttccccctgaagacagatgaaagtggggcctgcgtcatcgacagagatggccgcctcttcaagtacctgctggactacctgcatggagaggtgcagatccccacagatgagcagacccgcatcgccctgcaggaggaggccgactacttcggcatcccctacccctacagcctgagtgaccacctggccaatgagatggagacctacagcctgcggagcaacatcgagctgaagaaggccctgacagacttctgtgacagctatggcctggtgtgcaacaagcccaccgtgtgggtgctgcactacctgaacaccagcggggccagctgtgagagccgcatcatcggcgtgtatgccaccaagacagatggaacagatgccatcgagaagcagctgggcggccgcatccacagcaagggcatcttcaagcgggaggccggcaacaacgtgcagtacatctggagctactacagcgtggccgagctgaagaagatgatggatgcctttgatgcctgggagggcaagggcgtgtcctactggagggtgccccatgagctgattgagtgctggaccctggaggagcggcccctgctgggcagcctgcggcacatggcccccatcaggaagagaagactcatcaccttcaatgaagcagatgagagcgtgaactacaagacaggccccaagcctgtgcgcttcctgggccccagcaccagcacccagatcaaggtgaagaacagcgcctctgtgacagtgtccccagccagcgccatccagaccagcgctggggccacagccaaccgcttccagagcggcagcaggaggaaggccgcccagaggtctgcccccagccgggccacagccctggtgggcactggagcccctggccacccccaggccagccctggagctgccagcgcagaaaatggaggcacccacctgcccccagccaaggtgctgctgagtgacaagaagcccaccccccagagggtcatcaagctgaagaggacccccctgtgtgccacagccccctgcctgcccagccccacagccacccggcaggccaacagcctgaagcccctgcctggagaggccgcccgggccctgggcgtgaggacagaaaatggcaagaacaagggcaactag

SEQ ID NO: 36949 - DNA, 1281 bp, Artificial Sequence; identical to SEQ ID NO: 36948
  Description of Artificial Sequence: Synthetic coding sequence

SEQ ID NO: 36950 - DNA, 2781 bp, Artificial Sequence
  Description of Artificial Sequence: Synthetic coding sequence
atggaggagagcggcatggcccacgagagcgctgaggacctcttccacttcaacgtgggcggctggcacttctctgtgcccaggagcaagctgagccagttcccagacagcctgctgtggaaggaggccagcgccctgaccagcagcgagagccagaggctcttcatcgacagagatggcagcaccttcagacatgtgcactactacctgtacaccagcaagctgtccttcagcagctgtgccgagctgaacctgctgtatgagcaggccctgggcctgcagctgatgcccctgctgcagaccctggacaacctgaaggagggcaagcaccacctgcgggtgcggcctgctgacctgcctgtggccgagcgggccagcctgaactactggaggacctggaagtgcatcagcaagcccagcgagttccccatcaagagccctgccttcaccggcctgcatgacaaggcccccctgggcctgatggacacccccctgctggacacagaggaggaggtgcactactgcttcctgcccctggacctggtggccaagtaccccagcctggtgacagaggacaacctgctgtggctggccgagaccgtggccctgattgaatgtgaatgttctgagttccgcttcatcgtgaacttcctgcggagccagaagatcctgctgcctgacaacttcagcaacattgatgtgctggaggccgaggtggagatcctggagatcccagccctgacagaggccgtgcgctggtacaggatgaacatgggcggctgcagccccaccacctgcagccccctgagccctggaaaaggagccaggacagccagcctggagagcgtgaagcccctgtacaccatggccctgggcctgctggtgaagtacccagacagcgccctgggccagctgagaattgagagcaccctggatggcagccggctgtacatcactggaaatggagtgctcttccagcacgtgaagaactggctgggcacctgccgcctgcccctgacagagaccatcagcgaggtgtatgagctgtgtgccttcctggacaagagggacatcacctatgagcccatcaaggtggccctgaagacccacctggagcccaggaccctggcccccatggatgtgctgaatgagtggacagctgagatcaccgtgtacagcccccagcagatcatcaaggtgtatgtgggcagccactggtacgccaccaccctgcagaccctgctgaagtacccagagctgctgagcaacccccagagggtgtactggatcacctacggccagaccctgctgattcatggagatggccagatgttccgccacatcctgaacttcctgcggctgggcaagctgttcctgcccagcgagttcaaggagtggcccctcttctgccaggaggtggaggagtaccacatccccagcctgtctgaggccctggcccagtgtgaggcctacaagtcctggacccaggagaaggagagtgaaaatgaggaggccttcagcatccggcggctgcacgtggtgacagagggccctggcagcctggtggagttcagccgggacaccaaggagaccacagcctacatgcctgtggactttgaggactgcagcgacaggaccccctggaacaaggccaagggcaacctggtgcgcagcaaccagatggatgaggccgagcagtacacccggcccatccaggtgtccctgtgcagaaatgccaagagagctggcaaccccagcacctacagccactgccggggcctgtgcaccaaccctggccactggggcagccaccctgagagcccccccaagaagaagtgcaccaccatcaacctgacccagaagtctgagaccaaggaccccccagccacccccatgcagaagctgatcagcctggtgcgggagtgggacatggtgaactgcaagcagtgggagttccagcccctgacagccaccaggagcagccccctggaggaggccaccctgcagctgcccctgggcagcgaggccgccagccagcccagcaccagcgctgcctggaaggcccacagcacagccagcgagaaggaccccggcccccaggccggggccggggccggggccaaggacaagggccctgagcccaccttcaagccctacctgccccccaagagagctggcaccctgaaggactggagcaagcagaggaccaaggagcgggagagccctgcccctgagcagcccctgcctgaggccagcgaggtggacagcctgggcgtcatcctgaaggtgacccacccccctgtggtgggcagtgatggcttctgcatgttctttgaagattccatcatctacaccacagagatggacaacctgcggcacaccacccccacagccagcccccagccccaggaggtgaccttcctgtccttcagcctgtcctgggaggagatgttttatgcccagaagtgccactgcttcctggccgacatcatcatggacagcatccggcagaaggaccccaaggccatcacagccaaggtggtgtccctggccaaccggctgtggaccctgcacatcagccccaagcagtttgtggtggacctgctggccatcaccggcttcaaggatgacagacacacccaggagcggctgtacagctgggtggagctgaccctgccctttgccaggaaatatggccgctgcatggacctgctgatccagaggggcctgagccgctctgtgtcctacagcatcctgggcaagtacctgcaggaggactag

SEQ ID NO: 36951 - DNA, 1260 bp, Artificial Sequence
  Description of Artificial Sequence: Synthetic coding sequence
atgaatgtgcaccggggcagtgacagcgaccggctgctgcggcaggaggccagctgcctggtggatgacaccctggccgtggcccaggagaaggaggccaacagcctggccagcagcggcccccacaacctgacctaccccctgggccccagaaatgaagacctgagcctggactatgccagccagcctgccaacctgcagttcccccacatcatgcccctggccgaggacatcaagggcagctgcttccagagcggcaacaagagaaatcatgagcccttcatcgcccctgagcgcttcggcaacagctctgtgggcttcggcagcaacagccacagccaggcccctgagaaggtgaccctgctggtggatggcaccaggtttgtggtgaacccccagatcttcaccgcccacccagacaccatgctgggccgcatgtttggacctggccgggagtacaacttcacccggcccaatgaaaaaggagaatatgaaattgctgagggcatcagcgccaccgtcttcagaacagtgctggactactacaagacaggcatcatcaactgcccagatggcatcagcatcccagacctgcgggacacctgtgactacctgtgcatcaactttgacttcaacaccatccgctgccaggacctgagcgccctgctgcacgagctgagcaatgatggagcccacaagcagtttgaccactacctggaggagctgatcctgcccatcatggtgggctgtgccaagaagggggagcgggagtgccacatcgtggtgctgacagatgaggacagcgtggactgggatgaggaccaccccccacccatgggagaggagtacagccagatcctgtacagcagcaagctgtaccgcttcttcaagtacatcgagaacagagatgtggccaagacagtgctgaaggagcggggcctgaagaacatcagaattggaattgagggctaccccacctgcaaggagaagatcaagagaagacctgggggccgctctgaggtgatctacaactacgtgcagaggcccttcatccagatgtcctgggagaaggaggagggcaagagccgccacgtggacttccagtgtgtgcgcagcaagagcctgaccaacctggtggccgctggagatgatgtgctggaggaccaggagatcctgatgcaccaccccccccaggtggatgagctggaccggctgaatgcccccctgagccagatggccagcaatgacttccaggactag

SEQ ID NO: 36952 - DNA, 762 bp, Artificial Sequence
  Description of Artificial Sequence: Synthetic coding sequence
atgaatgtgcaccggggcagtgacagcgaccggctgctgcggcaggaggccagctgcctggtggatgacaccctggccgtggcccaggagaaggaggccaacagcctggccagcagcggcccccacaacctgacctaccccctgggccccagaaatgaaggagccctgctgcacgagctgagcaatgatggagcccacaagcagtttgaccactacctggaggagctgatcctgcccatcatggtgggctgtgccaagaagggggagcgggagtgccacatcgtggtgctgacagatgaggacagcgtggactgggatgaggaccaccccccacccatgggagaggagtacagccagatcctgtacagcagcaagctgtaccgcttcttcaagtacatcgagaacagagatgtggccaagacagtgctgaaggagcggggcctgaagaacatcagaattggaattgagggctaccccacctgcaaggagaagatcaagagaagacctgggggccgctctgaggtgatctacaactacgtgcagaggcccttcatccagatgtcctgggagaaggaggagggcaagagccgccacgtggacttccagtgtgtgcgcagcaagagcctgaccaacctggtggccgctggagatgatgtgctggaggaccaggagatcctgatgcaccaccccccccaggtggatgagctggaccggctgaatgcccccctgagccagatggccagcaatgacttccaggactag

SEQ ID NO: 36953 - DNA, 264 bp, Artificial Sequence
  Description of Artificial Sequence: Synthetic coding sequence
atgaatgtgcaccggggcagtgacagcgaccggctgctgcggcaggaggccagctgcctggtggatgacaccctggccgtggcccaggagaaggaggccaacagcctggccagcagcggcccccacaacctgacctaccccctgggccccagaaatgaagacctgagcctggactatgccagccagcctgccaacctgcagttcccccacatcatgcccctggccgaggacatcaagggcagctgcttccagagcggcaactag

SEQ ID NO: 36954 - DNA, 330 bp, Artificial Sequence
  Description of Artificial Sequence: Synthetic coding sequence
atgaatgtgcaccggggcagtgacagcgaccggctgctgcggcaggaggccagctgcctggtggatgacaccctggccgtggcccaggagaaggaggccaacagcctggccagcagcggcccccacaacctgacctaccccctgggccccagaaatgaagacctgagcctggactatgccagccagcctgccaacctgcagttcccccacatcatgcccctggccgaggacatcaagggcagctgcttccagagcggcaacaagagaaatcatgagcccttcatcgcccctgagcgcttcggcaacagctctgtgggcttcggcagctag

SEQ ID NO: 36955 - DNA, 294 bp, Artificial Sequence
  Description of Artificial Sequence: Synthetic coding sequence
atgaatgtgcaccggggcagtgacagcgaccggctgctgcggcaggaggccagctgcctggtggatgacaccctggccgtggcccaggagaaggaggccaacagcctggccagcagcggcccccacaacctgacctaccccctgggccccagaaatgaagacctgagcctggactatgccagccagcctgccaacctgcagttcccccacatcatgcccctggccgaggacatcaagggcagctgcttccagagcggcaacaagagaaatcatgagcccttcatcgccccctag

SEQ ID NO: 36956 - DNA, 825 bp, Artificial Sequence
  Description of Artificial Sequence: Synthetic coding sequence
atgtttggacctggccgggagtacaacttcacccggcccaatgagaagggggagtatgaaattgctgagggcatcagcgccaccgtcttcagaacagtgctggactactacaagacaggcatcatcaactgcccagatggcatcagcatcccagacctgcgggacacctgtgactacctgtgcatcaactttgacttcaacaccatccgctgccaggacctgagcgccctgctgcacgagctgagcaatgatggagcccacaagcagtttgaccactacctggaggagctgatcctgcccatcatggtgggctgtgccaagaagggggagcgggagtgccacatcgtggtgctgacagatgaagattctgtggactgggatgaggaccaccccccacccatgggagaggagtacagccagatcctgtacagcagcaagctgtaccgcttcttcaagtacattgaaaatagagatgtggccaagacagtgctgaaggagcggggcctgaagaacatccgcatcggcatcgagggctaccccacctgcaaggagaagatcaagaggaggcctgggggccgctctgaggtgatctacaactacgtgcagaggcccttcatccagatgtcctgggagaaggaggagggcaagagcagacatgtggacttccagtgtgtgcgcagcaagagcctgaccaacctggtggccgctggagatgatgtgctggaggaccaggagatcctgatgcaccaccccccccaggtggatgagctggaccggctgaatgcccccctgagccagatggccagcaatgacttccaggactag

SEQ ID NO: 36957 - DNA, 522 bp, Artificial Sequence
  Description of Artificial Sequence: Synthetic coding sequence
atggtgggctgtgccaagaagggggagcgggagtgccacatcgtggtgctgacagatgaggacagcgtggactgggatgaggaccaccccccacccatgggagaggagtacagccagatcctgtacagcagcaagctgtaccgcttcttcaagtacatcgagaacagagatgtggccaagacagtgctgaaggagcggggcctgaagaacatcagaattggaattgagggctaccccacctgcaaggagaagatcaagagaagacctgggggccgctctgaggtgatctacaactacgtgcagaggcccttcatccagatgtcctgggagaaggaggagggcaagagccgccacgtggacttccagtgtgtgcgcagcaagagcctgaccaacctggtggccgctggagatgatgtgctggaggaccaggagatcctgatgcaccaccccccccaggtggatgagctggaccggctgaatgcccccctgagccagatggccagcaatgacttccaggactag

SEQ ID NO: 36958 - DNA, 783 bp, Artificial Sequence
  Description of Artificial Sequence: Synthetic coding sequence
atgtctgaccccatcaccctgaatgtgggcggcaagctgtacaccaccagcctggccaccctgaccagcttcccagacagcatgctgggcgccatgttcagcggcaagatgcccaccaagagggacagccagggcaactgcttcatcgacagagatggcaaggtgttccgctacatcctgaacttcctgcggaccagccacctggacctgcctgaggacttccaggagatgggcctgctgcggcgggaggccgacttctaccaggtgcagcccctgattgaggccctgcaggagaaggaggtggagctgagcaaggccgagaagaatgccatgctgaacatcaccctgaaccagagggtgcagacagtgcacttcaccgtgcgggaggccccccagatctacagcctgagcagcagctccatggaggtgttcaatgccaacatcttcagcaccagctgcctcttcctgaagctgctgggcagcaagctgttctactgcagcaatggaaacctgagcagcatcaccagccacctgcaggaccccaaccacctgaccctggactgggtggccaacgtggagggcctgcctgaggaggagtacaccaagcagaacctgaagaggctgtgggtggtgcctgccaacaagcagatcaacagcttccaggtgtttgtggaggaggtgctgaagatcgccctgagtgatggcttctgcatcgacagcagccacccccacgccctggacttcatgaacaacaagatcatccgcctcatccgctacagatag

SEQ ID NO: 36959 - DNA, 423 bp, Artificial Sequence
  Description of Artificial Sequence: Synthetic coding sequence
atgtctgaccccatcaccctgaatgtgggcggcaagctgtacaccaccagcctggccaccctgaccagcttcccagacagcatgctgggcgccatgttcagcggcaagatgcccaccaagagggacagccagggcaactgcttcatcgacagagatggcaaggtgttccgctacatcctgaacttcctgcggaccagccacctggacctgcctgaggacttccaggagatgggcctgctgcggcgggaggccgacttctaccaggtgcagcccctgattgaggccctgcaggagaaggaggtggagctgagcaaggccgagaagaatgccatgctgaacatcaccctgaaccagagggtgcagacagtgcacttcaccgtgcgggaggccccccagatctacagcctgagcagcagcagctag

SEQ ID NO: 36960 - DNA, 780 bp, Artificial Sequence
  Description of Artificial Sequence: Synthetic coding sequence
atggagaggaagatcaacagaagagagaaggagaaggagtatgagggcaagcacaacagcctggaggacacagaccagggcaagaactgcaagagcaccctgatgaccctgaatgtgggcggctacctgtacatcacccagaagcagaccctgaccaagtacccagacaccttcctggagggcatcgtgaatggcaagatcctgtgcccctttgatgctgatggccactacttcatcgacagagatggcctgctcttccgccacgtgctgaacttcctgagaaatggagagctgctgctgcctgagggcttccgggagaaccagctgctggcccaggaggccgagttcttccagctgaagggcctggccgaggaggtgaagagccgctgggagaaggagcagctgaccccccgggagaccaccttcctggagatcacagacaaccacgacaggagccagggcctgcgcatcttctgcaatgccccagacttcatcagcaagatcaagagccgcatcgtgctggtgtccaagagccggctggatggcttccctgaggagttcagcatcagcagcaacatcatccagttcaagtacttcatcaagtcagaaaatggcacccggctggtgctgaaggaggacaacacctttgtgtgcaccctggagaccctgaagtttgaggccatcatgatggccctgaagtgtggcttccggctgctgaccagcctggactgcagcaagggcagcatcgtgcacagtgatgccctgcacttcatcaagtag

SEQ ID NO: 36961 - DNA, 780 bp, Artificial Sequence; identical to SEQ ID NO: 36960
  Description of Artificial Sequence: Synthetic coding sequence

SEQ ID NO: 36962 - DNA, 705 bp, Artificial Sequence
  Description of Artificial Sequence: Synthetic coding sequence
atggccgagaaccactgtgagctgctgagccctgcccggggcggcatcggggccggcctgggcggcggcctgtgccgccgctgcagcgctggcctgggcgccctggcccagaggcctggctctgtgtccaagtgggtgcggctgaatgtgggcggcacctacttcctgaccacccggcagaccctgtgccgggaccccaagagcttcctgtaccgcctgtgccaggccgaccctgacctggacagcgacaaggatgaaacaggagcctacctgattgaccgggaccccacctactttggacctgtgctgaactacctgcggcacggcaagctggtgatcaacaaggacctggccgaggagggcgtgctggaggaggccgagttctacaacatcaccagcctcatcaagctggtgaaggacaagatccgggagcgggacagcaagaccagccaggtgcctgtgaagcacgtgtacagagtgctgcagtgccaggaggaggagctgacccagatggtgtccaccatgtctgatggctggaagtttgagcagctggtgtccatcggcagcagctacaactatggaaatgaagaccaggccgagttcctgtgtgtggtgtccaaggagctgcacaacaccccctacggcacagccagcgagcccagcgagaaggccaagatcctgcaggagcggggcagcaggatgtag

SEQ ID NO: 36963 - DNA, 714 bp, Artificial Sequence
  Description of Artificial Sequence: Synthetic coding sequence
atggacaatggagactggggctacatgatgacagatcctgtgaccctgaatgtgggcggccacctgtacaccaccagcctgaccaccctgacccgctacccagacagcatgctgggcgccatgtttggaggagacttccccacagcccgggacccccagggcaactacttcatcgacagagatggccccctcttccgctacgtgctgaacttcctgcggaccagcgagctgaccctgcccctggacttcaaggagtttgacctgctgaggaaggaggccgacttctaccagatcgagcccctcatccagtgcctgaatgaccccaagcccctgtaccccatggacacctttgaggaggtggtggagctgagcagcaccaggaagctgagcaagtacagcaaccctgtggccgtcatcatcacccagctgaccatcaccaccaaggtgcacagcctgctggagggcatcagcaactacttcaccaagtggaacaagcacatgatggacacccgggactgccaggtgtccttcaccttcggcccctgtgactaccaccaggaggtgtccctgcgggtgcacctgatggagtacatcaccaagcagggcttcaccatccggaacaccagggtgcaccacatgtctgagcgggccaatgaaaatacagtggagcacaactggaccttctgccgcctggccaggaagacagatgactag

SEQ ID NO: 36964 - DNA, 714 bp, Artificial Sequence; identical to SEQ ID NO: 36963
  Description of Artificial Sequence: Synthetic coding sequence

SEQ ID NO: 36965 - DNA, 30 bp, Artificial Sequence
  Description of Artificial Sequence: Synthetic coding sequence
atggacaatggagactggggctacatgtag

SEQ ID NO: 36966 - DNA, 714 bp, Artificial Sequence; identical to SEQ ID NO: 36963
  Description of Artificial Sequence: Synthetic coding sequence

SEQ ID NO: 36967 - DNA, 1422 bp, Artificial Sequence
  Description of Artificial Sequence: Synthetic coding sequence
atggccctgaaggacaccggcagcggcggcagcaccatcctgcccatcagcgagatggtgagcagcagcagcagccctggggccagcgctgctgctgcccctggcccctgtgcccccagccccttccctgaggtggtggagctgaatgtgggcggccaggtgtatgtgaccaagcacagcaccctgctgtctgtgcctgacagcaccctggcctccatgttcagccccagcagcccccggggcggggccaggagaagaggagagctgccccgggacagccgggcccgcttcttcatcgacagagatggcttcctgttccgctacgtgctggactacctgcgggacaagcagctggccctgcctgagcacttccctgagaaggagcggctgctgcgggaggccgagtacttccagctgacagacctggtgaagctgctgagccccaaggtgaccaagcagaacagcctgaatgatgagggctgccagagcgacctggaggacaacgtgtcccagggcagcagtgatgccctgctgctgcggggagctgctgctgctgtgcccagcggccctggggcccatggaggcggcggcggcggcggggcccaggacaagaggagcggcttcctgaccctgggctaccggggcagctacaccaccgtgcgggacaaccaggctgatgccaagttccggcgggtggcccgcatcatggtgtgtggcagaattgccctggccaaggaggtgtttggagacaccctgaatgaaagccgggaccctgaccggcagcctgagaagtacaccagccgcttctacctgaagttcacctacctggagcaggcctttgaccggctgtctgaggccggcttccacatggtggcctgcaacagcagcggcacagctgcctttgtgaaccagtacagagatgacaagatctggagcagctacacagagtacatcttcttccggcccccccagaagatcgtgagccccaagcaggagcacgaggacaggaagcatgacaaggtgacagacaagggcagcgagagcggcaccagctgcaatgagctgagcaccagcagctgtgacagccacagcgaggccagcaccccccaggacaaccccagcagcgcccagcaggccacagcccaccagcccaacaccctgaccctggaccggcccagcaagaaggcccctgtgcagtggatccccccaccagacaagagaagaaacagcgagctgttccagaccctcatcagcaagagccgggagaccaacctgagcaagaagaaggtgtgtgagaagctgtctgtggaggaggagatgaagaagtgcatccaggacttcaagaagatccacatcccagactacttccctgagaggaagaggcagtggcagagcgagctgctgcagaagtatggcctgtag

SEQ ID NO: 36968 - DNA, 2751 bp, Artificial Sequence
  Description of Artificial Sequence: Synthetic coding sequence
atgagctacaccctggacagcctgggcaaccccagcgcctacagaagagtgacagagaccaggagcagcttcagccgggtgtctggcagccccagcagcggcttccgcagccagagctggagccggggcagccccagcacagtgagcagcagctacaagaggtccatgctggccccccggctggcctacagcagcgccatgctgagcagcgctgagagcagcctggacttcagccagagcagcagcctgctgaatggaggcagcggccctggaggagactacaagctgagccgcagcaatgagaaggagcagctgcagggcctgaatgacagatttgctggctacatcgagaaggtgcactacctggagcagcagaacaaggagattgaagctgagatccaggccctgcggcagaagcaggccagccacgcccagctgggagatgcctatgaccaggagatccgggagctgcgggccaccctggagatggtgaaccacgagaaggcccaggtgcagctggacagcgaccacctggaggaggacatccaccggctgaaggagagatttgaggaggaggcccggctgagagatgacacagaagctgccatccgggccctgaggaaggacatcgaggaggccagcctggtgaaggtggagctggacaagaaggtgcagagcctgcaggatgaggtggccttcctgcggagcaaccacgaggaggaggtggccgacctgctggcccagatccaggccagccacatcaccgtggagaggaaggactacctgaagacagacatcagcacagccctgaaggagatccgcagccagctggagagccacagcgaccagaacatgcaccaggccgaggagtggttcaagtgccgctatgccaagctgacagaggccgctgagcagaacaaggaggccatccgcagcgccaaggaggagattgctgagtaccgccggcagctgcagagcaagagcattgagctggagagcgtgcggggcaccaaggagagcctggagcggcagctgagtgacatcgaggagcggcacaaccacgacctgagcagctaccaggacaccatccagcagctggagaatgagctgcggggcaccaagtgggagatggcccggcacctgcgggagtaccaggacctgctgaatgtgaagatggccctggacatcgagattgctgcctacaggaagctgctggagggggaggagacccgcttcagcacctttgctggcagcatcaccggccccctgtacacccaccggccccccatcaccatcagcagcaagatccagaagcccaaggtggaggcccccaagctgaaggtgcagcacaagtttgtggaggagatcatcgaggagaccaaggtggaggatgagaagtctgagatggaggaggccctgacagccatcacagaggagctggccgtgtccatgaaggaggagaagaaggaggccgctgaggagaaggaggaggagcctgaggccgaggaggaggaggtggccgccaagaagagccctgtgaaggccacagcccctgaggtgaaggaggaggagggggagaaggaggaggaggagggccaggaggaggaggaggaggaggatgagggcgccaagagtgaccaggccgaggagggcggcagcgagaaggagggcagcagcgagaaggaggagggggagcaggaggagggggagacagaagctgaggccgagggggaggaggccgaggccaaggaggagaagaaggtggaggagaagtctgaggaggtggccaccaaggaggagctggtggctgatgccaaggtggagaagccagagaaggccaagagccctgtgcccaagagccctgtggaggagaagggcaagagccctgtgcccaagagccctgtggaggagaagggcaagagccctgtgcccaagagccctgtggaggagaagggcaagagccctgtgcccaagagccctgtggaggagaagggcaagagccctgtgtccaagagccctgtggaggagaaggccaagagccctgtgcccaagagccctgtggaggaggccaagagcaaggccgaggtgggcaagggggagcagaaggaggaggaggagaaggaggtgaaggaggcccccaaggaggagaaggtggagaagaaggaggagaagcccaaggatgtgcctgagaagaagaaggccgagagccctgtgaaggaggaggccgtggccgaggtggtgaccatcaccaagtctgtgaaggtgcacctggagaaggagaccaaggaggagggcaagcccctgcagcaggagaaggagaaggagaaggccggcggggagggcggcagcgaggaggagggcagtgacaagggggccaagggcagcaggaaggaggacattgctgtgaatggagaggtggagggcaaggaggaggtggagcaggagaccaaggagaagggcagcggccgggaggaggagaagggcgtggtgaccaacggcctggacctgagccctgcagatgagaagaagggcggggacaagtctgaggagaaggtggtggtgaccaagacagtggagaagatcaccagcgagggcggagatggagccaccaagtacatcaccaagtctgtgacagtgacccagaaggtggaggagcacgaggagacctttgaggagaagctggtgtccaccaagaaggtggagaaggtgaccagccacgccatcgtgaaggaggtgacccagagcgactag

SEQ ID NO: 36969 - DNA, 1932 bp, Artificial Sequence
  Description of Artificial Sequence: Synthetic coding sequence
atggaggccgtggagaccggggagcggcccaccttcggggcctgggactatggagtgtttgccctgatgctgctggtgtccacaggcatcggcctgtgggtgggcctggcccggggcggccagaggtctgctgaggacttcttcaccggcggccggcggctggccgccctgcctgtgggcctgagcctgagcgccagcttcatgtctgctgtgcaggtgctgggcgtgcccagcgaggcctaccgctatggcctgaagttcctgtggatgtgcctgggccagctgctgaacagcgtgctgacagccctgctcttcatgcctgtgttctaccgcctgggcctgaccagcacctatgagtacctggagatgaggttcagcagagctgtgcggctgtgtggcaccctgcagtacatcgtggccaccatgctgtacacaggaattgtcatctatgccccagccctgatcctgaaccaggtgacaggcctggacatctgggccagcctgctgagcacaggcatcatctgcaccttctacacagctgtgggcggcatgaaggctgtggtgtggacagatgtgttccaggtggtggtgatgctgagcggcttctgggtggtgctggcccggggcgtgatgctggtgggcggcccccggcaggtgctgaccctggcccagaaccacagccgcatcaacctgatggacttcaacccagaccccaggagccgctacaccttctggacctttgtggtgggcggcaccctggtgtggctgtccatgtatggagtgaaccaggcccaggtgcagagatatgtggcctgcaggacagagaagcaggccaagctggccctgctgatcaaccaggtgggcctcttcctgattgtgtcctctgctgcctgctgcggcatcgtgatgtttgtgttctacacagactgtgaccccctgctgctgggccgcatcagcgccccagaccagtacatgcccctgctggtgctggacatctttgaggacctgcccggggtgcccggcctcttcctggcctgtgcctacagcggcaccctgagcacagccagcaccagcatcaatgccatggctgctgtgacagtggaggacctgatcaagccccggctgcggagcctggcccccaggaagctggtgatcatcagcaagggcctgagcctcatctacggcagcgcctgcctgactgtggccgccctgagcagcctgctgggcggcggcgtgctgcagggcagcttcaccgtgatgggcgtcatcagcggccccctgctgggcgccttcatcctgggcatgttcctgcctgcctgcaacaccccaggagtgctggccggcctgggcgccggcctggccctgagcctgtgggtggccctgggcgccaccctgtacccaccttctgagcagaccatgagggtgctgcccagcagcgctgcccgctgtgtggccctgtctgtgaatgccagcggcctgctggaccctgccctgctgcctgccaatgacagcagccgggcccccagcagcggcatggatgccagcaggcctgccctggccgacagcttctacgccatctcctacctgtactatggagccctgggcaccctgaccaccgtgctgtgtggggccctgatcagctgcctgaccggccccaccaagaggagcaccctggcccctggcctgctgtggtgggacctggcccggcagacagcctctgtggcccccaaggaggaggtggccatcctggatgacaacctggtgaagggccctgaggagctgcccaccggcaacaagaagcccccaggcttcctgcccaccaatgaagatagactcttcttcctgggccagaaggagctggagggcgccggctcctggaccccctgtgtgggccatgatggcggccgggaccagcaggagaccaacctgtag

SEQ ID NO: 36970 - DNA, 1230 bp, Artificial Sequence
  Description of Artificial Sequence: Synthetic coding sequence
atgaacagccacagctacaatggatctgtgggccggcccctgggcagcggccctggggccctgggccgggaccccccagaccctgaggccggccaccccccccagcccccccacagccctggcctgcaggtggtggtggccaagtctgagcccgcccggcccagccctggcagcccccggggccagccccaggaccaggatgatgatgaagatgatgaggaggatgaagctggccggcagagggccagcggcaagcccagcaatgtgggccaccggctgggccaccggcgggccctgtttgagaagaggaagaggctgagtgactatgccctgatcttcggcatgtttggcatcgtggtgatggtgacagaaacagagctgtcctggggcgtgtacaccaaggagagcctgtacagctttgccctgaagtgcctgatcagcctgagcacagccatcctgctgggcctggtggtgctgtaccacgcccgggagatccagctgttcatggtggacaacggggctgatgactggagaattgccatgacctgtgagagggtcttcctgatcagcctggagctggccgtgtgtgccatccaccctgtgcccggccactaccgcttcacctggacagcccggctggccttcacctacgcccccagcgtggccgaggctgatgtggatgtgctgctgagcatccccatgttcctgcggctgtacctgctgggccgggtgatgctgctgcacagcaagatcttcacagatgccagcagccgcagcatcggggccctgaacaagatcaccttcaacaccaggtttgtgatgaagaccctgatgaccatctgccccggcaccgtgctgctggtgttcagcatcagctcctggatcatcgccgcctggacagtgcgggtgtgtgagcgctaccatgacaagcaggaggtgaccagcaacttcctgggcgccatgtggctgatcagcatcaccttcctgagcatcggctatggagacatggtgccccacacctactgtgggaagggcgtgtgcctgctgaccggcatcatgggcgccggctgcacagccctggtggtggccgtggtggccaggaagctggagctgaccaaggccgagaagcacgtgcacaacttcatgatggacacccagctgaccaagagggtgaagaatgctgctgccaacgtgctgcgggagacctggctgatctgcaagatgggctag

SEQ ID NO: 36971 - DNA, 1311 bp, Artificial Sequence
  Description of Artificial Sequence: Synthetic coding sequence
atgggcctggcccgggccctgcggcggctgagcggggccctggacagcggggacagcagagctggagatgaggaggaggccggccctggcctgtgcagaaatggctgggccccagcccctgtgcagagccctgtgggcagaagaagaggccgctttgtgaagaaggatggccactgcaatgtgcgctttgtgaacctgggcggccagggcgcccgctacctgagtgacctcttcaccacctgtgtggatgtgcgctggcgctggatgtgcctgctcttcagctgcagcttcctggcctcctggctgctgtttggcctggccttctggctgattgccagcctgcatggagacctggccgcccctcctcctccagccccctgcttcagccacgtggccagcttcctggccgccttcctgtttgccctggagacccagaccagcatcggctacggcgtgcgctctgtgacagaggagtgcccagctgctgtggccgctgtggtgctgcagtgcatcgccggctgtgtgctggatgcctttgtggtgggcgctgtgatggccaagatggccaagcccaagaagagaaatgagaccctggtgttttctgaaaatgctgtggtggccctgcgggaccaccggctgtgcctgatgtggagggtgggcaacctgcggcgcagccacctggtggaggcccacgtgcgggcccagctgctgcagccccgggtgaccccagagggggagtacatccccctggaccaccaggatgtggatgtgggctttgatggcggcacagaccgcatcttcctggtgagccccatcaccatcgtgcatgaaattgacagcgccagccccctgtatgagctgggccgggcagagctggcccgggctgactttgagctggtggtgatcctggagggcatggtggaggccacagccatgaccacccagtgccgcagcagctacctgcccggggagctgctgtggggccacagatttgagcctgtgctcttccagaggggcagccagtatgaggtggactaccgccacttccacaggacctatgaggtgcccggcacccctgtgtgcagcgccaaggagctggatgagcgggcagagcaggccagccacagcctgaagagcagcttccctggcagcctgacagccttctgctatgaaaatgagctggccctgagctgctgccaggaggaggatgaagatgatgaaacagaggagggcaatggagtggagacagaagatggagctgccagcccccgggtgctgacccccaccctggccctgaccctgcccccatag

SEQ ID NO: 36972 - DNA, 1311 bp, Artificial Sequence; identical to SEQ ID NO: 36971
  Description of Artificial Sequence: Synthetic coding sequence

SEQ ID NO: 36973 - DNA, 1182 bp, Artificial Sequence
  Description of Artificial Sequence: Synthetic coding sequence
atggcccaggagaatgctgccttcagccctggccaggaggagcccccaagaagaagaggccggcagcgctacgtggagaaggatggccgctgcaatgtgcagcagggcaatgtgcgggagacctaccgctacctgacagacctcttcaccaccctggtggacctgcagtggaggctgagcctgctcttctttgtgctggcctatgccctgacctggctgttctttggagccatctggtggctgattgcctacggccgcggggacctggagcacctggaggacacagcctggaccccctgtgtgaacaacctgaatggatttgtggccgccttcctgttcagcattgaaacagagaccaccatcggctacggccacagggtcatcacagaccagtgcccagagggcatcgtgctgctgctgctgcaggccatcctgggctccatggtgaatgccttcatggtgggctgcatgtttgtgaagatcagccagcccaacaagagagctgccaccctggtgttcagcagccatgctgtggtgtccctgagagatggccgcctgtgcctgatgttccgggtgggggacctgcggagcagccacatcgtggaggccagcatccgggccaagctgatccgcagccggcagaccctggagggggagttcatccccctgcaccagacagacctgtctgtgggctttgacacaggagatgacaggctcttcctggtgagccccctggtgatcagccatgaaattgatgctgccagccccttctgggaggccagccggcgggccctggagagagatgactttgagatcgtggtgatcctggagggcatggtggaggccaccggcatgacctgccaggcccggagcagctacctggtggatgaggtgctgtggggccaccgcttcacctctgtgctgaccctggaggatggcttctatgaggtggactatgccagcttccacgagacctttgaggtgcccacccccagctgcagcgcccgggagctggccgaggccgccgcccggctggatgcccacctgtactggagcatccccagccggctggatgagaaggtggaggaggagggcgctggggagggcgctggaggagaggccggggctgacaaggagcagaatggctgcctgcccccacctgagagcgagagcaaggtgtag

SEQ ID NO: 36974 - DNA, 708 bp, Artificial Sequence
  Description of Artificial Sequence: Synthetic coding sequence
atgttcatctggaccagcggccgcaccagcagcagctacagacatgatgagaagaggaacatctaccagaagatccgggaccatgacctgctggacaagaggaagacagtgacagccctgaaggccggggaggaccgggccatcctgctgggcctggccatgatggtgtgcagcatcatgatgtacttcctgctgggcatcaccctgctgcggagctacatgcagagcgtgtggacagaggagagccagtgcaccctgctgaatgccagcatcacagagaccttcaactgcagcttcagctgtggccctgactgctggaagctgagccagtacccctgcctgcaggtgtatgtgaacctgaccagcagtggagagaagctgctgctgtaccacacagaggagaccatcaagatcaaccagaagtgcagctacatccccaagtgtgggaagaactttgaggagagcatgagcctggtgaatgtggtgatggagaacttcaggaagtaccagcacttcagctgctacagcgaccctgagggcaaccagaagagcgtcatcctgaccaagctgtacagcagcaatgtgctcttccacagcctcttctggcccacctgcatgatggccggcggcgtggccatcgtggccatggtgaagctgacccagtacctgagcctgctgtgtgagcgcatccagaggatcaacagatag

SEQ ID NO: 36975 - DNA, 708 bp, Artificial Sequence; identical to SEQ ID NO: 36974
  Description of Artificial Sequence: Synthetic coding sequence

SEQ ID NO: 36976 - DNA, 708 bp, Artificial Sequence; identical to SEQ ID NO: 36974
  Description of Artificial Sequence: Synthetic coding sequence

SEQ ID NO: 36977 - DNA, 414 bp, Artificial Sequence
  Description of Artificial Sequence: Synthetic coding sequence
atgttcatctggaccagcggccgcaccagcagcagctacagacatgatgagaagaggaacatctaccagaagatccgggaccatgacctgctggacaagaggaagacagtgacagccctgaaggccggggaggaccgggccatcctgctgggcctggccatgatggtgtgcagcatcatgatgtacttcctgctgggcatcaccctgctgcggagctacatgcagagcgtgtggacagaggagagccagtgcaccctgctgaatgccagcatcacagagaccttcaactgcagcttcagctgtggccctgactgctggaagctgagccagtacccctgcctgcaggtgtatgtgaacctgaccagcagtggagagaagctgctgctgtaccacacagaggagaccatcaagtag

SEQ ID NO: 36978 - DNA, 708 bp, Artificial Sequence; identical to SEQ ID NO: 36974
  Description of Artificial Sequence: Synthetic coding sequence

SEQ ID NO: 36979 - DNA, 303 bp, Artificial Sequence
  Description of Artificial Sequence: Synthetic coding sequence
atgttcatctggaccagcggccgcaccagcagcagctacagacatgatgagaagaggaacatctaccagaagatccgggaccatgacctgctggacaagaggaagacagtgacagccctgaaggccggggaggaccgggccatcctgctgggcctggccatgatggtgtgcagcatcatgatgtacttcctgctgggcatcaccctgctgcggagctacatgcagagcgtgtggacagaggagagccagtgcaccctgctgaatgccagcatcacagagaccttcaactgcagcttctcctag

SEQ ID NO: 36980 - DNA, 651 bp, Artificial Sequence
  Description of Artificial Sequence: Synthetic coding sequence
atgttcatctggaccagcggccgcaccagcagcagctacagacatgatgagaagaggaacatctaccagaagatccgggaccatgacctgctgggcctggccatgatggtgtgcagcatcatgatgtacttcctgctgggcatcaccctgctgcggagctacatgcagagcgtgtggacagaggagagccagtgcaccctgctgaatgccagcatcacagagaccttcaactgcagcttcagctgtggccctgactgctggaagctgagccagtacccctgcctgcaggtgtatgtgaacctgaccagcagcggggagaagctgctgctgtaccacacagaggagaccatcaagatcaaccagaagtgcagctacatccccaagtgtgggaagaactttgaggagagcatgagcctggtgaatgtggtgatggagaacttcaggaagtaccagcacttcagctgctacagcgaccctgagggcaaccagaagagcgtcatcctgaccaagctgtacagcagcaatgtgctcttccacagcctcttctggcccacctgcatgatggccggcggcgtggccatcgtggccatggtgaagctgacccagtacctgagcctgctgtgtgagcgcatccagaggatcaacagatag

SEQ ID NO: 36981 - DNA, 2718 bp, Artificial Sequence
  Description of Artificial Sequence: Synthetic coding sequence
atgcctgtgcggcggggccacgtggccccccagaacacctacctggacaccatcatcaggaagtttgagggccagagcaggaagttcctgattgccaatgcccagatggagaactgtgccatcatctactgcaatgatggcttctgtgagctgtttggctacagccgggtggaggtgatgcagcagccctgcacctgtgacttcctgaccggccccaacacccccagcagcgctgtgtcccggctggcccaggccctgctgggcgctgaggagtgcaaggtggacatcctgtactacaggaaggatgccagcagcttccgctgcctggtggatgtggtgcctgtgaagaatgaagatggagctgtgatcatgttcatcctgaactttgaggacctggcccagctgctggccaagtgcagcagccgcagcctgagccagaggctgctgagccagagcttcctgggcagcgagggcagccacggccggcctgggggccctggccctggcaccggccggggcaagtaccgcaccatcagccagatcccccagttcaccctgaactttgtggagttcaacctggagaagcacaggagcagcagcaccacagaaattgagatcatcgccccccacaaggtggtggagaggacccagaatgtgacagagaaggtgacccaggtgctgagcctgggcgcagatgtgctgcctgagtacaagctgcaggccccccgcatccaccgctggaccatcctgcactacagccccttcaaggctgtgtgggactggctgatcctgctgctggtgatctacacagctgtgttcaccccctacagcgctgccttcctgctgagtgaccaggatgagagcagaagaggagcctgcagctacacctgcagccccctgactgtggtggacctgattgtggacatcatgtttgtggtggacatcgtcatcaacttccgcaccacctacgtgaacaccaatgatgaggtggtgagccaccccaggagaattgctgtgcactacttcaagggctggttcctgattgacatggtggccgccatcccctttgacctgctgatcttcagaactggaagtgatgagaccaccaccctcatcggcctgctgaagacagcccggctgctgcggctggtgcgggtggccaggaagctggaccgctacagtgaatatggagctgctgtgctcttcctgctgatgtgcacctttgccctgattgcccactggctggcctgcatctgcagcctgacctctgtgggctttggaaatgtgagccccaacaccaacagcgagaaggtgttcagcatctgtgtgatgctgattggcagcctgatgtatgccagcatctttggaaatgtgtctgccatcatccagaggctgtacagcggcacagcccgctaccacacccagatgctgcgggtgaaggagttcatccgcttccaccagatccccaaccccctgcggcagaggctggaggagtacttccagcacgcctggagctacaccaacggcatcgacatgaatgctgtgctgaagggcttcccagaatgtctgcaggccgacatctgcctgcacctgcaccgggccctgctgcagcactgcccagccttctctggagctgggaagggctgcctgcgggccctggccgtgaagttcaagaccacccacgcccctcctggggacaccctggtgcacctgggagatgtgctgagcaccctgtacttcatcagccggggcagcattgagatcctgagagatgatgtggtggtggccatcctgggcaagaatgacatctttggagagcctgtgtccctgcacgcccagcccgggaagagcagcgcagatgtgcgggccctgacctactgtgacctgcacaagatccagagagctgacctgctggaggtgctggacatgtacccagcctttgctgagagcttctggagcaagctggaggtgaccttcaacctgagagatgctgctgggggcctgcacagcagcccccggcaggcccctggcagccaggaccaccagggcttcttcctgagtgacaaccagagtgatgctgccccacccctgagcatcagtgatgccagcggcctgtggccagagctgctgcaggagatgccacccaggcacagcccccagagcccccaggaggaccctgactgctggcccctgaagctgggcagccggctggagcagctgcaggcccagatgaaccggctggagagccgggtgtccagtgacctgagccgcatcctgcagctgctgcagaagcccatgccccagggccacgccagctacatcctggaggccccagccagcaatgacctggccctggtgcccatcgccagcgagaccaccagccctggcccccggctgccccagggcttcctgcccccagcccagacccccagctatggagacctggatgactgcagccccaagcacaggaacagcagccccaggatgccccacctggccgtggccacagacaagaccctggcccccagcagcgagcaggagcagcctgagggcctgtggccacccctggccagccccctgcaccccctggaggtgcagggcctcatctgtggcccctgcttcagcagcctgcctgagcacctgggctctgtgcccaagcagctggacttccagagacatggcagtgaccccggctttgctggctcctggggccactag

SEQ ID NO: 36982 - DNA, 2985 bp, Artificial Sequence
  Description of Artificial Sequence: Synthetic coding sequence
atgcctgtgcggcggggccacgtggccccccagaacacctacctggacaccatcatcaggaagtttgagggccagagcaggaagttcctgattgccaatgcccagatggagaactgtgccatcatctactgcaatgatggcttctgtgagctgtttggctacagccgggtggaggtgatgcagcagccctgcacctgtgacttcctgaccggccccaacacccccagcagcgctgtgtcccggctggcccaggccctgctgggcgctgaggagtgcaaggtggacatcctgtactacaggaaggatgccagcagcttccgctgcctggtggatgtggtgcctgtgaagaatgaagatggagctgtgatcatgttcatcctgaactttgaggacctggcccagctgctggccaagtgcagcagccgcagcctgagccagaggctgctgagccagagcttcctgggcagcgagggcagccacggccggcctgggggccctggccctggcaccggccggggcaagtaccgcaccatcagccagatcccccagttcaccctgaactttgtggagttcaacctggagaagcacaggagcagcagcaccacagaaattgagatcatcgccccccacaaggtggtggagaggacccagaatgtgacagagaaggtgacccaggtgctgagcctgggcgcagatgtgctgcctgagtacaagctgcaggccccccgcatccaccgctggaccatcctgcactacagccccttcaaggctgtgtgggactggctgatcctgctgctggtgatctacacagctgtgttcaccccctacagcgctgccttcctgctgagtgaccaggatgagagcagaagaggagcctgcagctacacctgcagccccctgactgtggtggacctgattgtggacatcatgtttgtggtggacatcgtcatcaacttccgcaccacctacgtgaacaccaatgatgaggtggtgagccaccccaggagaattgctgtgcactacttcaagggctggttcctgattgacatggtggccgccatcccctttgacctgctgatcttcagaactggaagtgatgagaccaccaccctcatcggcctgctgaagacagcccggctgctgcggctggtgcgggtggccaggaagctggaccgctacagtgaatatggagctgctgtgctcttcctgctgatgtgcacctttgccctgattgcccactggctggcctgcatctggtacgccatcggaaatgtggagcggccctacctggagcacaagattggctggctggacagcctgggcgtgcagctgggcaagcgctacaatggaagtgaccctgccagcggccccagcgtgcaggacaagtatgtgacagccctgtacttcaccttcagcagcctgacctctgtgggctttggaaatgtgagccccaacaccaacagcgagaaggtgttcagcatctgtgtgatgctgattggcagcctgatgtatgccagcatctttggaaatgtgtctgccatcatccagaggctgtacagcggcacagcccgctaccacacccagatgctgcgggtgaaggagttcatccgcttccaccagatccccaaccccctgcggcagaggctggaggagtacttccagcacgcctggagctacaccaatggaattgacatgaatgctgtgctgaagggcttccctgagtgcctgcaggccgacatctgcctgcacctgcaccgggccctgctgcagcactgcccagccttcagcggggccggcaagggctgcctgcgggccctggccgtgaagttcaagaccacccacgcccctcctggggacaccctggtgcacctgggagatgtgctgagcaccctgtacttcatcagccggggcagcattgagatcctgagagatgatgtggtggtggccatcctgggcaagaatgacatctttggagagcctgtgtccctgcacgcccagcccgggaagagcagcgcagatgtgcgggccctgacctactgtgacctgcacaagatccagagagctgacctgctggaggtgctggacatgtacccagcctttgctgagagcttctggagcaagctggaggtgaccttcaacctgagagatgctgctgggggcctgcacagcagcccccggcaggcccctggcagccaggaccaccagggcttcttcctgagtgacaaccagagcggcagcccccatgagctgggcccccagttccccagcaagggctacagcctgctgggccctggcagccagaacagcatgggcgccggcccctgtgcccctggccacccagatgctgccccacccctgagcatcagtgatgccagcggcctgtggccagagctgctgcaggagatgccacccaggcacagcccccagagcccccaggaggaccctgactgctggcccctgaagctgggcagccggctggagcagctgcaggcccagatgaaccggctggagagccgggtgtccagtgacctgagccgcatcctgcagctgctgcagaagcccatgccccagggccacgccagctacatcctggaggccccagccagcaatgacctggccctggtgcccatcgccagcgagaccaccagccctggcccccggctgccccagggcttcctgcccccagcccagacccccagctatggagacctggatgactgcagccccaagcacaggaacagcagccccaggatgccccacctggccgtggccacagacaagaccctggcccccagcagcgagcaggagcagcctgagggcctgtggccacccctggccagccccctgcaccccctggaggtgcagggcctcatctgtggcccctgcttcagcagcctgcctgagcacctgggctctgtgcccaagcagctggacttccagagacatggcagtgaccccggctttgctggctcctggggccactag

SEQ ID NO: 36983 - DNA, 1581 bp, Artificial Sequence
  Description of Artificial Sequence: Synthetic coding sequence
atgctgatgctgctggtgcggggcacccactatgagaacctgcggagcaaggtggtgctgcccacccccctgggcggccgcagcacagagacctttgtgtctgagttccctggccctgacaccggcatccgctggaggagaagtgatgaggccctgcgggtgaatgtgggcggcgtgcggcggcagctgagcgcccgggccctggcccgcttccctggcacccggctgggccgcctgcaggccgccgccagcgaggagcaggcccggcggctgtgtgatgattatgatgaggccgcccgggagttctactttgacagacaccctggcttcttcctgagcctgctgcacttctacagaacaggccacctgcacgtgctggatgagctgtgtgtgtttgccttcggccaggaggccgactactggggcctgggagaaaatgccctggccgcctgctgccgggcccgctacctggagcggcggctgacccagccccacgcctgggatgaagattctgacacccccagctctgtggacccctgcccagatgagatcagtgatgtgcagcgggagctggcccgctacggggccgcccgctgtggccgcctgcggcggcggctgtggctgaccatggagaaccctggctacagcctgcccagcaagctgttcagctgtgtgtccatctctgtggtgctggccagcattgctgccatgtgcatccacagcctgcctgagtaccaggcccgggaggccgctgctgctgtggccgctgtggccgccggccgcagccctgagggcgtgagagatgatcctgtgctgcggcggctggagtacttctgcatcgcctggttctcctttgaggtgagcagccggctgctgctggcccccagcaccaggaacttcttctgccaccccctgaacctgattgacatcgtgtctgtgctgcccttctacctgaccctgctggccggcgtggccctgggggaccagggcggcaaggagtttggccacctgggcaaggtggtgcaggtgttccggctgatgaggatcttccgggtgctgaagctggcccggcacagcacaggcctgcggagcctgggcgccaccctgaagcacagctaccgggaggtgggcatcctgctgctgtacctggccgtgggcgtgtctgtgttttctggagtggcctacacagctgagaaggaggaggatgtgggcttcaacaccatcccagcctgctggtggtggggcaccgtgtccatgaccaccgtgggctatggagatgtggtgcctgtgacagtggccggcaagctggccgccagcggctgcatcctgggcggcatcctggtggtggccctgcccatcaccatcatcttcaacaagttcagccacttctaccgccggcagaaggccctggaggccgctgtgaggaacagcaaccaccaggagtttgaggacctgctgagcagcattgatggagtgtctgaggccagcctggagaccagccgggagaccagccaggagggccagagcgctgacctggagagccaggcccccagcgagcccccccacccccagatgtactag

SEQ ID NO: 36984 - DNA, 1581 bp, Artificial Sequence; identical to SEQ ID NO: 36983
  Description of Artificial Sequence: Synthetic coding sequence

SEQ ID NO: 36985 - DNA, 1500 bp, Artificial Sequence
  Description of Artificial Sequence: Synthetic coding sequence
atgacagtggccactggagaccctgcagatgaggccgccgccctgcccggccacccccaggacacctatgaccctgaggccgaccacgagtgctgtgagcgggtggtgatcaacatcagcggcctgcgctttgagacccagctgaagaccctggcccagtttcctgagaccctgctgggggaccccaagaagaggatgagatactttgaccccctgagaaatgagtacttctttgacaggaaccggcccagctttgatgccatcctgtactactaccagagcggcggccgcctgcggcggcctgtgaatgtgcccctggacatcttcagcgaggagatccgcttctatgagctgggggaggaggccatggagatgttccgggaggatgagggctacatcaaggaggaggagcggcccctgcctgaaaatgagttccagaggcaggtgtggctgctgtttgagtacccagagagcagcggccctgcccgcatcatcgccatcgtgtctgtgatggtgatcctgatcagcatcgtgtccttctgcctggagaccctgcccatcttcagagatgaaaatgaagacatgcacggcagcggcgtgaccttccacacctacagcaacagcaccatcggctaccagcagagcaccagcttcacagaccccttcttcatcgtggagaccctgtgcatcatctggttctcctttgagttcctggtgcgcttctttgcctgccccagcaaggccggcttcttcaccaacatcatgaacatcatcgacatcgtggccatcatcccctacttcatcaccctgggcacagagctggccgagaagccagaagatgcccagcagggccagcaggccatgagcctggccatcctgcgggtcatccggctggtgcgggtcttccgcatcttcaagctgagccgccacagcaagggcctgcagatcctgggccagaccctgaaggcctccatgagggagctgggcctgctgatcttcttcctgttcatcggggtcatcctcttcagcagcgctgtgtactttgctgaggctgatgagcgggagagccagttccccagcatcccagatgccttctggtgggccgtggtgtccatgaccaccgtgggctatggagacatggtgcccaccaccatcggcggcaagatcgtgggcagcctgtgtgccatcgccggcgtgctgaccatcgccctgcctgtgcctgtgattgtgagcaacttcaactacttctaccaccgggagacagaaggagaggagcaggcccagtacctgcaggtgaccagctgccccaagatccccagcagcccagacctgaagaagagccgcagcgccagcaccatcagcaagagtgactacatggagatccaggagggcgtgaacaacagcaatgaagacttccgggaggagaacctgaagacagccaactgcaccctggccaacaccaactacgtgaacatcaccaagatgctgacagatgtgtag

SEQ ID NO: 36986 - DNA, 1071 bp, Artificial Sequence
  Description of Artificial Sequence: Synthetic coding sequence
atgacagtggccactggagaccctgcagatgaggccgccgccctgcccggccacccccaggacacctatgaccctgaggccgaccacgagtgctgtgagcgggtggtgatcaacatcagcggcctgcgctttgagacccagctgaagaccctggcccagtttcctgagaccctgctgggggaccccaagaagaggatgagatactttgaccccctgagaaatgagtacttctttgacaggaaccggcccagctttgatgccatcctgtactactaccagagcggcggccgcctgcggcggcctgtgaatgtgcccctggacatcttcagcgaggagatccgcttctatgagctgggggaggaggccatggagatgttccgggaggatgagggctacatcaaggaggaggagcggcccctgcctgaaaatgagttccagaggcaggtgtggctgctgtttgagtacccagagagcagcggccctgcccgcatcatcgccatcgtgtctgtgatggtgatcctgatcagcatcgtgtccttctgcctggagaccctgcccatcttcagagatgaaaatgaagacatgcacggcagcggcgtgaccttccacacctacagcaacagcaccatcggctaccagcagagcaccagcttcacagaccccttcttcatcgtggagaccctgtgcatcatctggttctcctttgagttcctggtgcgcttctttgcctgccccagcaaggccggcttcttcaccaacatcatgaacatcatcgacatcgtggccatcatcccctacttcatcaccctgggcacagagctggccgagaagccagaagatgcccagcagggccagcaggccatgagcctggccatcctgcgggtcatccggctggagcggcggcccctgcagagccagaagagcaagaggggccggcagcacctgaacaccagccatgactgcaccctgggcatcaacctggtggccggcatgacagtgcagtggacccgggccagcggcccagatgaccggcagaccccagctgtgaccaccctgcacaggatgtactag

SEQ ID NO: 36987 - DNA, 1500 bp, Artificial Sequence; identical to SEQ ID NO: 36985
  Description of Artificial Sequence: Synthetic coding sequence

SEQ ID NO: 36988 - DNA, 1500 bp, Artificial Sequence; identical to SEQ ID NO: 36985
  Description of Artificial Sequence: Synthetic coding sequence

SEQ ID NO: 36989 - DNA, 1590 bp, Artificial Sequence
  Description of Artificial Sequence: Synthetic coding sequence
atgaggtctgagaagagcctgaccctggccgcccctggagaggtgcggggccctgagggggagcagcaggatgctggggacttccctgaggccggcggcggcggcggctgctgcagcagcgagcggctggtgatcaacatcagcggcctgcgctttgagacccagctgcggaccctgagcctcttcccagacaccctgctgggggaccccggccggcgggtgcgcttctttgaccccctgagaaatgagtacttctttgacaggaaccggcccagctttgatgccatcctgtactactaccagagcggcggccgcctgcggcggcctgtgaatgtgcccctggacatcttcctggaggagatccgcttctaccagctgggagatgaggccctggccgccttccgggaggatgagggctgcctgcctgagggcggggaggatgagaagcccctgcccagccagcccttccagaggcaggtgtggctgctgtttgagtacccagagagcagcggccctgcccggggcatcgccatcgtgtctgtgctggtgatcctgatcagcatcgtcatcttctgcctggagaccctgccccagttccgggtggatggccggggcggcaacaacggcggcgtgtcccgggtgtcccctgtgtcccggggcagccaggaggaggaggaggatgaagatgacagctacaccttccaccacggcatcaccccaggagagatgggcactggaggcagcagcagcctgagcaccctgggcggcagcttcttcacagaccccttcttcctggtggagaccctgtgcatcgtgtggttcacctttgagctgctggtgcgcttcagcgcctgccccagcaagccagccttcttcaggaacatcatgaacatcatcgacctggtggccatcttcccctacttcatcaccctgggcacagagctggtgcagcagcaggagcagcagcctgccagcggcggcggcggccagaatggccagcaggccatgagcctggccatcctgcgggtcatccggctggtgcgggtcttccgcatcttcaagctgagccgccacagcaagggcctgcagatcctgggcaagaccctgcaggcctccatgagggagctgggcctgctgatcttcttcctgttcatcggggtcatcctcttcagcagcgctgtgtactttgctgaggctgatgatgatgacagcctcttccccagcatcccagatgccttctggtgggccgtggtgaccatgaccaccgtgggctatggagacatgtaccccatgacagtgggcggcaagatcgtgggcagcctgtgtgccatcgccggcgtgctgaccatcgccctgcctgtgcctgtgattgtgagcaacttcaactacttctaccaccgggagacagagcaggaggagcagggccagtacacccacgtgacctgtggccagcctgccccagacctgcgggccacagacaatggcctgggcaagccagacttccctgaggccaaccgggagcggcggcccagctacctgcccaccccccaccgggcctatgcagagaagaggatgctgacagaggtgtag

SEQ ID NO: 36990 - DNA, 1590 bp, Artificial Sequence; identical to SEQ ID NO: 36989
  Description of Artificial Sequence: Synthetic coding sequence

SEQ ID NO: 36991 - DNA, 2319 bp, Artificial Sequence
  Description of Artificial Sequence: Synthetic coding sequence
atggagaagagcgccagcaaggaggagaagcagcagcccaagcaggacagcacagagcagggcaatgctgacagcgaggagtggatgagcagcgagagtgaccctgagcagatcagcctgaagagcagtgacaacagcaagagctgccagcccagagatggccagctgaagaagaaggagatgcacagcaagccccaccggcagctgtgccgcagcccctgcctggaccggcccagcttcagccagaaccacctgctgatgatgtactggcagagcctgagtgacctgggcaccaaggtgatccagaagggcagcagccgggagatcgccagccctgagctgagcctggaggatgaaattgacaacagcgacaacctgcggcctgtggtgattgatggcagcaatgtggccatgagccacggcaacaaggaggagttcagctgccggggcatccagctggccgtggactggttcctggacaagggccacaaggacatcaccgtgtttgtgcctgcctggaggaaggagcagagcaggccagatgcccccatcacagaccaggacatcctgaggaagctggagaaggagaagatcctggtgttcacccccagcagaagagtgcagggccggcgggtggtgtgctatgatgaccgcttcatcgtgaagctggcctttgacagtgatggcatcatcgtgtccaatgacaactacagagacctgcaggtggagaagccagagtggaagaagttcatcgaggagcggctgctgatgtacagctttgtgaatgacaagttcatgcccccagatgaccccctgggcagacatggccccagcctggagaacttcctgaggaagaggcccatcgtgcctgagcacaagaagcagccctgcccctacggcaagaagtgcacctacggccacaagtgcaagtactaccaccctgagcgggccaaccagccccagaggtctgtggctgatgagctgcgcatcagcgccaagctgagcacagtgaagaccatgtctgagggcaccctggccaagtgtggcaccggcatgagcagcgccaagggggagatcaccagcgaggtgaagagggtggcccccaagaggcagagcgaccccagcatccgctctgtggccatggagcctgaggagtggctgagcatcgccaggaagccagaggccagctctgtgcccagcctggtgacagccctgtctgtgcccaccatccccccacccaagagccatgctgtgggcgccctgaacaccaggtctgccagcagccctgtgcccggcagcagccacttcccccaccagaaggccagcctggagcacatggcctccatgcagtacccacccatcctggtgaccaacagccacggcacccccatctcctatgcagagcagtaccccaagtttgagagcatgggagaccacggctactacagcatgctgggggacttcagcaagctgaacatcaacagcatgcacaaccgggagtactacatggccgaggtggacagaggagtgtatgccaggaaccccaacctgtgcagcgacagccgggtgagccacaccagaaatgacaactacagcagctacaacaacgtgtacctggccgtggccgacacccaccctgagggcaacctgaagctgcacaggtctgccagccagaaccggctgcagcccttcccccacggctaccacgaggccctgaccagggtgcagagctatggccctgaggacagcaagcagggcccccacaagcagagcgtgccccacctggccctgcacgcccagcaccccagcacaggcaccaggagcagctgcccagctgactaccccatgccacccaacatccaccctggggccaccccccagcccggccgggccctggtgatgaccaggatggacagcatcagtgacagccggctgtatgagagcaaccctgtgcggcagaggcggccccccctgtgccgggagcagcacgcctcctgggaccccctgccctgcaccacagacagctatggctaccacagctaccccctgagcaacagcctgatgcagccctgctatgagcctgtgatggtgcgctctgtgcctgagaagatggagcagctgtggaggaacccctgggtgggcatgtgcaatgacagccgggagcacatgatccctgagcaccagtaccagacctacaagaacctgtgcaacatcttccccagcaacatcgtgctggccgtgatggagaagaacccccacacagcagatgcccagcagctggccgccctgattgtggccaagctgcgggccgccaggtag

SEQ ID NO: 36992 - DNA, 813 bp, Artificial Sequence
  Description of Artificial Sequence: Synthetic coding sequence
atggtgcccagcaccatcgccggcaagatcttcggcagcatctgcagcctgagcggcgtgctggtgattgccctgcctgtgcctgtgattgtgagcaacttcagccgcatctaccaccagaaccagagagctgacaagagaagagcccagcagaaggtgcggctggcccgcatccggctggccaagagcggcaccaccaatgccttcctgcagtacaagcagaatggaggcctggaggacagcggcagcggggaggagcaggccctgtgtgtgaggaacagaagtgcctttgagcagcagcaccaccacctgctgcactgcctggagaagaccacctgccacgagttcacagatgagctgaccttcagcgaggccctgggcgctgtgtccccaggcggccgcaccagccgcagcacctctgtgagcagccagcctgtgggccctggcagcctgctgagcagctgctgcccccggcgggccaagaggcgggccatccggctggccaacagcacagcctctgtgtcccggggctccatgcaggagctggacatgctggccggcctgcggcgcagccacgccccccagagccgcagcagcctgaatgccaagccccatgacagcctggacctgaactgtgacagccgggactttgtggccgccatcatcagcatccccaccccaccagccaacaccccagatgagagccagcccagcagccctgggggcggcggccgggccggcagcaccctgaggaacagcagcctgggcaccccctgcctcttccctgagaccgtgaagatcagcagcctgtag

SEQ ID NO: 36993 - DNA, 402 bp, Artificial Sequence
  Description of Artificial Sequence: Synthetic coding sequence
tgaggaagaggcctggacagagtgggcgtgagccacaatggagaggagggcgccgccctgattgccctgctgcacctgctgcaggacagcggcagcggggaggagcaggccctgtgtgtgaggaacagaagtgcctttgagcagcagcaccaccacctgctgcactgcctggagaagaccacctgccacgagttcacagatgagctgaccttcagcgaggccctgggcgctgtgtcccctgggggccgcaccagccgcagcacctctgtgagcagccagcctgtgggccctggcagcctgctgagcagctgctgcccccggcgggccaagagaagagccatccggctggccaacagcacagcctctgtgtcccggggctccatgcaggagctggacatgtag

SEQ ID NO: 36994 - DNA, 1401 bp, Artificial Sequence
  Description of Artificial Sequence: Synthetic coding sequence
atggagccctggccctgcagccctgggggcggcggcggcacccgggcccggcacgtgatcatcaacgtgggcggctgccgggtgcggctggcctgggccgccctggcccgctgccccctggcccggctggagcggctgcgggcctgccggggccatgatgacctgctgcgggtgtgtgatgattatgatgtgtccagagatgagttcttctttgacaggagcccctgtgccttccgggccatcgtggccctgctgcgggccggcaagctgcggctgctgcggggcccctgtgccctggccttcagagatgagctggcctactggggcattgatgaggcccggctggagcgctgctgcctgcggcggctgcggcggcgggaggaggaggccgctgaggcccgggccggccccacagagcggggggcccagggcagccctgcccgggccctgggcccccggggccgcctgcagagaggaagaagaaggctgagagatgtggtggacaacccccacagcggcctggccggcaagctgtttgcctgtgtgtctgtgtcctttgtggccgtgacagctgtgggcctgtgcctgagcaccatgccagacatccgggcagaggaggagcggggggagtgcagccccaagtgccgcagcctgtttgtgctggagaccgtgtgtgtggcctggttctcctttgagttcctgctgcggagcctgcaggccgagagcaaatgtgccttcctgcgggcccccctgaacatcatcgacatcctggccctgctgcccttctacgtgtccctgctgctgggcctggccgccggccctgggggcaccaagctgctggagagagctggcctggtgctgcggctgctgcgggccctgcgggtgctgtatgtgatgaggctggcccggcacagcctgggcctgcggagcctgggcctgaccatgaggcgctgtgcccgggagtttggcctgctgctgctcttcctgtgtgtggccatggccctgtttgcccccctggtgcacctggccgagcgggagctgggcgcccggcgggacttcagctctgtgcctgccagctactggtgggccgtcatctccatgaccaccgtgggctacggggacatggtgcccaggagcctgcccggccaggtggtggccctgagcagcatcctgagcggcatcctgctgatggccttccctgtgaccagcatcttccacaccttcagccgcagctacagcgagctgaaggagcagcagcagagagctgccagccctgagcccgccctgcaggaggacagcacccacagcgccacagccacagaggacagcagccagggcccagattctgctggcctggctgatgacagcgcagatgccctgtgggtgcgggccggccgctag

SEQ ID NO: 36995 - DNA, 3054 bp, Artificial Sequence
  Description of Artificial Sequence: Synthetic coding sequence
atgcctgtgatgaagggcctgctggccccccagaacaccttcctggacaccatcgccaccaggtttgatggcacccacagcaacttcctgctggccaatgcccagggcacccggggcttccccatcgtgtactgcagtgatggcttctgtgagctgaccggctacggccgcacagaggtgatgcagaagacctgcagctgccgcttcctgtatggccctgagaccagcgagcccgccctgcagaggctgcacaaggccctggagggccaccaggagcacagagctgagatctgcttctacaggaaggatggcagcgccttctggtgcctgctggacatgatgcccatcaagaatgagatgggagaggtggtgctcttcctgttctccttcaaggacatcacccagagcggcagccctggcctgggcccccagggcggccgcggggacagcaaccacgagaacagcctgggccggcggggggccacctggaagttccgcagcgcccggcggcgcagcaggacagtgctgcaccggctgaccggccactttggaagaagaggccagggcggcatgaaggccaacaacaacgtgtttgagcccaagcccagcgtgcctgagtacaaggtggcctctgtgggcggcagccgctgcctgctgctgcactacagcgtgtccaaggccatctgggatggcctcatcctgctggccaccttctacgtggccgtgacagtgccctacaacgtgtgcttctctggagatgatgacacccccatcaccagccgccacaccctggtgtctgacattgctgtggagatgctgttcatcctggacatcatcctgaacttccgcaccacctacgtgtcccagagcggccaggtgatcagcgcccccaggagcatcggcctgcactacctggccacctggttcttcatcgacctgattgctgccctgccctttgacctgctgtacatcttcaacatcaccgtgaccagcctggtgcacctgctgaagacagtgcggctgctgcggctgctgcggctgctgcagaagctggagcgctacagccagtgcagcgctgtggtgctgaccctgctgatgtctgtgtttgccctgctggcccactggatggcctgcatctggtacgtgattggaagaagagagatggaggccaatgaccccctgctgtgggacatcggctggctgcacgagctgggcaagaggctggaggtgccctacgtgaatggatctgtgggcggccccagccgccgcagcgcctacatcgccgccctgtacttcaccctgagcagcctgacctctgtgggctttggaaatgtgtgtgccaacacagatgctgagaagatcttcagcatctgcaccatgctgattggagccctgatgcatgctgtggtgtttggaaatgtgacagccatcatccagaggatgtacagccgccgcagcctgtaccacagcaggatgaaggacctgaaggacttcatccgggtgcaccggctgccccggcccctgaagcagaggatgctggagtacttccagaccacctgggccgtgaacagcggcattgatgccaatgagctgctgcgggacttcccagatgagctgcgggctgacatcgccatgcacctgaaccgggagatcctgcagctgcccctgtttggagctgccagccggggctgcctgcgggccctgagcctgcacatcaagaccagcttctgtgcccctggagagtacctgctgcggagaggagatgccctgcaggcccactactacgtgtgcagcggcagcctggaggtgctgcgggacaacatggtgctggccatcctgggcaaaggagacctgattggagctgacatccctgagcccggccaggagcccggcctgggcgctgaccccaactttgtgctgaagaccagcgcagatgtgaaggccctgacctactgcggcctgcagcagctgagcagccggggcctggccgaggtgctgcggctgtacccagaatatggagctgccttccgggccggcctgccccgggacctgaccttcaacctgcggcagggcagtgacaccagcggcctgagccgcttcagccgcagcccccggctgagccagcccaggtctgagagcctgggcagcagcagtgacaagaccctgcccagcatcacagaggccgagagcggggctgagcccggcggcggcccccggccccggcggcccctgctgctgcccaacctgagccctgcccggccccggggcagcctggtgtccctgctgggggaggagctgccccccttcagcgccctggtgagcagccccagcctgagccccagcctgagccctgccctggccggccagggccacagcgccagcccccacggccccccacgctgcagcgctgcctggaagccaccccagctgctgatcccccccctgggcaccttcggccccccagacctgagccccagaattgtggatggcatcgaggacagcggcagcacagctgaggcccccagcttccgcttcagcagaagacctgagctgccccggcccaggagccaggcccccccaacaggcacccggcccagccctgagctggccagcgaggccgaggaggtgaaggagaaggtgtgccgcctgaaccaggagatcagccggctgaaccaggaggtgtcccagctgagccgggagctgcggcacatcatgggcctgctgcaggcccggctgggccccccaggccaccctgctggcagcgcctggaccccagaccccccctgcccccagctgcggcccccctgcctgagcccctgtgccagccggcccccacccagcctgcaggacaccaccctggccgaggtgcactgcccagcctctgtgggcaccatggagactggaacagccctgctggacctgcggcccagcatcctgcccccctaccccagcgagccagaccccctgggccccagccctgtgcctgaggccagcccccccacccccagcctgctgcggcacagcttccagagcagaagtgacaccttccactag

SEQ ID NO: 36996 - DNA, 2985 bp, Artificial Sequence; identical to SEQ ID NO: 36982
  Description of Artificial Sequence: Synthetic coding sequence

SEQ ID NO: 36997 - DNA, 2718 bp, Artificial Sequence; identical to SEQ ID NO: 36981
  Description of Artificial Sequence: Synthetic coding sequence

SEQ ID NO: 36998 - DNA, 3324 bp, Artificial Sequence
  Description of Artificial Sequence: Synthetic coding sequence
atgcctgtgatgaagggcctgctggccccccagaacaccttcctggacaccatcgccaccaggtttgatggcacccacagcaacttcatcctggccaatgcccaggtggccaagggcttccccatcgtgtactgcagtgatggcttctgtgagctggccggctttgccaggacagaggtgatgcagaagagctgcagctgcaagttcctgtttggagtggagaccaatgagcagctgatgctgcagatcgagaagagcctggaggagaagacagagttcaagggggagatcatgttctacaagaagaatggcagccccttctggtgcctgctggacatcgtgcccatcaagaatgagaagggagatgtggtgctcttcctggccagcttcaaggacatcacagacaccaaggtgaagatcaccccagaggacaagaaggaggacaaggtgaagggccgcagccgggccggcacccactttgacagcgccaggagaagaagcagagctgtgctgtaccacatcagcggccacctgcagaggcgggagaagaacaagctgaagatcaacaacaacgtgtttgtggacaagccagccttccctgagtacaaggtgtctgatgccaagaagagcaagttcatcctgctgcacttcagcaccttcaaggccggctgggactggctgatcctgctggccaccttctacgtggccgtgacagtgccctacaacgtgtgcttcatcggaaatgatgacctgagcaccaccaggagcaccaccgtgtctgacattgctgtggagatcctcttcatcatcgacatcatcctgaacttccgcaccacctacgtgtccaagagcggccaggtgatctttgaggcccggagcatctgcatccactacgtgaccacctggttcatcatcgacctgattgctgccctgccctttgacctgctgtatgccttcaacgtgacagtggtgtccctggtgcacctgctgaagacagtgcggctgctgcggctgctgcggctgctgcagaagctggaccgctacagccagcacagcaccatcgtgctgaccctgctgatgtccatgtttgccctgctggcccactggatggcctgcatctggtacgtgattggcaagatggagcgggaggacaacagcctgctgaagtgggaggtgggctggctgcacgagctgggcaagaggctggagagcccctactacggcaacaacaccctgggcggccccagcatccgcagcgcctacatcgccgccctgtacttcaccctgagcagcctgacctctgtgggctttggaaatgtgtctgccaacacagatgctgagaagatcttcagcatctgcaccatgctgattggagccctgatgcacgccctggtgtttggaaatgtgacagccatcatccagaggatgtacagccgctggagcctgtaccacaccaggaccaaggacctgaaggacttcatccgggtgcaccacctgccccagcagctgaagcagaggatgctggagtacttccagaccacctggagcgtgaacaatggaattgacagcaatgagctgctgaaggacttcccagatgagctgcggagtgacatcaccatgcacctgaacaaggagatcctgcagctgagcctgtttgaatgtgccagccggggctgcctgcggagcctgagcctgcacatcaagaccagcttctgtgcccctggagagtacctgctgcggcagggagatgccctgcaggccatctactttgtgtgcagcggctccatggaggtgctgaaggacagcatggtgctggccatcctgggcaagggggacctgattggagccaacctgagcatcaaggaccaggtgatcaagaccaatgctgatgtgaaggccctgacctactgtgacctgcagtgcatcatcctgaagggcctgtttgaggtgctggacctgtacccagaatatgcccacaagtttgtggaggacatccagcacgacctgacctacaacctgcgggagggccatgaaagtgatgtgatcagccggctgagcaacaagtccatggtgtcccagagcgagcccaagggaaatggaaacatcaacaagaggctgcccagcatcgtggaggatgaggaggaggaggaggagggggaggaggaggaggccgtgtccctgagccccatctgcacccggggcagcagcagcaggaacaagaaggtgggcagcaacaaggcctacctgggcctgagcctgaagcagctggccagcggcaccgtgcccttccacagccccatccgggtgagccgcagcaacagccccaagaccaagcaggagattgatcctcccaaccacaacaagaggaaggagaagaacctgaagctgcagctgagcaccctgaacaatgccggccccccagacctgagccccagaattgtggatggcattgaagatggcaacagcagcgaggagagccagacctttgattttggaagtgagcgcatccgctctgagccccgcatcagcccccccctgggggaccctgagattggagctgctgtgctcttcatcaaggccgaggagaccaagcagcagatcaacaagctgaacagcgaggtgaccaccctgacccaggaggtgtcccagctgggcaaggacatgagaaatgtcatccagctgctggagaatgtgctgagcccccagcagcccagccgcttctgcagcctgcacagcacctctgtgtgccccagccgggagagcctgcagaccaggacctcctggagcgcccaccagccctgcctgcacctgcagacaggaggagctgcctacacccaggcccagctgtgcagcagcaacatcaccagtgacatctggagcgtggaccccagctctgtgggcagcagcccccagaggactggagcccacgagcagaacccagctgacagcgagctgtaccacagccccagcctggactacagccccagccactaccaggtggtgcaggagggccacctgcagttcctgcgctgcatcagcccccacagcgacagcaccctgacccccctgcagagcatcagcgccaccctgagcagctctgtgtgcagcagcagcgagaccagcctgcacctggtgctgcccagccgctctgaggagggcagcttcagccagggcaccgtgagcagcttcagcctggagaacctgcccggctcctggaaccaggagggcatggccagcgccagcaccaagcccctggagaacctgcccctggaggtggtgaccagcacagctgaggtgaaggacaacaaggccatcaacgtgtag

SEQ ID NO: 36999 - DNA, 558 bp, Artificial Sequence
  Description of Artificial Sequence: Synthetic coding sequence
atgtccatgtttgccctgctggcccactggatggcctgcatctggtacgtgattggcaagatggagcgggaggacaacagcctgctgaagtgggaggtgggctggctgcacgagctgggcaagaggctggagagcccctactacggcaacaacaccctgggcggccccagcatccgcagcgcctacatcgccgccctgtacttcaccctgagcagcctgacctctgtgggctttggaaatgtgtctgccaacacagatgctgagaagatcttcagcatctgcaccatgctgattggagtgtcccagttccaggtgtgcccccggcccagctggatcatctgctggttcaggaaccacttcggcttcatcctgctgatgaccaccctgatgcacgccctggtgtttggaaatgtgacagccatcatccagaggatgtacagccgctggagcctgtaccacaccaggaccaaggacctgaaggacttcatccgggtgcaccacctgccccagcagctgaagcagaggatgctggagtacttccagaccacctgcttctag

SEQ ID NO: 37000 - DNA, 399 bp, Artificial Sequence
  Description of Artificial Sequence: Synthetic coding sequence
atggaggccgagggcctggactggctgctggtgcccctgcaccagctggtgtcctggggcgctgctgctgccatggtgtttggaggagtggtgccctacgtgccccagtacagagacatccggaggacccagaatgctgatggcttcagcacctacgtgtgcctggtgctgctggtggccaacatcctgcgcatcctcttctggtttggaagaagatttgagagccccctgctgtggcagagcgccatcatgatcctgaccatgctgctgatgctgaagctgtgcacagaggtgcgggtggccaatgagctgaatgcccggcggcgctccttcaccgccagccgctggtgcagctgtggccctgtggtgacccccagcagaagacccaccagctgctag

SEQ ID NO: 37001 - DNA, 762 bp, Artificial Sequence
  Description of Artificial Sequence: Synthetic coding sequence
atggaggccgagggcctggactggctgctggtgcccctgcaccagctggtgtcctggggcgctgctgctgccatggtgtttggaggagtggtgccctacgtgccccagtacagagacatccggaggacccagaatgctgatggcttcagcacctacgtgtgcctggtgctgctggtggccaacatcctgcgcatcctcttctggtttggaagaagatttgagagccccctgctgtggcagagcgccatcatgatcctgaccatgctgctgatgctgaagctgtgcacagaggtgcgggtggccaatgagctgaatgcccggcggcgctccttcacagactttgacccccaccacttctggcagtggagcagcttcagtgactatgtgcagtgtgtgctggccttcaccggggtggccggctacatcacctacctgagcattgattctgccctgtttgtggagaccctgggcttcctggccgtgctgacagaggccatgctgggcgtgccccagctgtacagaaaccaccgccaccagagcacagagggcatgagcatcaagatggtgctgatgtggaccagcggagatgccttcaagacagcctacttcctgctgaagggggcccccctgcagttctctgtgtgtggcctgctgcaggtgctggtggacctggccatcctgggccaggcctatgcctttgcccggcacccccagaagccagcccctcatgctgtgcaccccaccggcaccaaggccctgtag

SEQ ID NO: 37002 - DNA, 816 bp, Artificial Sequence
  Description of Artificial Sequence: Synthetic coding sequence
atggaggccgagggcctggactggctgctggtgcccctgcaccagctggtgtcctggggcgctgctgctgccatggtgtttggaggagtggtgccctacgtgccccagtacagagacatccggaggacccagaatgctgatggcttcagcacctacgtgtgcctggtgctgctggtggccaacatcctgcgcatcctcttctggtttggaagaagatttgagagccccctgctgtggcagagcgccatcatgatcctgaccatgctgctgatgctgaagctgtgcacagaggtgcgggtggccaatgagctgaatgcccggcggcgctccttcaccgctgctgacagcaaggatgaggaggtgaaggtggccccccggcgctccttcctggactttgacccccaccacttctggcagtggagcagcttcagtgactatgtgcagtgtgtgctggccttcaccggggtggccggctacatcacctacctgagcattgattctgccctgtttgtggagaccctgggcttcctggccgtgctgacagaggccatgctgggcgtgccccagctgtacagaaaccaccgccaccagagcacagagggcatgagcatcaagatggtgctgatgtggaccagcggagatgccttcaagacagcctacttcctgctgaagggggcccccctgcagttctctgtgtgtggcctgctgcaggtgctggtggacctggccatcctgggccaggcctatgcctttgcccggcacccccagaagccagcccctcatgctgtgcaccccaccggcaccaaggccctgtag

SEQ ID NO: 37003 - DNA, 399 bp, Artificial Sequence; identical to SEQ ID NO: 37000
  Description of Artificial Sequence: Synthetic coding sequence

SEQ ID NO: 37004 - DNA, 876 bp, Artificial Sequence
  Description of Artificial Sequence: Synthetic coding sequence
atggtgtggaagaagctgggcagcaggaacttcagcagctgccccagcggcagcatccagtggatctgggatgtgctgggggagtgtgcccaggacggctgggatgaggcctctgtgggcctgggcctcatcagcatcctgtgctttgctgccagcaccttcccccagttcatcaaggcctacaagacaggcaacatggaccaggccctgagcctgtggttcctgctgggctggattggaggagacagctgcaacctgattggcagcttcctggccgaccagctgcccctgcagacctacacagctgtgtactacgtgctggccgacctggtgatgctgaccctgtacttctactacaagttccgcacccggcccagcctgctgagcgcccccatcaacagcgtgctgctcttcctgatgggcatggcctgtgccacccccctgctgtctgctgctggccctgtggccgccccccgggaggccttccggggccgggccctgctgtctgtggagagcggcagcaagcccttcacccggcaggaggtgattggatttgtgattggcagcatcagctctgtgctgtacctgctgagccggctgccccagatccgcaccaacttcctgaggaagagcacccagggcatctcctacagcctgtttgccctggtgatgctgggcaacaccctgtatggcctgtctgtgctgctgaagaaccctgaggagggccagagcgagggcagctacctgctgcaccacctgccctggctggtgggcagcctgggcgtgctgctgctggacaccatcatcagcatccagttcctggtgtacagaagaagcacagctgccagcgagctggagcccctgctgcccagctag

SEQ ID NO: 37005 - DNA, 876 bp, Artificial Sequence; identical to SEQ ID NO: 37004
  Description of Artificial Sequence: Synthetic coding sequence

SEQ ID NO: 37006 - DNA, 681 bp, Artificial Sequence
  Description of Artificial Sequence: Synthetic coding sequence
atggaccaggccctgagcctgtggttcctgctgggctggattggaggagacagctgcaacctgattggcagcttcctggccgaccagctgcccctgcagacctacacagctgtgtactacgtgctggccgacctggtgatgctgaccctgtacttctactacaagttccgcacccggcccagcctgctgagcgcccccatcaacagcgtgctgctcttcctgatgggcatggcctgtgccacccccctgctgtctgctgctggccctgtggccgccccccgggaggccttccggggccgggccctgctgtctgtggagagcggcagcaagcccttcacccggcaggaggtgattggcttcgtcatcggcagcatcagctctgtgctgtacctgctgagccggctgccccagatccgcaccaacttcctgaggaagagcacccagggcatctcctacagcctgtttgccctggtgatgctgggcaacaccctgtatggcctgtctgtgctgctgaagaaccctgaggagggccagagcgagggcagctacctgctgcaccacctgccctggctggtgggcagcctgggcgtgctgctgctggacaccatcatcagcatccagttcctggtgtaccgccgcagcacagctgccagcgagctggagcccctgctgcccagctag

SEQ ID NO: 37007 - DNA, 609 bp, Artificial Sequence
  Description of Artificial Sequence: Synthetic coding sequence
atggaggccgccctgctgggcctgtgcaactggagcaccctgggcgtgtgtgccgccctgaagctgccccagatctctgctgtgctggccgcccggagcgcccggggcctgagcctgcccagcctgctgctggagctggccggcttcctggtgttcctgcgctaccagtgctactacggctacccacccctgacctacctggagtaccccatcctgattgcccaggacgtcatcctgctgctgtgcatcttccacttcaatggaaatgtgaagcaggccaccccctacatcgctgtgctggtgtcctcctggttcatcctggccctgcagaagtggatcatcgacctggccatgaacctgtgcaccttcatctctgctgccagcaagtttgcccagctgcagtgcctgtggaagacccgggacagcggcaccgtgtctgccctgacctggagcctgagcagctacacctgtgccacccgcatcatcaccaccctgatgaccaccaatgacttcaccatcctgctgcgctttgtgatcatgctggccctgaacatctgggtgacagtgacagtgctgcgctacaggaagacagccatcaaggccgagtag

SEQ ID NO: 37008 - DNA, 567 bp, Artificial Sequence
  Description of Artificial Sequence: Synthetic coding sequence
atggaggccgccctgctgggcctgtgcaactggagcaccctgggcgtgtgtgccgccctgaagctgccccagatctctgctgtgctggccgcccggagcgcccggggcctgagcctgcccagcctgctgctggagctggccggcttcctggtgttcctgcgctaccagtgctactacggctacccacccctgacctacctggagtaccccatcctgattgcccaggacgtcatcctgctgctgtgcatcttccacttcaatggaaatgtgaagcaggccaccccctacatcgctgtgctggtgtcctcctggttcatcctggccctgcagaagtggatcatcgacctggccatgaacctgtgcaccttcatctctgctgccagcaagtttgcccagctgcagtgcctgtggaagacccgggacagcggcaccgtgtctgccctgacctggagcctgagcagctacacctgtgccatcctgctgcgctttgtgatcatgctggccctgaacatctgggtgacagtgacagtgctgcgctacaggaagacagccatcaaggccgagtag

SEQ ID NO: 37009 - DNA, 2127 bp, Artificial Sequence
  Description of Artificial Sequence: Synthetic coding sequence
atgagccagtacacagagaaggagcctgctgccatggaccaggagagcggcaaggctgtgtggcccaagccagctgggggctaccagaccatcaccggccgccgctatggaagaagacatgcctacgtgtccttcaagccctgcatgaccaggcatgagaggagcctgggccgggctggagatgattatgaggtgctggagctggatgatgtgcccaaggagaacagcagcggcagcagccccctggaccaggtggacagcagcctgcccagcgagcccatctttgagaagtcagaaacagagatccccacctgtggcagcgccctgaaccagaccacagagagcagccagagctttgtggccgtgcaccacagcgaggagggccgggacaccctgggcagcagcaccaacctgcacaaccacagcgagggggagtacatccctggggcctgcagcgccagctctgtgcagaatggcatcgccctggtgcacacagacagctatgaccctgatggcaagcacggggaggacaatgaccacctgcagctgtctgctgaggtggtggagggcagccgctaccaggagagcctgggcaacacagtgtttgagctggagaaccgggaggccgaggcctacacaggcctgagcccccctgtgcccagcttcaactgtgaggtgagagatgaatttgaggagctggacagcgtgcccctggtgaagagcagcgctggggacacagaatttgtgcaccagaacagccaggagatccagaggagcagccaggatgagatggtgtccaccaagcagcagaacaacaccagccaggagcggcagacagagcacagcccagaagatgctgcctgtggccctggccacatctgcagcgagcagaacaccaatgaccgggagaagaaccacggcagcagccctgagcaggtggtgcggcccaaggtgaggaagctgatcagcagcagccaggtggaccaggagaccggcttcaacagacatgaggccaagcagaggtctgtgcagcgctggagggaggccctggaggtggaggagagcggcagtgatgacctgctgatcaagtgtgaggagtatgatggagaacatgactgcatgttcctggaccccccctacagcagggtcatcacccagcgggagacagagaacaaccagatgaccagcgagagcggggccacagctggccggcaggaggtggacaacaccttctggaatggctgtggggactactaccagctgtatgacaaggatgaggacagcagcgagtgcagtgatggagagtggagcgccagcctgccccaccgcttctctggaacagagaaggaccagagcagcagtgatgagagctgggagaccctgcccgggaaggatgaaaatgaacctgagctgcagagcgacagcagcggccctgaggaggagaaccaggagctgagcctgcaggagggggagcagaccagcctggaggagggggagatcccctggctgcagtacaatgaggtgaatgaaagcagcagtgatgagggcaatgaaccagccaatgaatttgcccagcctgccttcatgctggatggcaacaacaacctggaggatgacagctctgtgtctgaggacctggatgtggactggagcctgtttgatggctttgctgatggcctgggcgtggccgaggccatctcctatgtggacccccagttcctgacctacatggccctggaggagcggctggcccaggccatggagacagccctggcccacctggagagcctggccgtggatgtggaggtggccaaccccccagccagcaaggagagcattgatggcctgcctgagaccctggtgctggaggaccacacagccatcggccaggagcagtgctgccccatctgctgcagcgagtacatcaaggatgacatcgccacagagctgccctgccaccacttcttccacaagccctgtgtgtccatctggctgcagaagagcggcacctgccctgtgtgcagaagacacttccccccagctgtgattgaggccagcgctgcccccagcagcgagccagaccctgatgccccacccagcaatgacagcattgctgaggccccctag

SEQ ID NO: 37010 - DNA, 2127 bp, Artificial Sequence; identical to SEQ ID NO: 37009
  Description of Artificial Sequence: Synthetic coding sequence

SEQ ID NO: 37011 - DNA, 570 bp, Artificial Sequence
  Description of Artificial Sequence: Synthetic coding sequence
atgggcgtgtctgtggatgtgcaccaggtgtacaagtacccctttgagcaggtggtggccagcttcctgaggaagtaccccaaccccatggacaagaatgtcatctctgtgaagatcatggaggagaagagagatgagagcactggagtcatctacaggaagagaattgccatctgccagaatgtggtgcctgagatcctgaggaagagcctgagcaccctggtgatcctgtgctggaagaaggtgtccatcctgaaggtgcccaacatccagctggaggaggagagctggctgaacccccgggagaggaacatggccatccgcagccactgcctgacctggacccagtatgcctccatgaaggaggagagcgtcttccgggagagcatggagaaccccaactggacagagttcatccagaggggccgcatcagcatcactggagtgggcttcctgaactgtgtgctggagacctttgccagcaccttcctgcggcagggcgcccagaagggcatccgcatcatggagatgctgctgaaggagcagtgtggggcccccctggccgagtag

SEQ ID NO: 37012 - DNA, 534 bp, Artificial Sequence
  Description of Artificial Sequence: Synthetic coding sequence
atgggcgtgtctgtggatgtgcaccaggtgtacaagtacccctttgagcaggtggtggccagcttcctgaggaagtaccccaaccccatggacaagaatgtcatctctgtgaagatcatggaggagaagagagatgagagcactggagtcatctacaggaagagaattgccatctgccagaatgtggtgcctgagatcctgaggaaggtgtccatcctgaaggtgcccaacatccagctggaggaggagagctggctgaacccccgggagaggaacatggccatccgcagccactgcctgacctggacccagtatgcctccatgaaggaggagagcgtcttccgggagagcatggagaaccccaactggacagagttcatccagaggggccgcatcagcatcactggagtgggcttcctgaactgtgtgctggagacctttgccagcaccttcctgcggcagggcgcccagaagggcatccgcatcatggagatgctgctgaaggagcagtgtggggcccccctggccgagtag

SEQ ID NO: 37013 - DNA, 447 bp, Artificial Sequence
  Description of Artificial Sequence: Synthetic coding sequence
atggacaagaatgtcatctctgtgaagatcatggaggagaagagagatgagagcactggagtcatctacaggaagagaattgccatctgccagaatgtggtgcctgagatcctgaggaaggtgtccatcctgaaggtgcccaacatccagctggaggaggagagctggctgaacccccgggagaggaacatggccatccgcagccactgcctgacctggacccagtatgcctccatgaaggaggagagcgtcttccgggagagcatggagaaccccaactggacagagttcatccagaggggccgcatcagcatcaccggggtgggcttcctgaactgtgtgctggagacctttgccagcaccttcctgcggcagggcgcccagaagggcatccgcatcatggagatgctgctgaaggagcagtgtggggcccccctggccgagtag

SEQ ID NO: 37014 - DNA, 267 bp, Artificial Sequence
  Description of Artificial Sequence: Synthetic coding sequence
atgcaccagaagctgctgaagagcgcccactacatcgagctgggcagctaccagtactggcctgtgctggtgccccggggcatccggctgtacacctatgagcagatccctggcagcctgaaggacaacccctacatcacagatggctaccgggcctacctgcccagccggctgtgcatcaagaggtctgtgtgctttgccctgtgggccatcatcttcttccctgccatcggccagaagaagcacgtggaggatggctggcactag

SEQ ID NO: 37015 - DNA, 876 bp, Artificial Sequence
  Description of Artificial Sequence: Synthetic coding sequence
atgcaccagaagctgctgaagagcgcccactacatcgagctgggcagctaccagtactggcctgtgctggtgccccggggcatccggctgtacacctatgagcagatccctggcagcctgaaggacaacccctacatcacagatggctaccgggcctacctgcccagccggctgtgcatcaagagcctcttcatcctgagcaatgagaccgtgaacatctggagccacctgctgggcttcttcctgttcttcaccctgggcatctatgacatgacctctgtgctgcccagcgccagcgccagcagagaagattttgtgatctgcagcatctgcctcttctgcttccaggtgtgcatgctgtgcagcgtgggctaccacctgttcagctgccacaggtctgagaagacctgccgccgctggatggccctggactatgccggcatcagcatcggcatcctgggctgctacgtgtctggagtcttctacgccttctactgcaacaactactggaggcaggtgtacctgatcaccgtgctggccatgatcctggccgtgttctttgcccagatccaccccaactacctgacccagcagtggcagaggctgcggagcatcatcttctgcagcgtgtctggctatggagtcatccccaccctgcactgggtgtggctgaatggaggcatcggggcccccatcgtgcaggactttgccccccgggtgattgtgatgtacatgattgccctgctggccttcctgttctacatcagcaaggtgcctgagcgctacttccctgagaacatcttccgctggaagatcaccaagaggaccctgggcggcgtgaacaacagcctgcagaacctgtacctgctggtgtag

SEQ ID NO: 37016 - DNA, 936 bp, Artificial Sequence
  Description of Artificial Sequence: Synthetic coding sequence
atgcaccagaagctgctgaagagcgcccactacatcgagctgggcagctaccagtactggcctgtgctggtgccccggggcatccggctgtacacctatgagcagatccctggcagcctgaaggacaacccctacatcacagatggctaccgggcctacctgcccagccggctgtgcatcaagagcctcttcatcctgagcaatgagaccgtgaacatctggagccacctgctgggcttcttcctgttcttcaccctgggcatctatgacatgacctctgtgctgcccagcgccagcgccagcagagaagattttgtgatctgcagcatctgcctcttctgcttccaggtgtgcatgctgtgcagcgtgggctaccacctgttcagctgccacaggtctgagaagacctgccgccgctggatggccctggactatgccggcatcagcatcggcatcctgggctgctacgtgtctggagtcttctacgccttctactgcaacaactactggaggcaggtgtacctgatcaccgtgctggccatgatcctggccgtgttctttgcccagatccaccccaactacctgacccagcagtggcagaggctgcggagcatcatcttctgcagcgtgtctggctatggagtcatccccaccctgcactgggtgtggctgaatggaggcatcggggcccccatcgtgcaggactttgccccccgggtgattgtgatgtacatgattgccctgctggccttcctgttctacatcagcaaggtgcctgagcgctacttccctggccagctgaactacctgggcagcagccaccagatctggcacatcctggccgtggtgatgctgtactggtggcaccagagcacagtgtatgtgatgcagtaccgccacagcaagccctgcccagactatgtgagccacctgtag

SEQ ID NO: 37017 - DNA, 936 bp, Artificial Sequence; identical to SEQ ID NO: 37016
  Description of Artificial Sequence: Synthetic coding sequence

SEQ ID NO: 37018 - DNA, 600 bp, Artificial Sequence
  Description of Artificial Sequence: Synthetic coding sequence
atggccttcctggccggcccccggctgctggactgggccagcagccccccccacctgcagttcaacaagtttgtgctgaccggctacagacctgccagcagcggcagcggctgcctgcggagcctcttctacctgcacaatgagctgggcaacatctacacccatggagccctgcccatcatccactgcaccctggcctgccggccctggctgcggcctgctgccctggtgggctacacagtgctgtctggagtggccggctggagggccctgacagcccccagcaccagcgcccggctgcgggccttcggctggcaggccgccgcccggctgctggtgtttggagcccggggcgtgggcctgggcagcggggcccctggcagcctgccctgctacctgaggatggatgccctggccctgctgggcggcctggtgaatgtggcccggctgcctgagcgctggggccctggccgctttgactactggggcaacagccaccagatcatgcacctgctgtctgtgggcagcatcctgcagctgcacgccggcgtggtgcctgacctgctgtgggccgcccaccacgcctgcccccgggactag

SEQ ID NO: 37019 - DNA, 822 bp, Artificial Sequence
  Description of Artificial Sequence: Synthetic coding sequence
atggccttcctggccggcccccggctgctggactgggccagcagccccccccacctgcagttcaacaagtttgtgctgaccggctacagacctgccagcagcggcagcggctgcctgcggagcctcttctacctgcacaatgagctgggcaacatctacacccacggcctggccctgctgggcttcctggtgctggtgcccatgaccatgccctggggccagctgggcaaggatggctggctgggcggcacccactgtgtggcctgcctggcccccccagctggctctgtgctgtaccacctgttcatgtgccaccagggcggcagcgctgtgtatgcccggctgctggccctggacatgtgtggggtgtgcctggtgaacaccctgggcgccctgcccatcatccactgcaccctggcctgccggccctggctgcggcctgctgccctggtgggctacacagtgctgtctggagtggccggctggagggccctgacagcccccagcaccagcgcccggctgcgggccttcggctggcaggccgccgcccggctgctggtgtttggagcccggggcgtgggcctgggcagcggggcccctggcagcctgccctgctacctgaggatggatgccctggccctgctgggcggcctggtgaatgtggcccggctgcctgagcgctggggccctggccgctttgactactggggcaacagccaccagatcatgcacctgctgtctgtgggcagcatcctgcagctgcacgccggcgtggtgcctgacctgctgtgggccgcccaccacgcctgcccccgggactag

SEQ ID NO: 37020 - DNA, 1134 bp, Artificial Sequence
  Description of Artificial Sequence: Synthetic coding sequence
atgccccggcggctgcagcccaggggggccggcaccaagggccccccagccccagccccagctgccagcggggccgccaggaacagccacagcgctgccagccgggaccccccagccagcgccaagcccctgctgcgctgggatgaggtgcctgatgactttgtggagtgcttcatcctgagcggctaccgccgcctgccctgcacagcccaggagtgcctggcctctgtgctgaagcccaccaatgagaccctgaacttctggacccacttcatccccctgctgctcttcctgagcaagttctgccgcctcttcttcctgtctggaggagatgtgcccttccaccacccctggctgctgcccctgtggtgctacgccagcggcgtgctgctgacctttgccatgagctgcacagcccacgtgttcagctgcctgagcctgcggctgcgggccgccttcttctacctggactatgccagcatctcctactacggcttcggcagcacagtggcctactactactacctgctgcccggcctgagcctgctggatgcccgggtgatgaccccctacctgcagcagaggctgggctggcacgtggactgcacccggctgattgctgcctaccgggccctggtgctgcctgtggcctttgtgctggccgtggcctgcaccgtggcctgctgcaagagcaggacagactggtgcacctacccctttgccctgcggacctttgtgtttgtgatgcccctgtccatggcctgccccatcatgctggagagctggctgtttgacctgcggggggagaaccccaccctgtttgtgcacttctaccgccgctacttctggctggtggtggccgccttcttcaacgtgtccaagatccctgagcgcatccagcccggcctgtttgacatcatcggccacagccaccagctgttccacatcttcaccttcctgagcatctatgaccaggtgtactacgtggaggagggcctgcggcagttcctgcaggcccccccagctgcccccaccttctctggaacagtgggctacatgctgctgctggtggtgtgcctgggcctggtgatcaggaagttcctgaacagcagcgagttctgcagcaagaagtag

SEQ ID NO: 37021 - DNA, 993 bp, Artificial Sequence
  Description of Artificial Sequence: Synthetic coding sequence
atgctgagcctgaagctgcccaggctcttcagcattgaccagatcccccaggtgttccacgagcagggcatcctgtttggctaccgccacccccagagcagcgccacagcctgcatcctgagcctcttccagatgaccaatgagaccctgaacatctggacccacctgctgcccttctggttctttgcctggaggtttgtgacagccctgtacatgacagacatcaagaatgacagctacagctggcccatgctggtgtacatgtgcaccagctgtgtgtaccccctggtgagcagctgtgcccacaccttcagctccatgagcaagaatgcccggcacatctgctacttcctggactatggagctgtgaacctcttcagcctgggcagcgccatcgcctacagcgcctacaccttcccagatgccctgatgtgcaccaccttccatgactactacgtggccctggccgtgctgaacaccatcctgagcacaggcctgagctgctacagccgcttcctggagatccagaagccccggctgtgcaaggtgatccgggtgctggcctttgcctacccctacacctgggacagcctgcccatcttctaccgcctcttcctgtttcctggagagagcgcccagaatgaggccaccagctaccaccagaagcacatgatcatgaccctgctggccagcttcctgtacagcgcccacctgcctgagcggctggcccctggccgctttgactacatcggccacagccaccagctgttccacgtgtgtgtgatcctggccacccacatgcagatggaggccatcctgctggacaagaccctgaggaaggagtggctgctggccaccagcaagcccttctccttcagccagattgctggggccatcctgctgtgcatcatcttcagcctgagcaacatcatctacttctctgctgccctgtaccgcatccccaagccagagctgcacaagaaggagacctag

SEQ ID NO: 37022 - DNA, 993 bp, Artificial Sequence; identical to SEQ ID NO: 37021
  Description of Artificial Sequence: Synthetic coding sequence

SEQ ID NO: 37023 - DNA, 993 bp, Artificial Sequence; identical to SEQ ID NO: 37021
  Description of Artificial Sequence: Synthetic coding sequence

SEQ ID NO: 37024 - DNA, 1035 bp, Artificial Sequence
  Description of Artificial Sequence: Synthetic coding sequence
atgctgagcctgaagctgccccagctgctgcaggtgcaccaggtgcccagggtcttctgggaggatggcatcatgagcggctacagaagacccaccagcagcgccctggactgtgtgctgagcagcttccagatgaccaatgaaacagtgaacatctggacccacttcctgcccacctggtacttcctgtggaggctgctggccctggccggcggccctggcttccgggcagagccctaccactggcccctgctggtgttcctgctgcctgcctgcctgtacccctttgccagctgctgtgcccacaccttcagctccatgagccccaggatgaggcacatctgctacttcctggactatggagccctgagcctgtacagcctgggctgtgccttcccctatgctgcctacagcatgcctgcctcctggctgcacggccacctgcaccagttctttgtgcctgctgctgccctgaacagcttcctgtgcaccggcctgagctgctacagccgcttcctggagctggagagccctggcctgagcaaggtgctgaggactggagcctttgcctaccccttcctgtttgacaacctgcccctcttctaccgcctgggcctgtgctggggccggggccacggctgcggccaggaggccctgagcaccagccacggctaccacctgttctgtgccctgctgaccggcttcctgtttgccagccacctgcctgagcggctggcccctggccgctttgactacatcggccacagccaccagctgttccacatctgtgctgtgctgggcacccacttccagctggaggccgtgctggccgacatgggcagccggcgggcctggctggccacccaggagcccgccctgggcctggccggcaccgtggccaccctggtgctggccgctgctggcaacctgctgatcatcgccgccttcaccgccaccctgctgcgggcccccagcacctgccccctgctgcagggcggccccctggagggcggcacccaggccaagcagcagtag

SEQ ID NO: 37025 - DNA, 1056 bp, Artificial Sequence
  Description of Artificial Sequence: Synthetic coding sequence
atgagccccaggatgaggcacatctgctacttcctggactatggagccctgagcctgtacagcctgggctgtgccttcccctatgctgcctacagcatgcctgcctcctggctgcacggccacctgcaccagttctttgtgcctgctgctgccctgaacagcttcctgtgcaccggcctgagctgctacagccgcttcctggagctggagagccctggcctgagcaaggtgctgaggactggagcctttgcctaccccttcctgtttgacaacctgcccctcttctaccgcctgggcctgtgctggggccggggccacggctgcggccaggaggccctgagcaccagccacggctaccacctgttctgtgccctgctgaccggcttcctgtttgccagccacctgcctgagcggctggcccctggccgctttgactacatcggggagggcaccccaggccctgcccgggaggaggccggggctgatgccttccctgagcacaggatgaactgggccacagccaccagctacagcacctctgtgcagtgctgggcccccaccagctcctggaggcagtgctggctgatctgggaccacgccgagcccggctggccccacaggaacctgccctgggcctggcaggcccagtggccccactggagctggctgcagctgggcacctacagcctgctgctgctgagccagcccccctgctttggacctcctgtgcacgccctgtgctgccgggtggcccactggaggggcgtgccccggcccaacaacagcgaggcccccagcctgaccctgtcctggaggggccagaggcctggccccagcgcagatgaggagccccgcttcggccccaaccaggtgggcacccacctgagcctggagcccaccggggctgaggagcggggccaccggcgggagggccgggaggaggagggctgcctgggcggcctggctgaatgtgagcgggaccgggagggcgccctggatggcagcggccgctctgctgagggcctgcggggggagatgcacgcctgccccggctag

SEQ ID NO: 37026 - DNA, 1092 bp, Artificial Sequence
  Description of Artificial Sequence: Synthetic coding sequence
accctgcccccatctgcctggctggccgccgccctggacagcgcccggggggccctgggcctgctgacccaccagctgcggagcacccaccaggccctgggcgtgctgggccgctggcaccacgtgtggctgcccccaccccaccagctgggcttcggcctgtgcccccagctgctgcctgatgaccagagagatggccagcacctggacagcctgcctgcccacctggtgcggggcggcagcgcccctggccggggcctggagctgcggggcggcacccaggccggccgggaccggcccggccccagggctgctgctgctgtggccggcgtgcggggcggcctgagcaccaggcctccccaggtgctgcctgtggccgcccctggggccggcggccggccccggctgccctgtggggctgtgcccctggccgccgccggcctgcctgctgcccggctgcccctgcccctgcgggtggtgctgcgggcccacctgcagctgcacgtggccccccacgccccccacctgctgctgccccggctgcggcgggcccagcccctgcagagcggcttcctggagctggagagccctggcctgagcaaggtgctgaggactggagcctttgcctaccccttcctgtttgacaacctgcccctcttctaccgcctgggcctgtgctggggccggggccacggctgcggccaggaggccctgagcaccagccacggctaccacctgttctgtgccctgctgaccggcttcctgtttgccagccacctgcctgagcggctggcccctggccgctttgactacatcggccacagccaccagctgttccacatctgtgctgtgctgggcacccacttccagctggaggccgtgctggccgacatgggcagcagaagagcctggctggccacccaggagcccgccctgggcctggccggcaccgtggccaccctggtgctggccgccgccggcaacctgctgatcatcgccgccttcaccgccaccctgctgcgggcccccagcacctgccccctgctgcagggcggccccctggagggcggcacccaggccaagcagcagtag

SEQ ID NO: 37027 - DNA, 1056 bp, Artificial Sequence; identical to SEQ ID NO: 37025
  Description of Artificial Sequence: Synthetic coding sequence

SEQ ID NO: 37028 - DNA, 1056 bp, Artificial Sequence; identical to SEQ ID NO: 37025
  Description of Artificial Sequence: Synthetic coding sequence

SEQ ID NO: 37029 - DNA, 963 bp, Artificial Sequence
  Description of Artificial Sequence: Synthetic coding sequence
atgagcggctacagaagacccaccagcagcgccctggactgtgtgctgagcagcttccagatgaccaatgaaacagtgaacatctggacccacttcctgcccacctggtacttcctgtggaggctgctggccctggccggcggccctggcttccgggcagagccctaccactggcccctgctggtgttcctgctgcctgcctgcctgtacccctttgccagctgctgtgcccacaccttcagctccatgagccccaggatgaggcacatctgctacttcctggactatggagccctgagcctgtacagcctgggctgtgccttcccctatgctgcctacagcatgcctgcctcctggctgcacggccacctgcaccagttctttgtgcctgctgctgccctgaacagcttcctgtgcaccggcctgagctgctacagccgcttcctggagctggagagccctggcctgagcaaggtgctgaggactggagcctttgcctaccccttcctgtttgacaacctgcccctcttctaccgcctgggcctgtgctggggccggggccacggctgcggccaggaggccctgagcaccagccacggctaccacctgttctgtgccctgctgaccggcttcctgtttgccagccacctgcctgagcggctggcccctggccgctttgactacatcggccacagccaccagctgttccacatctgtgctgtgctgggcacccacttccagctggaggccgtgctggccgacatgggcagccggcgggcctggctggccacccaggagcccgccctgggcctggccggcaccgtggccaccctggtgctggccgctgctggcaacctgctgatcatcgccgccttcaccgccaccctgctgcgggcccccagcacctgccccctgctgcagggcggccccctggagggcggcacccaggccaagcagcagtag

SEQ ID NO: 37030 - DNA, 381 bp, Artificial Sequence
  Description of Artificial Sequence: Synthetic coding sequence
ctgcccctgcccctgcgggtggtgctgcgggcccacctgcagctgcacgtggccccccacgccccccacctgctgctgccccggctgcggagatttgactacatcggccacagccaccagctgttccacatctgtgctgtgctgggcacccacttccagctggaggccgtgctggccgacatgggcagccggcgggcctggctggccacccaggagcccgccctgggcctggccggcaccgtggccaccctggtgctggccgctgctggcaacctgctgatcatcgccgccttcaccgccaccctgctgcgggcccccagcacctgccccctgctgcagggcggccccctggagggcggcacccaggccaagcagcagtag

SEQ ID NO: 37031 - DNA, 1026 bp, Artificial Sequence
  Description of Artificial Sequence: Synthetic coding sequence
atgctgagcctgaagctgccccagctgctgcaggtgcaccaggtgttctgggaggatggcatcatgagcggctaccgccggcccaccagcagcgccctggactgtgtgctgagcagcttccagatgaccaatgagaccgtgaacatctggacccacttcctgcccacctggtacttcctgtggaggctgctggccctggccggcggccctggcttccgggcagagccctaccactggcccctgctggtgttcctgctgcctgcctgcctgtacccctttgccagctgctgtgcccacaccttcagctccatgagccccaggatgaggcacatctgctacttcctggactatggagccctgagcctgtacagcctgggctgtgccttcccctatgctgcctacagcatgcctgcctcctggctgcacggccacctgcaccagttctttgtgcctgctgctgccctgaacagcttcctgtgcaccggcctgagctgctacagccgcttcctggagctggagagccctggcctgagcaaggtgctgaggactggagcctttgcctaccccttcctgtttgacaacctgcccctcttctaccgcctgggcctgtgctggggccggggccacggctgcggccaggaggccctgagcaccagccacggctaccacctgttctgtgccctgctgaccggcttcctgtttgccagccacctgcctgagcggctggcccctggccgctttgactacatcggccacagccaccagctgttccacatctgtgctgtgctgggcacccacttccagctggaggccgtgctggccgacatgggcagcagaagagcctggctggccacccaggagcccgccctgggcctggccggcaccgtggccaccctggtgctggccgccgccggcaacctgctgatcatcgccgccttcaccgccaccctgctgcgggcccccagcacctgccccctgctgcagggcggccccctggagggcggcacccaggccaagcagcagtag

SEQ ID NO: 37032 - DNA, 1065 bp, Artificial Sequence
  Description of Artificial Sequence: Synthetic coding sequence
atgaccacagccatcctggagcggctgagcaccctgtctgtgtctggccagcagctgcggcggctgcccaagatcctggaggatggcctgcccaagatgccctgcaccgtgcctgagacagatgtgccccagctgttccgggagccctacatcagaacaggctaccggcccaccggccacgagtggagatactacttcttcagcctcttccagaagcacaatgaggtggtgaatgtgtggacccacctgctggccgccctggccgtgctgctgcgcttctgggcctttgctgaggccgaggccctgccctgggccagcacccacagcctgcccctgctgctcttcatcctgagcagcatcacctacctgacctgcagcctgctggcccacctgctgcagagcaagtctgagctgagccactacaccttctactttgtggactatgtgggcgtgtctgtgtaccagtatggcagcgccctggcccacttcttctacagcagtgaccaggcctggtatgaccgcttctggctgttcttcctgcctgctgctgccttctgtggctggctgagctgtgccggctgctgctacgccaagtaccgctaccgccggccctaccctgtgatgaggaagatctgccaggtggtgcctgctggcctggccttcatcctggacatcagccctgtggcccaccgggtggccctgtgccacctggccggctgccaggagcaggccgcctggtaccacaccctgcagatcctcttcttcctggtgtctgcctacttcttcagctgccctgtgcctgagaagtacttccctggcagctgtgacatcgtgggccacggccaccagatcttccacgccttcctgagcatctgcaccctgagccagctggaggccatcctgctggactaccagggccggcaggagatcttcctgcagagacatggccccctgtctgtgcacatggcctgcctgtccttcttcttcctggccgcctgcagcgctgccacagctgccctgctgcggcacaaggtgaaggcccggctgaccaagaaggacagctag

SEQ ID NO: 37033 - DNA, 1065 bp, Artificial Sequence; identical to SEQ ID NO: 37032
  Description of Artificial Sequence: Synthetic coding sequence

SEQ ID NO: 37034 - DNA, 339 bp, Artificial Sequence
  Description of Artificial Sequence: Synthetic coding sequence
atgaccacagccatcctggagcggctgagcaccctgtctgtgtctggccagcagctgcggcggctgcccaagatcctggaggatggcctgcccaagatgccctgcaccgtgcctgagacagatgtgccccagctgttccgggagccctacatcagaacaggctaccggcccaccggccacgagtggagatactacttcttcagcctcttccagaagcacaatgaggtggtgaatgtgtggacccacctgctggccgccctggccgtgctgctgcgcttctgggcctttgctgaggccgaggccctgccctgggccagcacccacagcctgcccctgtag

SEQ ID NO: 37035 - DNA, 576 bp, Artificial Sequence
  Description of Artificial Sequence: Synthetic coding sequence
atggccgcctacagctaccggcccggccctggggccggccctggccctgctgctggggccgccctgcctgaccagagcttcctgtggaatgtgttccagagggtggacaaggacagaagtggagtcatcagtgacacagagctgcagcaggccctgagcaatggcacctggacccccttcaaccctgtgacagtgcgcagcatcatctccatgtttgaccgggagaacaaggccggcgtgaacttcagcgagttcaccggggtgtggaagtacatcacagactggcagaatgtgttccgcacctatgaccgggacaacagcggcatgattgacaagaatgagctgaagcaggccctgagcggcttcggctaccgcctgagtgaccagttccatgacatcctgatcaggaagtttgaccggcagggccggggccagatcgcctttgatgacttcatccagggctgcatcgtgctgcagaggctgacagacatcttccgccgctatgacacagaccaggacggctggatccaggtgtcctatgagcagtacctgtccatggtgttcagcatcgtgtag

SEQ ID NO: 37036 - DNA, 210 bp, Artificial Sequence
  Description of Artificial Sequence: Synthetic coding sequence
atggccgcctacagctaccggcccggccctggggccggccctggccctgctgctggggccgccctgcctgaccagagcttcctgtggaatgtgttccagagggtggacaaggacagaagtggagtcatcagtgacacagagctgcagcaggccctgagcaatggcacctggacccccttcaaccctgtgacagtgcgcagcatcatctag

SEQ ID NO: 37037 - DNA, 222 bp, Artificial Sequence
  Description of Artificial Sequence: Synthetic coding sequence
atggccgcctacagctaccggcccggccctggggccggccctggccctgctgctggggccgccctgcctgaccagagcttcctgtggaatgtgttccagagggtggacaaggacagaagtggagtcatcagtgacacagagctgcagcaggccctgagcaatggcacctggacccccttcaaccctgtgacagtgcgcagcatcatctgccggggccgctag

SEQ ID NO: 37038 - DNA, 570 bp, Artificial Sequence
  Description of Artificial Sequence: Synthetic coding sequence
atggccgcctacagctaccggcccggccctggggccggccctggccctgctgctggggccgccctgcctgaccagagcttcctgtggaatgtgttccagagggtggacaaggacagaagtggagtcatcagtgacacagagctgcagcaggccctgagcaatggcacctggacccccttcaaccctgtgacagtgcgcagcatcatctccatgtttgaccgggagaacaaggccggcgtgaacttcagcgagttcaccggggtgtggaagtacatcacagactggcagaatgtgttccgcacctatgaccgggacaacagcggcatgattgacaagaatgagctgaagcaggccctgagcggctaccgcctgagtgaccagttccatgacatcctgatcaggaagtttgaccggcagggccggggccagatcgcctttgatgacttcatccagggctgcatcgtgctgcagaggctgacagacatcttccgccgctatgacacagaccaggacggctggatccaggtgtcctatgagcagtacctgtccatggtgttcagcatcgtgtag

SEQ ID NO: 37039 - DNA, 168 bp, Artificial Sequence
  Description of Artificial Sequence: Synthetic coding sequence
atggccgcctacagctaccggcccggccctggggccggccctggccctgctgctggggccgccctgcctgaccagagcttcctgtggaatgtgttccagagggtggacaaggacagaagtggagtcatcagtgacacagagctgcagcaggccctgagcaatggatag

SEQ ID NO: 37040 - DNA, 1182 bp, Artificial Sequence
  Description of Artificial Sequence: Synthetic coding sequence
atggagaccaccatgggcttcatggatgacaatgccaccaacaccagcaccagcttcctgtctgtgctgaacccccacggggcccacgccaccagcttccccttcaacttctcctacagcgactatgacatgcccctggatgaagatgaagatgtgaccaacagcaggaccttctttgctgccaagatcgtgattggcatggccctggtgggcatcatgctggtgtgtggcatcggcaacttcatcttcatcgccgccctggtgcgctacaagaagctgaggaacctgaccaacctgctgattgccaacctggccatcagtgacttcctggtggccatcgtgtgctgcccctttgagatggactactacgtggtgcggcagctgtcctgggagcacggccacgtgctgtgcacctctgtgaactacctgaggacagtgtccctgtatgtgtccaccaatgccctgctggccatcgccatcgaccgctacctggccatcgtgcaccccctgcggcccaggatgaagtgccagacagccaccggcctgattgccctggtgtggacagtgtccatcctgattgccatccccagcgcctacttcaccacagagaccgtgctggtgattgtgaagagccaggagaagatcttctgtggccagatctggcctgtggaccagcagctgtactacaagagctacttcctgttcatctttggaattgaatttgtgggccctgtggtgaccatgaccctgtgctacgcccgcatcagccgggagctgtggttcaaggctgtgcccggcttccagacagagcagatcaggaagaggctgcgctgcaggaggaagacagtgctggtgctgatgtgcatcctgacagcctacgtgctgtgctgggcccccttctacggcttcaccatcgtgcgggacttcttccccaccgtgtttgtgaaggagaagcactacctgacagccttctacatcgtggagtgcatcgccatgagcaacagcatgatcaacaccctgtgctttgtgacagtgaagaatgacacagtgaagtacttcaagaagatcatgctgctgcactggaaggccagctacaacggcggcaagagcagcgctgacctggacctgaagaccatcggcatgcctgccacagaggaggtggactgcatccggctgaagtag

SEQ ID NO: 37041 - DNA, 1182 bp, Artificial Sequence; identical to SEQ ID NO: 37040
  Description of Artificial Sequence: Synthetic coding sequence

SEQ ID NO: 37042 - DNA, 1113 bp, Artificial Sequence
  Description of Artificial Sequence: Synthetic coding sequence
atggccagcagcaccacccggggcccccgggtgtctgacctcttcagcggcctgcccccagctgtgaccaccccagccaaccagagcgctgaggccagcgctggaaatggatctgtggccggggctgatgccccagctgtgacccccttccagagcctgcagctggtgcaccagctgaagggcctgattgtgctgctgtacagcgtggtggtggtggtgggcctggtgggcaactgcctgctggtgctggtgattgcccgggtgcggcggctgcacaacgtgaccaacttcctgattggcaacctggccctgagtgatgtgctgatgtgcacagcctgtgtgcccctgaccctggcctatgcctttgagccccggggctgggtgtttggaggcggcctgtgccacctggtgttcttcctgcagcctgtgacagtgtatgtgtctgtgttcaccctgaccaccatcgctgtggaccgctacgtggtgctggtgcaccccctgcggcggcgcatcagcctgcggctgagcgcctatgctgtgctggccatctgggccctgtctgctgtgctggccctgcctgctgctgtgcacacctaccacgtggagctgaagccccatgatgtgcggctgtgtgaggagttctggggcagccaggagcggcagaggcagctgtatgcctggggcctgctgctggtgacctacctgctgcccctgctggtgatcctgctgtcctatgtgcgggtgtctgtgaagctgaggaacagagtggtgcccggctgtgtgacccagagccaggccgactgggaccgggccaggagaagaaggaccttctgcctgctggtggtgattgtggtggtgtttgctgtgtgctggctgcccctgcacgtgttcaacctgctgcgggacctggacccccacgccatcgacccctatgccttcggcctggtgcagctgctgtgccactggctggccatgagcagcgcctgctacaaccccttcatctatgcctggctgcatgacagcttccgggaggagctgaggaagctgctggtggcctggcccaggaagatcgccccccacggccagaacatgacagtgtctgtggtgatctag

SEQ ID NO: 37043 - DNA, 1113 bp, Artificial Sequence; identical to SEQ ID NO: 37042
  Description of Artificial Sequence: Synthetic coding sequence

SEQ ID NO: 37044 - DNA, 888 bp, Artificial Sequence
  Description of Artificial Sequence: Synthetic coding sequence
atgcccttcccccccatgcctcctcctccagccccagcccctggggcccaggccgcccggcagctgccccggcggccctgtgccgccggggacaagaagaagaggcctccccagaggcctgagggcctgctgagcagctcctggcccagcgccaccctgaagaggcccccagcccggcggggccctggcctggacaggacccagcccccagcccctcctggggtgagcccccaggccctgcccagccgggcccgggccccagccacctgtgccccacccaggcctgctggcagcggccacagccctgcccggaccacctacgccgccaccagcgctggcaccggcaccacagctgctggcaccagcagtggagctggcccctgcccagattctgctgcccgcttctgcctgaacctgaccccagaggccgtgctggtgatccagaagaggcacctggagaagcagctgctggcccggccccggcggcccttccccagccccagcgctgagccccggcggctgctggccccctgcctgcctgcccgggccgccggccccaggagaggaggccctgccagtgaccctgatgccccacccacagctggccagggcagaagagcccctcctcctggggcccagctgctgcacggcggcctgcaggtgccccagctgagccccaggcctggggccctgcggcccatgctgaaggtgtccctgctgaatgaaagacacagatatgatgatgtggagtatgaggaggagcctgaggccgtggatgagggcctggtgaggaaatgtacagagtggctgcggggcgtggagagcgctgctgctgcccggggccgggccggggccctggacagcagaagacacctgagcaccctgtag

SEQ ID NO: 37045 - DNA, 354 bp, Artificial Sequence
  Description of Artificial Sequence: Synthetic coding sequence
atgcccttcccccccatgcctcctcctccagccccagcccctggggcccaggccgcccggcagctgccccggcggccctgtgccgccggggacaagaagaagaggcctccccagaggcctgagggcctgctgagcagctcctggcccagcgccaccctgaagaggcccccagcccggcggggccctggcctggacaggacccagcccccagcccctcctggggtgagcccccaggccctgcccagccgggcccgggccccagccacctgtgccccacccaggcctgctggcagcggccacagccctgcccggaccacctacgccgccaccagcgctggcaccggcaccacctag

SEQ ID NO: 37046 - DNA, 888 bp, Artificial Sequence
  Description of Artificial Sequence: Synthetic coding sequence
atgagcagccctgtgctgagtgacctgccccgcttccaggccgcccggcaggccctgcagctgagcagcagcagcgcctggaacagcgtgcagacagctgtgatcaacgtgttcaagggcggcggcctgcagagcaatgagctgtatgccctgaatgaaaacatccggcggctgctgaagtctgagctgggcagcttcatcacagactacttccagaaccagctgctggccaagggcctcttctttgtggaggagaagatcaagctgtgtgaaggagaaaatcgcatcgaggtgctggccgaggtgtgggaccacttcttcacagagaccctgcccaccctgcaggccatcttctaccctgtgcagagcgtgcatgagcccaccggccccagcgagagctacctgcagctggaggagctggtgaagcaggtggtgagccccttcctgggcatcagcggggacaggagcttcagcggccccacctacaccctggcccggcggcacagccgggtgcggcccaaggtgacagtgctgaactatgccagccccatcacagctgtgtcccggcccctgaatgagatggtgctgacccccctgacagagcaggagggggaggcctacctggagaagtgtggctctgtgagaagacacacagtggccaatgcccacagcgacatccagctgctggccatggccaccatgatgcacagcggcctgggggaggaggccagcagcgagaacaagtgcctgctgctgcccccatccttccccccaccccaccggcagtgcagcagcgagcccaacatcacagacaacccagatggcctggaggagggcgcccggggcagccaggagggcagcgagctgaactgtgccagcctgtcctag

SEQ ID NO: 37047 - DNA, 1107 bp, Artificial Sequence
  Description of Artificial Sequence: Synthetic coding sequence
atgacccggggctttgcccccatcctgcctgtggagttccacaagatgggcagcttccggcggccccggccccgcttcatgagcagccctgtgctgagtgacctgccccgcttccaggccgcccggcaggccctgcagctgagcagcagcagcgcctggaacagcgtgcagacagctgtgatcaacgtgttcaagggcggcggcctgcagagcaatgagctgtatgccctgaatgaaaacatccggcggctgctgaagtctgagctgggcagcttcatcacagactacttccagaaccagctgctggccaagggcctcttctttgtggaggagaagatcaagctgtgtgaaggagaaaatcgcatcgaggtgctggccgaggtgtgggaccacttcttcacagagaccctgcccaccctgcaggccatcttctaccctgtgcagggccaggagctgaccatccggcagatcagcctgctgggcttccgggacctggtgctgctgaaggtgaagctgggggacctgctgctgctggcccagagcaagctgcccagcagcatcgtgcagatgctgctgatcctgcagagcgtgcatgagcccaccggccccagcgagagctacctgcagctggaggagctggtgaagcaggtggtgagccccttcctgggcatcagcggggaccgctccttcagcggccccacctacaccctggcccggcggcacagccgggtgcggcccaaggtgacagtgctgaactatgccagccccatcacagctgtgtcccggcccctgaatgagatggtgctgacccccctgacagagcaggagggggaggcctacctggagaagtgtggctctgtgcggcggcacacagtggccaatgcccacagcgacatccagctgctggccatggccaccatgatgcacagcggcctgggggaggaggccagcagcgagaacaagtgcctgctgctgccccccagcttccccccaccccaccggcagtgcagcagcgagcccaacatcacagacaacccagatggcctggaggagggcgcccggggcagccaggagggcagcgagctgaactgtgccagcctgtcctag

SEQ ID NO: 37048 - DNA, 147 bp, Artificial Sequence
  Description of Artificial Sequence: Synthetic coding sequence
atgacccggggctttgcccccatcctgcctgtggagttccacaagatgggcagcttccggcggccccggccccgcttcatgagcagccctgtgctgagtgacctgccccgcttccaggccgcccggcaggccctgcagctgtcctag

SEQ ID NO: 37049 - DNA, 243 bp, Artificial Sequence
  Description of Artificial Sequence: Synthetic coding sequence
atgacccggggctttgcccccatcctgcctgtggagttccacaagatgggcagcttccggcggccccggccccgcttcatgagcagccctgtgctgagtgacctgccccgcttccaggccgcccggcaggccctgcagctgagcagcagcagcgcctggaacagcgtgcagacagctgtgatcaacgtgttcaagggcggcggcctgcagagcaatgagctgtatgccctgaatgaaaattag

SEQ ID NO: 37050 - DNA, 192 bp, Artificial Sequence
  Description of Artificial Sequence: Synthetic coding sequence
atgacccggggctttgcccccatcctgcctgtggagttccacaagatgggcagcttccggcggccccggccccgcttcatgagcagccctgtgctgagtgacctgccccgcttccaggccgcccggcaggccctgcagctgagcagcagcagcgcctggaacagcgtgcagacagctgtgatcaacgtgtag

SEQ ID NO: 37051 - DNA, 231 bp, Artificial Sequence
  Description of Artificial Sequence: Synthetic coding sequence
atgacccggggctttgcccccatcctgcctgtggagttccacaagatgggcagcttccggcggccccggccccgcttcatgagcagccctgtgctgagtgacctgccccgcttccaggccgcccggcaggccctgcagctgagcagcagcagcgcctggaacagcgtgcagacagctgtgatcaacgtgttcaagggcggcggcctgcagagcaatgagctgtatgcctag

SEQ ID NO: 37052 - DNA, 144 bp, Artificial Sequence
  Description of Artificial Sequence: Synthetic coding sequence
atgacccggggctttgcccccatcctgcctgtggagttccacaagatgggcagcttccggcggccccggccccgcttcatgagcagccctgtgctgagtgacctgccccgcttccaggccgcccggcaggccctgcagctgtag

SEQ ID NO: 37053 - DNA, 228 bp, Artificial Sequence
  Description of Artificial Sequence: Synthetic coding sequence
atgacccggggctttgcccccatcctgcctgtggagttccacaagatgggcagcttccggcggccccggccccgcttcatgagcagccctgtgctgagtgacctgccccgcttccaggccgcccggcaggccctgcagctgagcagcagcagcgcctggaacagcgtgcagacagctgtgatcaacgtgttcaagggcggcggcctgcagagcaatgagctgtactag

SEQ ID NO: 37054 - DNA, 150 bp, Artificial Sequence
  Description of Artificial Sequence: Synthetic coding sequence
atgacccggggctttgcccccatcctgcctgtggagttccacaagatgggcagcttccggcggccccggccccgcttcatgagcagccctgtgctgagtgacctgccccgcttccaggccgcccggcaggccctgcagctgagcagctag

SEQ ID NO: 37055 - DNA, 1107 bp, Artificial Sequence; identical to SEQ ID NO: 37047
  Description of Artificial Sequence: Synthetic coding sequence

SEQ ID NO: 37056 - DNA, 252 bp, Artificial Sequence
  Description of Artificial Sequence: Synthetic coding sequence
atgacccggggctttgcccccatcctgcctgtggagttccacaagatgggcagcttccggcggccccggccccgcttcatgagcagccctgtgctgagtgacctgccccgcttccaggccgcccggcaggccctgcagctgagcagcagcagcgcctggaacagcgtgcagacagctgtgatcaacgtgttcaagggcggcggcctgcagagcaatgagctgtatgccctgaatgaaaacatcagaagatag

SEQ ID NO: 37057 - DNA, 618 bp, Artificial Sequence
  Description of Artificial Sequence: Synthetic coding sequence
atgacccggggctttgcccccatcctgcctgtggagttccacaagatgggcagcttccggcggccccggccccgcttcatgagcagccctgtgctgagtgacctgccccgcttccaggccgcccggcaggccctgcagctgagcagcagcagcgcctggaacagcgtgcagacagctgtgatcaacgtgttcaagggcggcggcctgcagagcaatgagctgtatgccctgaatgaaaacatccggcggctgctgaagtctgagctgggcagcttcatcacagactacttccagaaccagctgctggccaagggcctcttctttgtggaggagaagatcaagctgtgtgaaggagaaaatcgcatcgaggtgctggccgaggtgtgggaccacttcttcacagagaccctgcccaccctgcaggccatcttctaccctgtgcagggccaggagctgaccatccggcagatcagcctgctgggcttccgggacctggtgctgctgaaggtgaagctgggggacctgctgctgctggcccagagcaagctgcccagcagcatcgtgcagatgctgctgatcctgcagcccggcggcaccccaggcagcggccccaggtag

SEQ ID NO: 37058 - DNA, 825 bp, Artificial Sequence
  Description of Artificial Sequence: Synthetic coding sequence
atggtgatgagccagggcacctacaccttcctgacctgctttgctggcttctggctgatctggggcctcatcgtgctgctgtgctgcttctgcagcttcctgcggcggcggctgaagaggcggcaggaggagcggctgcgggagcagaacctgcgggccctggagctggagcccctggagctggagggcagcctggccggcagccccccaggcctggccccaccccagcccccaccccacaggagccggctggaggccccagcccacgcccacagccacccccacgtgcacgtgcaccccctgctgcaccacggccctgcccagccccacgcccacgcccacccccacccccaccaccacgccctgccccaccccccacccacccacctgtctgtgcccccccggccctggagctacccccggcaggccgagagtgacatgagcaagccaccctgctatgaggaggccgtgctgatggccgagcccccaccaccctacagcgaggtgctgacagacacccggggcctgtacaggaagatcgtgacccccttcctgagcagaagagacagcgctgagaagcaggagcagcccccacccagctacaagcccctcttcctggaccggggctacaccagcgccctgcacctgcccagcgcccccaggcctgccccaccctgcccagccctgtgcctgcaggccgaccggggcagaagagtcttccccagctggacagacagcgagctgagcagccgggagcccctggagcacggggcctggaggctgcctgtgtccatccccctgtttggccgcaccacagctgtgtag

SEQ ID NO: 37059 - DNA, 765 bp, Artificial Sequence
  Description of Artificial Sequence: Synthetic coding sequence
atggtgatgagccagggcacctacaccttcctgacctgctttgctggcttctggctgatctggggcctcatcgtgctgctgtgctgcttctgcagcttcctgcggcggcggctgaagaggcggcaggaggagcggctgcgggagcagaacctgcgggccctggagctggagcccctggagctggagggcagcctggccggcagccccccaggcctggccccaccccagcccccaccccacaggagccggctggaggccccagcccaccacgcccacgcccacccccacccccaccaccacgccctgccccaccccccacccacccacctgtctgtgcccccccggccctggagctacccccggcaggccgagagtgacatgagcaagccaccctgctatgaggaggccgtgctgatggccgagcccccaccaccctacagcgaggtgctgacagacacccggggcctgtacaggaagatcgtgacccccttcctgagcagaagagacagcgctgagaagcaggagcagcccccacccagctacaagcccctcttcctggaccggggctacaccagcgccctgcacctgcccagcgcccccaggcctgccccaccctgcccagccctgtgcctgcaggccgaccggggcagaagagtcttccccagctggacagacagcgagctgagcagccgggagcccctggagcacggggcctggaggctgcctgtgtccatccccctgtttggccgcaccacagctgtgtag

SEQ ID NO: 37060 - DNA, 825 bp, Artificial Sequence; identical to SEQ ID NO: 37058
  Description of Artificial Sequence: Synthetic coding sequence

SEQ ID NO: 37061 - DNA, 537 bp, Artificial Sequence
  Description of Artificial Sequence: Synthetic coding sequence
atggtgatgagccagggcacctacaccttcctgacctgctttgctggcttctggctgatctggggcctcatcgtgctgctgtgctgcttctgcagcttcctgcggcggcggctgaagaggcggcaggaggagcggctgcgggagcagaacctgcgggccctggagctggagcccctggagctggagggcagcctggccggcagccccccaggcctggccccaccccagcccccaccccacaggagccggctggaggccccagcccacgcccacagccacccccacgtgcacgtgcaccccctgctgcaccacggccctgcccagccccacgcccacgcccacccccacccccaccaccacgccctgccccaccccccacccacccacctgtctgtgcccccccggccctggagctacccccggcaggccgagagtgacatgagcaagccaccctgctatgaggaggccgtgctgatggccgagcccccaccaccctacagcgaggtgctgacagacacccggggcctgtacagatag

SEQ ID NO: 37062 - DNA, 825 bp, Artificial Sequence; identical to SEQ ID NO: 37058
  Description of Artificial Sequence: Synthetic coding sequence

SEQ ID NO: 37063 - DNA, 1338 bp, Artificial Sequence
  Description of Artificial Sequence: Synthetic coding sequence
atgatggaggagagcggcatcgagaccaccccacctggcaccccaccacccaacccagctggcctggccgccacagccatgagcagcacccctgtgcccctggccgccaccagcagcttcagcagccccaacgtgtcctccatggagagcttcccccccctggcctacagcaccccccagccccccctgccccctgtgcggcccagcgcccccctgccctttgtgcccccacctgctgtgcccagcgtgccccccctggtgacctccatgcctcctcctgtgagccccagcacagctgctgccttcggcaacccccctgtgagccacttcccccccagcaccagcgcccccaacaccctgctgcctgccccacccagcggcccccccatcagcggcttctctgtgggcagcacctatgacatcacccggggccacgccggccgggccccccagacccccctgatgcccagcttcagcgcccccagcggcaccggcctgctgcccacccccatcacccagcaggccagcctgaccagcctggcccagggcaccggcaccaccagcgccatcaccttccctgaggagcaggaggacccccgcatcacccggggccaggatgaggccagcgctgggggcatctggggcttcatcaagggcgtggccggcaaccccatggtgaagtctgtgctggacaagaccaagcacagcgtggagagcatgatcaccaccctggaccccggcatggccccctacatcaagagcggcggggagctggacatcgtggtgaccagcaacaaggaggtgaaggtggccgctgtgagagatgccttccaggaggtgtttggcctggccgtggtggtgggggaggccggccagagcaacatcgccccccagcctgtgggctatgctgctggcctgaagggggcccaggagagaattgacagcctgcggaggactggagtcatccacgagaagcagacagctgtgtctgtggagaacttcatcgccgagctgctgcctgacaagtggtttgacatcggctgcctggtggtggaggaccctgtgcacggcatccacctggagaccttcacccaggccacccctgtgcccctggagtttgtgcagcaggcccagagcctgaccccccaggactacaacctgcgctggagcggcctgctggtgacagtgggggaggtgctggagaagagcctgctgaatgtgtccaggacagactggcacatggccttcaccggcatgagccggcggcagatgatctacagcgctgcccgggccatcgccggcatgtacaagcagaggctgccccccaggacagtgtag

SEQ ID NO: 37064 - DNA, 1395 bp, Artificial Sequence
  Description of Artificial Sequence: Synthetic coding sequence
atgatggaggagagcggcatcgagaccaccccacctggcaccccaccacccaacccagctggcctggccgccacagccatgagcagcacccctgtgcccctggccgccaccagcagcttcagcagccccaacgtgtcctccatggagagcttcccccccctggcctacagcaccccccagccccccctgccccctgtgcggcccagcgcccccctgccctttgtgcccccacctgctgtgcccagcgtgccccccctggtgacctccatgcctcctcctgtgagccccagcacagctgctgccttcggcaacccccctgtgagccacttcccccccagcaccagcgcccccaacaccctgctgcctgccccacccagcggcccccccatcagcggcttctctgtgggcagcacctatgacatcacccggggccacgccggccgggccccccagacccccctgatgcccagcttcagcgcccccagcggcaccggcctgctgcccacccccatcacccagcaggccagcctgaccagcctggcccagggcaccggcaccaccagcgccatcaccttccctgaggagcaggaggacccccgcatcacccggggccaggatgaggccagcgctgggggcatctggggcttcatcaagggcgtggccggcaaccccatggtgaagtctgtgctggacaagaccaagcacagcgtggagagcatgatcaccaccctggaccccggcatggccccctacatcaagagcggcggggagctggacatcgtggtgaccagcaacaaggaggtgaaggtggccgctgtgagagatgccttccaggaggtgtttggcctggccgtggtggtgggggaggccggccagagcaacatcgccccccagcctgtgggctatgctgctggcctgaagggggcccaggagagaattgacagcctgcggaggactggagtcatccacgagaagcagacagctgtgtctgtggagaacttcatcgccgagctgctgcctgacaagtggtttgacatcggctgcctggtggtggaggaccctgtgcacggcatccacctggagaccttcacccaggccacccctgtgcccctggagtttgtgcagcaggcccagagcctgaccccccaggactacaacctgcgctggagcggcctgctggtgacagtgggggaggtgctggagaagagcctgctgaatgtgtccaggacagactggcacatggccttcaccggcatgagccggcggcagatgatctacagcgctgcccgggccatcgccaacccccagagagctgtggccgtgcacggcctggtggaggccaggaacttccctgcccctggggacctggtgtccctgctgctgggcaccgtgtag

SEQ ID NO: 37065 - DNA, 936 bp, Artificial Sequence
  Description of Artificial Sequence: Synthetic coding sequence
atgatggaggagagcggcatcgagaccaccccacctggcaccccaccacccaacccagctggcctggccgccacagccatgagcagcacccctgtgcccctggccgccaccagcagcttcagcagccccaacgtgtcctccatggagagcttcccccccctggcctacagcaccccccagccccccctgccccctgtgcggcccagcgcccccctgccctttgtgcccccacctgctgtgcccagcgtgccccccctggtgacctccatgcctcctcctgtgagccccagcacagctgctgccttcggcaacccccctgtgagccacttcccccccagcaccagcgcccccaacaccctgctgcctgccccacccagcggcccccccatcagcggcttctctgtgggcagcacctatgacatcacccggggccacgccggccgggccccccagacccccctgatgcccagcttcagcgcccccagcggcaccggcctgctgcccacccccatcacccagcaggccagcctgaccagcctggcccagggcaccggcaccaccagcgccatcaccttccctgaggagcaggaggacccccgcatcacccggggccaggatgaggccagcgctgggggcatctggggcttcatcaagggcgtggccggcaaccccatggtgaagtctgtgctggacaagaccaagcacagcgtggagagcatgatcaccaccctggaccccggcatggccccctacatcaagagcggcggggagctggacatcgtggtgaccagcaacaaggaggtgaaggtggccgctgtgagagatgccttccaggaggtgtttggcctggccgtggtggtgggggaggccggccagagcaacatcgccccccagcctgtgggctatgctgctggcctgaagggggccaacagatag

SEQ ID NO: 37066 - DNA, 1257 bp, Artificial Sequence
  Description of Artificial Sequence: Synthetic coding sequence
atgatggaggagagcggcatcgagaccaccccacctggcaccccaccacccaacccagctggcctggccgccacagccatgagcagcacccctgtgcccctggccgccaccagcagcttcagcagccccaacgtgtcctccatggagagcttcccccccctggcctacagcaccccccagccccccctgccccctgtgcggcccagcgcccccctgccctttgtgcccccacctgctgtgcccagcgtgccccccctggtgacctccatgcctcctcctgtgagccccagcacagctgctgccttcggcaacccccctgtgagccacttcccccccagcaccagcgcccccaacaccctgctgcctgccccacccagcggcccccccatcagcggcttctctgtgggcagcacctatgacatcacccggggccacgccggccgggccccccagacccccctgatgcccagcttcagcgcccccagcggcaccggcctgctgcccacccccatcacccagcaggccagcctgaccagcctggcccagggcaccggcaccaccagcgccatcaccttccctgaggagcaggaggacccccgcatcacccggggccaggatgaggccagcgctgggggcatctggggcttcatcaagggcgtggccggcaaccccatggtgaagtctgtgctggacaagaccaagcacagcgtggagagcatgatcaccaccctggaccccggcatggccccctacatcaagagcggcggggagctggacatcgtggtgaccagcaacaaggaggtgaaggtggccgctgtgagagatgccttccaggaggtgtttggcctggccgtggtggtgggggaggccggccagagcaacatcgccccccagcctgtgggctatgctgctggcctgaagggggcccaggagagaattgacagcctgcggaggactggagtcatccacgagaagcagacagctgtgtctgtggagaacttcatcgccgagctgctgcctgacaagtggtttgacatcggctgcctggtggtggaggaccctgtgcacggcatccacctggagaccttcacccaggccacccctgtgcccctggagtttgtgcagcaggtgggcttcctgctgtgcttcttcatcatgctgcagaggaacctgcactactgcttccagaacaagaacctgtttggcttctttgtgaggaacatgttcctgatcctcttccagagcttcttcttctag

SEQ ID NO: 37067 - DNA, 1338 bp, Artificial Sequence
  Description of Artificial Sequence: Synthetic coding sequence
atgatggaggagagcggcatcgagaccaccccacctggcaccccaccacccaacccagctggcctggccgccacagccatgagcagcacccctgtgcccctggccgccaccagcagcttcagcagccccaacgtgtcctccatggagagcttcccccccctggcctacagcaccccccagccccccctgccccctgtgcggcccagcgcccccctgccctttgtgcccccacctgctgtgcccagcgtgccccccctggtgacctccatgcctcctcctgtgagccccagcacagctgctgccttcggcaacccccctgtgagccacttcccccccagcaccagcgcccccaacaccctgctgcctgccccacccagcggcccccccatcagcggcttctctgtgggcagcacctatgacatcacccggggccacgccggccgggccccccagacccccctgatgcccagcttcagcgcccccagcggcaccggcctgctgcccacccccatcacccagcaggccagcctgaccagcctggcccagggcaccggcaccaccagcgccatcaccttccctgaggagcaggaggacccccgcatcacccggggccaggatgaggccagcgctgggggcatctggggcttcatcaagggcgtggccggcaaccccatggtgaagtctgtgctggacaagaccaagcacagcgtggagagcatgatcaccaccctggaccccggcatggccccctacatcaagagcggcggggagctggacatcgtggtgaccagcaacaaggaggtgaaggtggccgctgtgagagatgccttccaggaggtgtttggcctggccgtggtggtgggggaggccggccagagcaacatcgccccccagcctgtgggctatgctgctggcctgaagggggcccaggagagaattgacagcctgcggaggactggagtcatccacgagaagcagacagctgtgtctgtggagaacttcatcgccgagctgctgcctgacaagtggtttgacatcggctgcctggtggtggaggaccctgtgcacggcatccacctggagaccttcacccaggccacccctgtgcccctggagtttgtgcagcaggcccagagcctgaccccccaggactacaacctgcgctggagcggcctgctggtgacagtgggggaggtgctggagaagagcctgctgaatgtgtccaggacagactggcacatggccttcaccggcatgagccggcggcagatgatctacagcgctgcccgggccatcgccgagagccccaagagcagcggcagcccctggctgggctag

SEQ ID NO: 37068 - DNA, 1389 bp, Artificial Sequence
  Description of Artificial Sequence: Synthetic coding sequence
atgatggaggagagcggcatcgagaccaccccacctggcaccccaccacccaacccagctggcctggccgccacagccatgagcagcacccctgtgcccctggccgccaccagcagcttcagcagccccaacgtgtcctccatggagagcttcccccccctggcctacagcaccccccagccccccctgccccctgtgcggcccagcgcccccctgccctttgtgcccccacctgctgtgcccagcgtgccccccctggtgacctccatgcctcctcctgtgagccccagcacagctgctgccttcggcaacccccctgtgagccacttcccccccagcaccagcgcccccaacaccctgctgcctgccccacccagcggcccccccatcagcggcttctctgtgggcagcacctatgacatcacccggggccacgccggccgggccccccagacccccctgatgcccagcttcagcgcccccagcggcaccggcctgctgcccacccccatcacccagcaggccagcctgaccagcctggcccagggcaccggcaccaccagcgccatcaccttccctgaggagcaggaggacccccgcatcacccggggccaggatgaggccagcgctgggggcatctggggcttcatcaagggcgtggccggcaaccccatggtgaagtctgtgctggacaagaccaagcacagcgtggagagcatgatcaccaccctggaccccggcatggccccctacatcaagagcggcggggagctggacatcgtggtgaccagcaacaaggaggtgaaggtggccgctgtgagagatgccttccaggaggtgtttggcctggccgtggtggtgggggaggccggccagagcaacatcgccccccagcctgtgggctatgctgctggcctgaagggggcccaggagagaattgacagcctgcggaggactggagtcatccacgagaagcagacagctgtgtctgtggagaacttcatcgccgagctgctgcctgacaagtggtttgacatcggctgcctggtggtggaggaccctgtgcacggcatccacctggagaccttcacccaggccacccctgtgcccctggagtttgtgcagcaggcccagagcctgaccccccaggactacaacctgcgctggagcggcctgctggtgacagtgggggaggtgctggagaagagcctgctgaatgtgtccaggacagactggcacatggccttcaccggcatgagccggcggcagatgatctacagcgctgcccgggccatcgcagatgactacttcccccgcatccccaaggagcagtggcagagcatggcctggctgaagctggagatcttcctgcccctggtgacctggtag

SEQ ID NO: 37069 - DNA, 3795 bp, Artificial Sequence
  Description of Artificial Sequence: Synthetic coding sequence
atgagcaccctgtatgtgagcccccacccagatgccttccccagcctgcgggccctgattgctgcccgctacggggaggccggggagggccctggctggggcggggcccacccccgcatctgcctgcagcccccacccaccagcaggacccccttccccccaccccggctgcctgccctggagcagggccctgggggcctgtgggtgtggggcgccacagctgtggcccagctgctgtggccagctggcctgggcggccctgggggcagcagagctgctgtgctggtgcagcagtgggtgtcctatgctgacacagagctgatcccagctgcctgtggggccaccctgcctgccctgggcctgcggagcagcgcccaggacccccaggccgtgctgggcgccctgggccgggccctgagccccctggaggagtggctgcggctgcacacctacctggccggggaggcccccaccctggccgacctggccgctgtgacagccctgctgctgcccttccgctacgtgctggaccccccagcccggcgcatctggaacaacgtgacccgctggtttgtgacctgtgtgcggcagcctgagttccgggctgtgctgggggaggtggtgctgtacagcggggcccggcccctgagccaccagcccggccctgaggccccagccctgcccaagacagctgcccagctgaagaaggaggccaagaagcgggagaagctggagaagttccagcagaagcagaagatccagcagcagcagcccccacctggagagaagaagcccaagccagagaagcgggagaagagggaccccggggtcatcacctatgacctgcccaccccacctggagagaagaaggatgtgtctggccccatgccagacagctacagcccccgctacgtggaggccgcctggtacccctggtgggagcagcagggcttcttcaagccagaatatggccggcccaacgtgtctgctgccaacccccggggcgtcttcatgatgtgcatccccccaccaaatgtgacaggcagcctgcacctgggccacgccctgaccaatgccatccaggacagcctgacccgctggcacaggatgagaggagagaccaccctgtggaaccctggctgtgaccacgccggcatcgccacccaggtggtggtggagaagaagctgtggagggagcagggcctgagccgccaccagctgggccgggaggccttcctgcaggaggtgtggaagtggaaggaggagaagggggaccgcatctaccaccagctgaagaagctgggcagcagcctggactgggaccgggcctgcttcaccatggaccccaagctgtctgctgctgtgacagaggcctttgtgcggctgcacgaggagggcatcatctaccgcagcacccggctggtgaactggagctgcaccctgaacagcgccatcagtgacatcgaggtggacaagaaggagctgaccggccgcaccctgctgtctgtgcccggctacaaggagaaggtggagtttggagtgctggtgtcctttgcctacaaggtgcagggcagtgacagtgatgaggaggtggtggtggccaccacccgcatcgagaccatgctgggagatgtggccgtggccgtgcaccccaaggacacccgctaccagcacctgaagggcaagaatgtcatccaccccttcctgagccgcagcctgcccatcgtgtttgatgaatttgtggacatggactttggaactggagctgtgaagatcaccccagcccatgaccagaatgactatgaggtgggccagagacatggcctggaggccatcagcatcatggacagcagaggagccctgatcaacgtgcccccacccttcctgggcctgcccaggtttgaggccaggaaggctgtgctggtggccctgaaggagcggggcctcttccggggcatcgaggacaaccccatggtggtgcccctgtgcaacagaagcaaggatgtggtggagcccctgctgcggccccagtggtacgtgcgctgtggggagatggcccaggccgccagcgctgctgtgaccaggggggacctgcgcatcctgcctgaggcccaccagaggacctggcacgcctggatggacaacatccgggagtggtgcatcagccggcagctgtggtggggccaccgcatcccagcctactttgtgacagtgtctgaccctgctgtgcccccaggagaagatcctgatggccgctactgggtgtctggaagaaatgaagctgaggcccgggagaaggccgccaaggagtttggagtgtccccagacaagatcagcctgcagcaggatgaagatgtgctggacacctggttcagcagcggcctcttccccctgagcatcctgggctggcccaaccagagcgaggacctgtctgtgttctacccaggcaccctgctggagactggacatgacatcctcttcttctgggtggccaggatggtgatgctgggcctgaagctgaccggccgcctgcccttccgggaggtgtacctgcacgccatcgtgagagatgcccacggcaggaagatgagcaagagcctgggcaatgtgattgaccccctggatgtgatctacggcatcagcctgcagggcctgcacaaccagctgctgaacagcaacctggaccccagcgaggtggagaaggccaaggagggccagaaggctgacttccctgctggcatcccagaatgtggcacagatgccctgcgcttcggcctgtgtgcctacatgagccagggccgggacatcaacctggatgtgaaccgcatcctgggctaccgccacttctgcaacaagctgtggaatgccaccaagtttgccctgcggggcctgggcaagggctttgtgcccagccccaccagccagcccggcggccacgagagcctggtggaccgctggatccgcagccggctgacagaggccgtgcggctgagcaaccagggcttccaggcctatgacttccctgctgtgaccacagcccagtacagcttctggctgtatgagctgtgtgatgtgtacctggagtgcctgaagcctgtgctgaatggagtggaccaggtggccgcagaatgtgcccggcagaccctgtacacctgcctggatgtgggcctgcggctgctgagccccttcatgccctttgtgacagaggagctgttccagaggctgcccaggaggatgccccaggccccacccagcctgtgtgtgaccccctacccagagcccagcgagtgctcctggaaggaccctgaggccgaggccgccctggagctggccctgagcatcaccagggctgtgcgcagcctgcgggctgactacaacctgacccgcatccggccagactgcttcctggaggtggctgatgaggccactggagccctggccagcgctgtgtctggctacgtgcaggccctggccagcgctggggtggtggccgtgctggccctgggcgccccagccccccagggctgtgctgtggccctggccagtgaccgctgcagcatccacctgcagctgcagggcctggtggaccctgcccgggagctgggcaagctgcaggccaagagggtggaggcccagaggcaggcccagaggctgcgggagaggagagctgccagcggctaccctgtgaaggtgcccctggaggtgcaggaggctgatgaggccaagctgcagcagacagaggccgagctgaggaaggtggatgaggccatcgccctcttccagaagatgctgtag

SEQ ID NO: 37070 - DNA, 678 bp, Artificial Sequence
  Description of Artificial Sequence: Synthetic coding sequence
atgcctggcacccagaccccagccccagctgaggacccccacagcggctgccgggaccctgtgcctgcccggccccaggcctgccaccccaagagccaggagaccaggtttgagggccccctgcccccacctcctcctgctgctgctgcccctcctcctccagccccagcccagacagcccaggcccctggctttgtggtgcccacccatgctggcaccgtgggcaccctgcccctgggcggctacgtggcccctggctaccccctgcagctgcagccctgcacagcctacgtgcctgtgtaccctgtgggcaccccctatgctgggggcacccctgggggcactggagtgaccagcaccctgcccccaccaccccagggccctggcctggccctgctggagccccggcggccccctcatgactacatgcccatcgctgtgctgaccaccatctgctgcttctggcccaccggcatcatcgccatcttcaaggctgtgcaggtgaggacagccctggcccggggggacatggtgtctgctgagatcgccagccgggaggccaggaacttctccttcatcagcctggccgtgggcattgctgccatggtgctgtgcaccatcctgactgtggtgatcatcatcgccgcccagcaccacgagaactactgggacccctag

SEQ ID NO: 37071 - DNA, 678 bp, Artificial Sequence; identical to SEQ ID NO: 37070
  Description of Artificial Sequence: Synthetic coding sequence

SEQ ID NO: 37072 - DNA, 678 bp, Artificial Sequence; identical to SEQ ID NO: 37070
  Description of Artificial Sequence: Synthetic coding sequence

SEQ ID NO: 37073 - DNA, 921 bp, Artificial Sequence
  Description of Artificial Sequence: Synthetic coding sequence
atgagcagcgagaagagcggcctgcctgattctgtgccccacaccagccccccaccctacaatgccccccagcccccagctgagcccccagcccccccaccccaggccgcccccagcagccaccaccaccaccaccaccactaccaccagagcggcacagccaccctgccccggctgggcgccggcggcctggccagcagcgctgccacagcccagaggggccccagcagcagcgccaccctgccccggcccccccaccacgcccctcctggccctgctgctggggcccctcctcctggctgtgccaccctgcccaggatgcccccagacccctacctgcaggagaccaggtttgagggccccctgcccccacctcctcctgctgctgctgcccctcctcctccagccccagcccagacagcccaggcccctggctttgtggtgcccacccacgccggcaccgtgggcaccctgcccctgggcggctacgtggcccctggctaccccctgcagctgcagccctgcacagcctacgtgcctgtgtaccctgtgggcaccccctatgccggcggcaccccaggcggcaccggggtgaccagcaccctgcccccaccaccccagggccctggcctggccctgctggagcccaggaggcctcctcatgactacatgcccatcgctgtgctgaccaccatctgctgcttctggcccaccggcatcatcgccatcttcaaggctgtgcaggtgaggacagccctggcccggggggacatggtgtctgctgagatcgccagccgggaggccaggaacttctccttcatcagcctggccgtgggcattgctgccatggtgctgtgcaccatcctgactgtggtgatcatcatcgccgcccagcaccacgagaactactgggacccctag

SEQ ID NO: 37074 - DNA, 678 bp, Artificial Sequence; identical to SEQ ID NO: 37070
  Description of Artificial Sequence: Synthetic coding sequence

SEQ ID NO: 37075 - DNA, 921 bp, Artificial Sequence; identical to SEQ ID NO: 37073
  Description of Artificial Sequence: Synthetic coding sequence

SEQ ID NO: 37076 - DNA, 192 bp, Artificial Sequence
  Description of Artificial Sequence: Synthetic coding sequence
atgcctggcacccagaccccagccccagctgaggacccccacagcggctgccgggaccctgtgcctgcccggccccaggcctgccaccccaagagccaggagaccaggtttgagggccccctgcccccacctcctcctgctgctgctgcccctcctcctccagccccagcccagacagcccaggccccctag

SEQ ID NO: 37077 - DNA, 192 bp, Artificial Sequence; identical to SEQ ID NO: 37076
  Description of Artificial Sequence: Synthetic coding sequence

SEQ ID NO: 37078 - DNA, 678 bp, Artificial Sequence; identical to SEQ ID NO: 37070
  Description of Artificial Sequence: Synthetic coding sequence

SEQ ID NO: 37079 - DNA, 192 bp, Artificial Sequence; identical to SEQ ID NO: 37076
  Description of Artificial Sequence: Synthetic coding sequence

SEQ ID NO: 37080 - DNA, 678 bp, Artificial Sequence; identical to SEQ ID NO: 37070
  Description of Artificial Sequence: Synthetic coding sequence

SEQ ID NO: 37081 - DNA, 192 bp, Artificial Sequence; identical to SEQ ID NO: 37076
  Description of Artificial Sequence: Synthetic coding sequence

SEQ ID NO: 37082 - DNA, 192 bp, Artificial Sequence; identical to SEQ ID NO: 37076
  Description of Artificial Sequence: Synthetic coding sequence

SEQ ID NO: 37083 - DNA, 192 bp, Artificial Sequence; identical to SEQ ID NO: 37076
  Description of Artificial Sequence: Synthetic coding sequence

SEQ ID NO: 37084 - DNA, 678 bp, Artificial Sequence; identical to SEQ ID NO: 37070
  Description of Artificial Sequence: Synthetic coding sequence

SEQ ID NO: 37085 - DNA, 192 bp, Artificial Sequence; identical to SEQ ID NO: 37076
  Description of Artificial Sequence: Synthetic coding sequence

SEQ ID NO: 37086 - DNA, 921 bp, Artificial Sequence; identical to SEQ ID NO: 37073
  Description of Artificial Sequence: Synthetic coding sequence

SEQ ID NO: 37087 - DNA, 678 bp, Artificial Sequence; identical to SEQ ID NO: 37070
  Description of Artificial Sequence: Synthetic coding sequence

SEQ ID NO: 37088 - DNA, 921 bp, Artificial Sequence; identical to SEQ ID NO: 37073
  Description of Artificial Sequence: Synthetic coding sequence

SEQ ID NO: 37089 - DNA, 678 bp, Artificial Sequence; identical to SEQ ID NO: 37070
  Description of Artificial Sequence: Synthetic coding sequence

SEQ ID NO: 37090 - DNA, 921 bp, Artificial Sequence; identical to SEQ ID NO: 37073
  Description of Artificial Sequence: Synthetic coding sequence

SEQ ID NO: 37091 - DNA, 921 bp, Artificial Sequence; identical to SEQ ID NO: 37073
  Description of Artificial Sequence: Synthetic coding sequence

SEQ ID NO: 37092 - DNA, 192 bp, Artificial Sequence; identical to SEQ ID NO: 37076
  Description of Artificial Sequence: Synthetic coding sequence

SEQ ID NO: 37093 - DNA, 921 bp, Artificial Sequence; identical to SEQ ID NO: 37073
  Description of Artificial Sequence: Synthetic coding sequence

SEQ ID NO: 37094 - DNA, 678 bp, Artificial Sequence; identical to SEQ ID NO: 37070
  Description of Artificial Sequence: Synthetic coding sequence

SEQ ID NO: 37095 - DNA, 678 bp, Artificial Sequence; identical to SEQ ID NO: 37070
  Description of Artificial Sequence: Synthetic coding sequence

SEQ ID NO: 37096 - DNA, 678 bp, Artificial Sequence; identical to SEQ ID NO: 37070
  Description of Artificial Sequence: Synthetic coding sequence

SEQ ID NO: 37097 - DNA, 678 bp, Artificial Sequence; identical to SEQ ID NO: 37070
  Description of Artificial Sequence: Synthetic coding sequence

SEQ ID NO: 37098 - DNA, 678 bp, Artificial Sequence; identical to SEQ ID NO: 37070
  Description of Artificial Sequence: Synthetic coding sequence

SEQ ID NO: 37099 - DNA, 678 bp, Artificial Sequence; identical to SEQ ID NO: 37070
  Description of Artificial Sequence: Synthetic coding sequence

SEQ ID NO: 37100 - DNA, 678 bp, Artificial Sequence; identical to SEQ ID NO: 37070
  Description of Artificial Sequence: Synthetic coding sequence

SEQ ID NO: 37101 - DNA, 2946 bp, Artificial Sequence
  Description of Artificial Sequence: Synthetic coding sequence
atggccagcagcccctggggctgtgtgtgtggcctgctgctgctgctgctgcccctgctgggcaccggccctgccctgggccggggcttcccccggcccctggagaacagcgagatccccatgatccctggggcccaccccaagggctctgtgggcagcgagccccaggcctttgatgtgtttcctgagaaccccagggctgacagccacaggaacagtgatgtgagacatgccccagctgaggagatgcctgagaagcctgtggccagccccctgggccctgccctgtatggccccaaggccgcccagggcgcccagcgggagcggctgcctgtgacagatgacctgcagatggcccagggccccagcagccacggctggacaggccccctggacagccaggagctgctgcagcaggaggccgtggccccccaccctgtgggccacccccacctgaccttcatccccaccaccccccggcggcagctgcgggtggccaccgtgccccccagcctgcagcacgagggccaggagggccagtggcccccaagagatgagggcctgaaggccaagaccaagagccgggtgccccccaccagccccagcgaccaccagggccccccccacaccctggtgagccacagcggcaccgtgaagaggcctgtgctggagggccagggcggctttgaggagcacctgcaggaggccgcccagggcccccacttcacccagcaggaccctgctgccccagatgtgggctctgtgccccctgtggaggtggtgtacagccaggagcccggggcccagcctgacctggccctggcccggagcctgcccccagctgaggagctgcctgtggagacccccaagagagctggagctgaggtgtcctgggaggtgagcagccctggccccccacccaagcaggccgacctgcctgatgccaaggacagccctggcccccagcccacagaccccccagccagcgaggccccagaccggcccagcaagccagagagagctgccatgaatggagctgaccccatcagcccccagagggtgagaggagctgtggaggcccctggcacccccaagagcctcatccctggccccagcgaccccggccctgctgtgaacagaacagagagccccatgggcgccctgcagccagatgaagctgaggagtggccaggccggccccagagccaccccccagcccctcctgtgcaggcccccagcaccagccggcggggcctcatccgggtgaccacccagagggccctgggccagcccccacctcctgagcccacagccagctccatggccagcgccccagccagcagccccccagccaatgccacagccccacccctgcgctggggccccctgcggcgggtgctgtccttctcctgggagctgcacgtgtatggagtgggcgtgctcttcctgctgcctgccctgctggccctggccgccctggccgccgccccagctggcccccggctggccctggtggccgctgtgctggtgctggtggccagcgccctgcggagcgcctacatgctgacagacccctacggcagccaggcccggctgggcgtgcggggcggcctggtgctgtacaacctgcccttccccctgctgctgacagccctggccgccctgaccctgctgggcctgggcgccggcctgcccccacccctgcagaaccccctgctgctgggcgctgtggccctggtgcatggagtgggcctgctggccacagacctgctgagcacctggagcgtgctgaacctgctgacccagggcctgagctgtgcctggggcgctgctgtggccctgggcaccctgtgcctgtgcagaagaaggctgctggatggcccccggggctgggatgccagccctggcccccggctgctggccgtggccggggccctgggcctgctggccagcggcctgcagctggccgccgccctgtggctgtacccaggccctggccgggtgggccgcttctcctgggcctggtggggcgtgcacttctggctgcggctgctggagctgacctgggccctggccctggccctggccgctgtggccgccgcccggcccaggcctcccacagaacatgcctgctgggccaagctgatgaggctggcctgcccagcccccagcggcaagtctgaggtgcctgagcggcccaacaactgctacgccggccccagcaatgtgggcgccggcagcctggacatcagcaagagcctcatccggaacccagctgagagcggccagctggccacccccagcagcggggcctggggcagcgctgccagcctgggccggggcccccagggcggccctggcctgagcagaaatggagtgggccctgcccccagcctgtctgagctggacctgcggccccccagccccatcaacctgagccgcagcattgatgctgccctcttccgggagcacctggtgcgggacagcgtcttccagagatgtggcctgcggggcctggccagccccccacctgggggcgccctgcggccccggcggggcagccaccccaaggccgagctggatgatgctggcagcagcctgctgcggggccgctgccgcagcctgagtgatgtgcgggtgcggggccctgtgccccagcacgtggtggaggccccagatggagctgctgctgctgccagcggcagcagcctggacagcttcagccggggcagcctgaagatctcctggaacccctggaggcatggcctgagctctgtggacagcctgcccctggatgagctgcccagcacagtgcagctgctgcctgcccccaccccagccccagacagcacagctgcccggcagggagatggccagggcgaggtgcagccccggggcaagccaggagagagccgcagcgccagcagtgacaccatcgagctgtag

SEQ ID NO: 37102 - DNA, 2946 bp, Artificial Sequence; identical to SEQ ID NO: 37101
  Description of Artificial Sequence: Synthetic coding sequence

SEQ ID NO: 37103 - DNA, 2082 bp, Artificial Sequence
  Description of Artificial Sequence: Synthetic coding sequence
atggcccggcacggctgcctgggcctgggcctcttctgctgcgtgctgtttgctgccaccgtgggcccccagcccacccccagcatccctggggccccagccaccaccctgacccctgtgccccagagcgaggcctccatgctgagcctgaacctgggcctgaacttcaagttccacctgcggggccctgctgctgtgtggggcagccctgtgacagagacccagcccctgagcctgggccctggccaggagcctggagaggaggtggccagcggcctgaggacagaccccctgtgggagctgctggtgggcagcagcggcaacagcctgacagagtggggcagcacagagggcggcagcaagccccgggccagcagcctgctgcctgagagcaccagccgccgcagcggccccagtgatggccccacagccccctaccagcccaggaggagcacagtgacctgggacacagccctgatggtgacagccctgcccagcagcgccccccggccccaccagagcgagctggagctgaagtttgacatggccctgcgggccggggccgcccccaccctgggccacaggaccctgcccctgctgcccagcctgcgggccagcctggccgagattgctggccgcctgggccccttcggcttcttcggcaccaccctgagccccctgaggaacttcagcggcctgagccccccaggagagaccaccagcaccagcagcgccagcggcgtgtctggcagcctgggcttcctgggcaccaccctgagcctgcccccctacagcctggagaggaagctgagcagccccagccccctggaccctgctgccagcctgagctttgccagcatcgccaccaccagcctggaccccaccgtgcccatcagcggcccagatgacctgagccccccagccagcctgggcaaccccagcggccagccagaatgtggccctggcagctgcagcgtgggggagctgcctgagcgggagggccagcccccagaggccccccggcccctcttcttcctgaccctggaggccgactgggccgaggcccgggcccgctggggcctggcctgggaggcccacgtgtatggaggctatgaggtgctgcacgccctgggctatggaggccagagcggcctggagggcccctggccctggtgggccttccagctgggcctgcggctgggggaggtgggcgtggccctgcccctggccctgctgggcctgtacccagccctgtgcagcccccgggtgcccccacgctgctgggccaagctgttccggctgagccctggccatgctgcccccctgctgcccggcggctgggtgactggacctccagacaaggagcccctgggcagcgccatcgcccggggagatgctgagctgctgcagctgtgtgccctggccggccctggccctgacctgctgctgcagggcggcggctgccggggctttgaaggagctgctgccaacccagcccccagccctgccagcagcccctgcagcgactacacagtggacttccggccccccagccccatcaacctgcggcgcagcattgaggaggccctgtgcagcgaggccctgctggcccctggcctcttccagggccctgcctttgaagatgccctgcccggcctgggcctgtacagaacagccagcctgggcactggaggccgggccagcgagaggtctggagaggccagcggccctgctgcccctcctgagctgcccagccctggggcctggccagctggcagctctgtgagcagcggcagcttctgtggcctgagccgggacagcagctccatgctgctgtgcagcagcccagacaggcctccccgctgccccctggtgtgtgtgctgagccccccccggcccagcggcagcagccccagcctgcctgccagcggcagctaccaggccctgagcccccccagccgggacagccctgagcccgccagcgagctgcaggccgaggaggccctgctgcaggagcagttcctggatgcctgccggcagattgatgagctgtctgtgggcagtgacaccatcgacctgtag

SEQ ID NO: 37104 - DNA, 2700 bp, Artificial Sequence
  Description of Artificial Sequence: Synthetic coding sequence
atggcccggcacggctgcctgggcctgggcctcttctgctgcgtgctgtttgctgccaccgtgggcccccagcccacccccagcatccctggggccccagccaccaccctgacccctgtgccccagagcgaggcctccatgctgagcctgaacctgggcctgaacttcaagttccacctgcggggccctgctgctgtgtggggcagccctgtgacagagacccagcccctgagcctgggccctggccaggagcctggagaggaggtggccagcggcctgaggacagaccccctgtgggagctgctggtgggcagcagcggcaacagcctgacagagtggggcagcacagagggcggcagcaagccccgggccagcagcctgctgcctgagagcaccagccgccgcagcggccccagtgatggccccacagccccctaccagcccaggaggagcacagtgacctgggacacagccctgatggtgacagccctgcccagcagcgccccccggccccaccagagcgagctggagctgaagtttgacatggccctgcgggccggggccgcccccaccctgggccacaggaccctgcccctgctgcccagcctgcgggccagcctggccgagattgctggccgcctgggccccttcggcttcttcggcaccaccctgagccccctgaggaacttcagcggcctgagccccccaggagagaccaccagcaccagcagcgccagcggcgtgtctggcagcctgggcttcctgggcaccaccctgagcctgcccccctacagcctggagaggaagctgagcagccccagccccctggaccctgctgccagcctgagctttgccagcatcgccaccaccagcctggaccccaccgtgcccatcagcggcccagatgacctgagccccccagccagcctgggcaaccccagcggccagccagaatgtggccctggcagctgcagcgtgggggagctgcctgagcgggagggccagcccccagaggccccccggcccctcttcttcctgaccctggaggccgactgggccgaggcccgggcccgctggggcctggcctgggaggcccacgtgtatggagtgggcgccctgtttggcctggtggccctgctggccctgctggccctggccctgctgccctggcgctgccccccaggggccccctgcctggccctgctggacctgctgctgctgtctgctggcaccacccgggccttccccctcttctatgatgcctacggccaccgggaccggctgcctgccctggcctggctgctgctgcaggacctgcccctgccctgcctggccgccggcctgggcctggcctgcctgctgctggcccggccccggcccccacgctgccccaccggcctggccgccctgctgctgctgggcctgggcctggccgctgctgctgccctgggcagcgctgcccaccggcccctgcggcccctgcggctggccagccggggcctgcacgccttcctggccgccttcctgagcggcctgctgctggccctgagctgctggggcggcagaagaagaagagctggggcccccctgggcggcagcggcttcaagggggccacccccctgccccagggccgcagcccctttgccccccgggagagctggaggagagctgccaggacagcccctgtggccggcaccttcggcctgctgagcggggccctgcagggctatgaggtgctgcacgccctgggctatggaggccagagcggcctggagggcccctggccctggtgggccttccagctgggcctgcggctgggggaggtgggcgtggccctgcccctggccctgctgggcctgtacccagccctgtgcagcccccgggtgcccccacgctgctgggccaagctgttccggctgagccctggccatgctgcccccctgctgcccggcggctgggtgactggacctccagacaaggagcccctgggcagcgccatcgcccggggagatgctgagctgctgcagctgtgtgccctggccggccctggccctgacctgctgctgcagggcggcggctgccggggctttgaaggagctgctgccaacccagcccccagccctgccagcagcccctgcagcgactacacagtggacttccggccccccagccccatcaacctgcggcgcagcattgaggaggccctgtgcagcgaggccctgctggcccctggcctcttccagggccctgcctttgaagatgccctgcccggcctgggcctgtacagaacagccagcctgggcactggaggccgggccagcgagaggtctggagaggccagcggccctgctgcccctcctgagctgcccagccctggggcctggccagctggcagctctgtgagcagcggcagcttctgtggcctgagccgggacagcagctccatgctgctgtgcagcagcccagacaggcctccccgctgccccctggtgtgtgtgctgagccccccccggcccagcggcagcagccccagcctgcctgccagcggcagctaccaggccctgagcccccccagccgggacagccctgagcccgccagcgagctgcaggccgaggaggccctgctgcaggagcagttcctggatgcctgccggcagattgatgagctgtctgtgggcagtgacaccatcgacctgtag

SEQ ID NO: 37105 - DNA, 2700 bp, Artificial Sequence; identical to SEQ ID NO: 37104
  Description of Artificial Sequence: Synthetic coding sequence

SEQ ID NO: 37106 - DNA, 1290 bp, Artificial Sequence
  Description of Artificial Sequence: Synthetic coding sequence
atggcccggcacggctgcctgggcctgggcctcttctgctgcgtgctgtttgctgccaccgtgggcccccagcccacccccagcatccctggggccccagccaccaccctgacccctgtgccccagagcgaggcctccatgctgagcctgaacctgggcctgaacttcaagttccacctgcggggccctgctgctgtgtggggcagccctgtgacagagacccagcccctgagcctgggccctggccaggagcctggagaggaggtggccagcggcctgaggacagaccccctgtgggagctgctggtgggcagcagcggcaacagcctgacagagtggggcagcacagagggcggcagcaagccccgggccagcagcctgctgcctgagagcaccagccgccgcagcggccccagtgatggccccacagccccctaccagcccaggaggagcacagtgacctgggacacagccctgatggtgacagccctgcccagcagcgccccccggccccaccagagcgagctggagctgaagtttgacatggccctgcgggccggggccgcccccaccctgggccacaggaccctgcccctgctgcccagcctgcgggccagcctggccgagattgctggccgcctgggccccttcggcttcttcggcaccaccctgagccccctgaggaacttcagcggcctgagccccccaggagagaccaccagcaccagcagcgccagcggcgtgtctggcagcctgggcttcctgggcaccaccctgagcctgcccccctacagcctggagaggaagctgagcagccccagccccctggaccctgctgccagcctgagctttgccagcatcgccaccaccagcctggaccccaccgtgcccatcagcggcccagatgacctgagccccccagccagcctgggcaaccccagcggccagccagaatgtggccctggcagctgcagcgtgggggagctgcctgagcgggagggccagcccccagaggccccccggcccctcttcttcctgaccctggaggccgactgggccgaggcccgggcccgctggggcctggcctgggaggcccacgtgtatggccgcctgcaccggggcctgcccccagccctgcccaaccagcctgccacccagcacagaggaggccccctgcagaggggccctgcctgtgcctggcccctgcccggcccctgcctgcggggccgcagcgcctgggcccggaccctgccccaccggctggccggggaccggggccagggccagtag

SEQ ID NO: 37107 - DNA, 1692 bp, Artificial Sequence
  Description of Artificial Sequence: Synthetic coding sequence
atggctgctgctgctgtgacaggccagaggcctgagacagctgctgctgaggaggccagccggccccagtgggcccccccagaccactgccaggcccaggccgccgccggcctgggagatggagaagatgcccctgtgcggcccctgtgcaagccccggggcatctgcagccgggcctacttcctggtgctgatggtgtttgtgcacctgtacctgggcaatgtgctggccctgctgctgtttgtgcactacagcaatggagatgagagcagtgaccccggcccccagcaccgggcccagggccctggccctgagcccaccctgggccccctgacccggctggagggcatcaaggtgggccacgagaggaaggtgcagctggtgacagaccgggaccacttcatccgcaccctgagcctgaagcccctgctgtttgagatccctggcttcctgacagatgaagaatgtcgcctcatcatccacctggcccagatgaagggcctgcagaggagccagatcctgcccacagaggagtatgaggaggccatgagcaccatgcaggtgtcccagctggacctcttccggctgctggaccagaacagagatggccacctgcagctgcgggaggtgctggcccagacccggctgggcaatggctggtggatgaccccagagagcatccaggagatgtatgctgccatcaaggctgaccctgatggagatggagtgctgagcctgcaggagttcagcaacatggacctgcgggacttccacaagtacatgaggagccacaaggccgagagcagcgagctggtgaggaacagccaccacacctggctgtaccagggcgagggcgcccaccacatcatgagggccatccggcagagggtgctgcggctgacccggctgagccctgagatcgtggagctgtctgagcccctgcaggtggtgcgctatggagagggcggccactaccacgcccacgtggacagcggccctgtgtacccagagaccatctgcagccacaccaagctggtggccaatgaatctgtgccctttgagaccagctgccggcaggtgagccccaactggggcctgcccagcatcctgcggcccggcacccccatgacccaggcccagccctgcaccgtgggcgtgcccctgggcatgggccctggggaccactgggtgattcctgtgagcccctgggagcacccccagctgggcacctgcagcgtgccccccctgccctacagctacatgacagtgctcttctacctgaacaacgtgactggaggaggagagaccgtcttccctgtggccgacaacagaacctatgatgagatgagcctcatccaggatgatgtggacctgcgggacacccggcggcactgtgacaagggcaacctgcgggtgaagccccagcagggcacagctgtgttctggtacaactacctgcctgatggccagggctgggtgggagatgtggatgactacagcctgcacggcggctgcctggtgacccggggcaccaagtggatcgccaacaactggatcaacgtggaccccagccgggcccggcaggccctcttccagcaggagatggcccggctggcccgggagggcggcacagacagccagcctgagtgggccctggaccgggcctacagagatgcccgggtggagctgtag

SEQ ID NO: 37108 - DNA, 1509 bp, Artificial Sequence
  Description of Artificial Sequence: Synthetic coding sequence
atggctgctgctgctgtgacaggccagaggcctgagacagctgctgctgaggaggccagccggccccagtgggcccccccagaccactgccaggcccaggccgccgccggcctgggagatggagaagatgcccctgtgcggcccctgtgcaagccccggggcatctgcagccgggcctacttcctggtgctgatggtgtttgtgcacctgtacctgggcaatgtgctggccctgctgctgtttgtgcactacagcaatggagatgagagcagtgaccccggcccccagcaccgggcccagggccctggccctgagcccaccctgggccccctgacccggctggagggcatcaaggtgggccacgagaggaaggtgcagctggtgacagaccgggaccacttcatccgcaccctgagcctgaagcccctgctgtttgagatccctggcttcctgacagatgaagaatgtcgcctcatcatccacctggcccagatgaagggcctgcagaggagccagatcctgcccacagaggagtatgaggaggccatgagcaccatgcaggtgtcccagctggacctcttccggctgctggaccagaacagagatggccacctgcagctgcgggaggtgctggcccagacccggctgggcaatggctggtggatgaccccagagagcatccaggagatgtatgctgccatcaaggctgaccctgatggagatggagtgctgagcctgcaggagttcagcaacatggacctgcgggacttccacaagtacatgaggagccacaaggccgagagcagcgagctggtgaggaacagccaccacacctggctgtaccagggcgagggcgcccaccacatcatgagggccatccggcagagggtgctgcggctgacccggctgagccctgagatcgtggagctgtctgagcccctgcaggtggtgcgctatggagagggcggccactaccacgcccacgtggacagcggccctgtgtacccagagaccatctgcagccacaccaagctggtggccaatgaatctgtgccctttgagaccagctgccgctacatgacagtgctcttctacctgaacaacgtgactggaggaggagaaacagtgtttcctgtggccgacaacagaacctatgatgagatgagcctcatccaggatgatgtggacctgcgggacaccaggaggcactgtgacaagggcaacctgcgggtgaagccccagcagggcacagctgtgttctggtacaactacctgcctgatggccagggctgggtgggagatgtggatgactacagcctgcatggaggctgcctggtgacccggggcaccaagtggatcgccaacaactggatcaacgtggaccccagccgggcccggcaggccctcttccagcaggagatggcccggctggcccgggagggcggcacagacagccagcctgagtgggccctggaccgggcctacagagatgcccgggtggagctgtag

SEQ ID NO: 37109 - DNA, 2358 bp, Artificial Sequence
  Description of Artificial Sequence: Synthetic coding sequence
atgcccaagggccggcagaaggtgccccacctggatgcccccctgggcctgcccacctgcctgtggctggagctggccggcctcttcctgctggtgccctgggtgatgggcctggccggcactggaggcccagatggccagggcactggaggccccagctgggccgtgcacctggagagcctggagggagatggagaggaggagaccctggagcagcaggctgatgccctggcccaggccgccggcctggtgaatgccggcagaattggagagctgcagggccactacctgtttgtgcagcctgctggccacaggcctgccctggaggtggaggccatccggcagcaggtggaggccgtgctggccggccacgaggccgtgcgctggcacagcgagcagaggctgctgcggcgggccaagaggtctgtgcacttcaatgaccccaagtacccccagcagtggcacctgaacaacagaagaagccctggccgggacatcaacgtgactggagtgtgggagagaaatgtgacaggccggggcgtgacagtggtggtggtggatgatggagtggagcacaccatccaggacatcgcccccaactacagccctgagggcagctatgacctgaacagcaatgaccctgaccccatgccccacccagatgtggagaatggaaaccaccacggcacccgctgtgccggggagattgctgctgtgcccaacaacagcttctgtgctgtgggcgtggcctacggcagcagaattgctggcatccgggtgctggatggccccctgacagacagcatggaggccgtggccttcaacaagcactaccagatcaatgacatctacagctgctcctggggcccagatgatgatggcaagacagtggatggcccccaccagctgggcaaggccgccctgcagcacggcgtgattgctggccggcagggcttcggcagcatctttgtggtggccagcggaaatggaggccagcacaatgacaactgcaactatgatggctacgccaacagcatctacacagtgaccatcggggctgtggatgaggagggccgcatgcccttctacgccgaggagtgtgcctccatgctggccgtgaccttcagcggcggggacaagatgctgcggagcatcgtgaccacagactgggacctgcagaagggcaccggctgcacagagggccacacaggcaccagcgctgctgcccccctggccgccggcatgattgccctgatgctgcaggtgcggccctgcctgacctggagagatgtgcagcacatcatcgtgttcaccgccaccaggtatgaagatagaagagctgagtgggtgaccaatgaggccggcttcagccacagccaccagcacggcttcggcctgctgaatgcctggaggctggtgaatgctgccaagatctggacctctgtgccctacctggccagctatgtgtcccctgtgctgaaggagaacaaggccatcccccagagccccaggagcctggaggtgctgtggaatgtgtccaggatggacctggagatgagcggcctgaagaccctggagcacgtggccgtgacagtgtccatcacccacccccggcggggcagcctggagctgaagctgttctgccccagcggcatgatgagcctcatcggggcccccaggtccatggacagcgaccccaacggcttcaatgactggaccttcagcacagtgcgctgctggggcgagcgggcccggggcacctaccgcctggtgatcagagatgtgggagatgagagcttccaggtgggcatcctgcggcagtggcagctgaccctgtatggctctgtgtggagcgctgtggacatccgggaccggcagaggctgctggagagcgccatgtctgggaagtacctgcatgatgactttgccctgccctgccccccaggcctgaagatcccagaagaagatggctacaccatcacccccaacaccctgaagaccctggtgctggtgggctgcttcaccgtcttctggacagtgtactacatgctggaggtgtacctgagccagagaaatgtggccagcaaccaggtgtgccgcagcggcccctgccactggccccacaggagcaggaaggccaaggaggagggcacagagctggagagcgtgcccctgtgcagcagcaaggaccctgatgaggtggagacagagagccggggcccccccaccaccagtgacctgctggccccagacctgctggagcagggcgactggagcctgagccagaacaagagcgccctggactgcccccaccagcacctggatgtgccccacggcaaggaggagcagatctgctag

SEQ ID NO: 37110 - DNA, 342 bp, Artificial Sequence
  Description of Artificial Sequence: Synthetic coding sequence
atgcccaagggccggcagaaggtgccccacctggatgcccccctgggcctgcccacctgcctgtggctggagctggccggcctcttcctgctggtgccctgggtgatgggcctggccggcactggaggcccagatggccagggcactggaggccccagctgggccgtgcacctggagagcctggagggagatggagaggaggagaccctggagcagcaggctgatgccctggcccaggccgccggcctggtgaatgccggcagaattggagagctgcagggccactacctgtttgtgcagcctgctggccacaggcctgccctggaggtggaggccatctag

SEQ ID NO: 37111 - DNA, 279 bp, Artificial Sequence
  Description of Artificial Sequence: Synthetic coding sequence
atgcccaagggccggcagaaggtgccccacctggatgcccccctgggcctgcccacctgcctgtggctggagctggccggcctcttcctgctggtgccctgggtgatgggcctggccggcactggaggcccagatggccagggcactggaggccccagctgggccgtgcacctggagagcctggagggagatggagaggaggagaccctggagcagcaggctgatgccctggcccaggccgccggcctggtgaatgccggcagaattggagagctgtag

SEQ ID NO: 37112 - DNA, 279 bp, Artificial Sequence; identical to SEQ ID NO: 37111
  Description of Artificial Sequence: Synthetic coding sequence

SEQ ID NO: 37113 - DNA, 714 bp, Artificial Sequence
  Description of Artificial Sequence: Synthetic coding sequence
atgcccttctatgcagaagaatgtgcctccatgctggccgtgaccttctctggaggagacaagatgctgcggagcatcgtgaccacagactgggacctgcagaagggcaccggctgcacagagggccacacaggcaccagcgctgctgcccccctggccgccggcatgattgccctgatgctgcaggtgcggccctgcctgacctggagagatgtgcagcacatcatcgtgttcaccgccaccaggtatgaggaccggcgggcagagtgggtgaccaatgaagctggcttcagccacagccaccagcacggcttcggcctgctgaatgcctggaggctggtgaatgctgccaagatctggacctctgtgccctacctggccagctatgtgtcccctgtgctgaaggagaacaaggccatcccccagagccccaggagcctggaggtgctgtggaatgtgtccaggatggacctggagatgagcggcctgaagaccctggagcacgtggccgtgacagtgtccatcacccacccccggcggggcagcctggagctgaagctgttctgccccagcggcatgatgagcctgattggagcccccaggtccatggacagcgaccccaacggcttcaatgactggaccttcagcacagtgcgctgctggggcgagcgggcccggggcacctaccgcctggtgatcagagatgtgggctag

SEQ ID NO: 37114 - DNA, 1776 bp, Artificial Sequence
  Description of Artificial Sequence: Synthetic coding sequence
atgcccaagggccggcagaaggtgccccacctggatgcccccctgggcctgcccacctgcctgtggctggagctggccggcctcttcctgctggtgccctgggtgatgggcctggccggcactggaggcccagatggccagggcactggaggccccagctgggccgtgcacctggagagcctggagggagatggagaggaggagaccctggagcagcaggctgatgccctggcccaggccgccggcctggtgaatgccggcagaattggagagctgcagggccactacctgtttgtgcagcctgctggccacaggcctgccctggaggtggaggccatccggcagcaggtggaggccgtgctggccggccacgaggccgtgcgctggcacagcgagcagaggctgctgcggcgggccaagaggtctgtgcacttcaatgaccccaagtacccccagcagtggcacctgaacaacagaagaagccctggccgggacatcaacgtgactggagtgtgggagagaaatgtgacaggccggggcgtgacagtggtggtggtggatgatggagtggagcacaccatccaggacatcgcccccaactacagccctgagggcagctatgacctgaacagcaatgaccctgaccccatgccccacccagatgtggagaatggaaaccaccacggcacccgctgtgccggggagattgctgctgtgcccaacaacagcttctgtgctgtgggcgtggcctacggcagcagaattgctggcatccgggtgctggatggccccctgacagacagcatggaggccgtggccttcaacaagcactaccagatcaatgacatctacagctgctcctggggcccagatgatgatggcaagacagtggatggcccccaccagctgggcaaggccgccctgcagcacggcgtgattgctggccggcagggcttcggcagcatctttgtggtggccagcggaaatggaggccagcacaatgacaactgcaactatgatggctacgccaacagcatctacacagtgaccatcggggctgtggatgaggagggccgcatgcccttctacgccgaggagtgtgcctccatgctggccgtgaccttcagcggcggggacaagatgctgcggagcatcgtgaccacagactgggacctgcagaagggcaccggctgcacagagggccacacaggcaccagcgctgctgcccccctggccgccggcatgattgccctgatgctgcaggtgcggccctgcctgacctggagagatgtgcagcacatcatcgtgttcaccgccaccaggtatgaagatagaagagctgagtgggtgaccaatgaggccggcttcagccacagccaccagcacggcttcggcctgctgaatgcctggaggctggtgaatgctgccaagatctggacctctgtgccctacctggccagctatgtgtcccctgtgctgaaggagaacaaggccatcccccagagccccaggagcctggaggtgctgtggaatgtgtccaggatggacctggagatgagcggcctgaagaccctggagcacgtggccgtgacagtgtccatcacccacccccggcggggcagcctggagctgaagctgttctgccccagcggcatgatgagcctcatcggggcccccaggtccatggacagctggctgtgtgtggagtgcagccgccaccagggccagaccaaggctgtgcgggagtgccacgagtggaagatcccagccaggtag

SEQ ID NO: 37115 - DNA, 2022 bp, Artificial Sequence
  Description of Artificial Sequence: Synthetic coding sequence
atggccaagctggagaccctgcctgtgcgggctgaccccggccgggaccccctgctggcctttgccccccggcccagcgagctgggccccccagacccccggctggccatgggctctgtgggcagcggcgtggcccacgcccaggagtttgccatgaagtctgtgggcaccaggactggaggcggcggcagccagggcagcttccctggcccccggggcagcggcagcggggccagccgggagaggcctggccgctaccccagtgaagataaaggcctggccaacagcctgtacctgaatggagagctgcggggcagtgaccacacagatgtgtgtggaaatgtggtgggcagcagcggcggcagcagcagcagcggcggcagtgacaaggccccaccccagtaccgggagcccagccacccccccaagctgctggccaccagcggcaagctggaccagtgcagcgagcccctggtgcggcccagcgccttcaagcctgtggtgcccaagaacttccacagcatgcagaacctgtgccccccccagaccaacggcaccccagagggccggcagggccctgggggcctgaagggcggcctggacaagagcaggaccatgaccccagctgggggcagcggcagcggcctgagtgacagcggcaggaacagcctgaccagcctgcccacctacagcagcagctacagccagcacctggcccccctgagcgccagcaccagccacatcaacagaattggaacagccagctatggcagcggcagcggcggcagcagcggcggcggcagcggctaccaggacctgggcaccagtgacagcggccgggccagcagcaagagcggcagcagcagctccatgggccggcccggccacctgggcagcggggagggcggcggcggcggcctgccctttgctgcctgcagcccccccagccccagcgccctgatccaggagctggaggagcggctgtgggagaaggagcaggaggtggccgccctgcggcgcagcctggagcagagcgaggccgctgtggcccaggtgctggaggagcggcagaaggcctgggagcgggagctggccgagctgcggcagggctgcagcggcaagctgcagcaggtggcccggcgggcccagagggcccagcagggcctgcagctgcaggtgctgcggctgcagcaggacaagaagcagctgcaggaggaggccgcccggctgatgaggcagcgggaggagctggaggacaaggtggccgcctgccagaaggagcaggccgacttcctgcccagaattgaggagaccaagtgggaggtgtgccagaaggccggggagatcagcctgctgaagcagcagctgaaggacagccaggctgatgtgtcccagaagctgtctgagatcgtgggcctgcggagccagctgcgggagggccgggccagcctgcgggagaaggaggagcagctgctgagcctgcgggacagcttcagcagcaagcaggccagcctggagctgggggagggggagctgcctgctgcctgcctgaagccagccctgacccctgtggaccctgctgagccccaggatgccctggccacctgtgagagtgatgaggccaagatgaggcggcaggccggcgtggccgccgccgccagcctggtgtctgtggatggagaggccgaggccggcggggagagcggcacccgggccctgcggcgggaggtgggccgcctgcaggccgagctggccgctgagcggcgggcccgggagcggcagggcgccagctttgctgaggagcggcgggtgtggctggaggagaaggagaaggtgattgagtaccagaagcagctgcagctgtcctatgtggagatgtaccagaggaaccagcagctggagcggcggctgcgggagagaggagctgctggaggagccagcacccccaccccccagcacggggaggagaagaaggcctggacccccagccggctggagcgcatcgagagcacagagatctag

SEQ ID NO: 37116 - DNA, 1884 bp, Artificial Sequence
  Description of Artificial Sequence: Synthetic coding sequence
atggccaagctggagaccctgcctgtgcgggctgaccccggccgggaccccctgctggcctttgccccccggcccagcgagctgggccccccagacccccggctggccatgggctctgtgggcagcggcgtggcccacgcccaggagtttgccatgaagtctgtgggcaccaggactggaggcggcggcagccagggcagcttccctggcccccggggcagcggcagcggggccagccgggagaggcctggccgctaccccagtgaagataaaggcctggccaacagcctgtacctgaatggagagctgcggggcagtgaccacacagatgtgtgtggaaatgtggtgggcagcagcggcggcagcagcagcagcggcggcagtgacaaggccccaccccagtaccgggagcccagccacccccccaagctgctggccaccagcggcaagctggaccagtgcagcgagcccctggtgcggcccagcgccttcaagcctgtggtgcccaagaacttccacagcatgcagaacctgtgccccccccagaccaacggcaccccagagggccggcagggccctgggggcctgaagggcggcctggacaagagcaggaccatgaccccagctgggggcagcggcagcggcctgagtgacagcggcaggaacagcctgaccagcctgcccacctacagcagcagctacagccagcacctggcccccctgagcgccagcaccagccacatcaacagaattggaacagccagctatggcagcggcagcggcggcagcagcggcggcggcagcggctaccaggacctgggcaccagtgacagcggccgggccagcagcaagagcggcagcagcagctccatgggccggcccggccacctgggcagcggggagggcggcggcggcggcctgccctttgctgcctgcagcccccccagccccagcgccctgatccaggagctggaggagcggctgtgggagaaggagcaggaggtggccgccctgcggcgcagcctggagcagagcgaggccgctgtggcccagcaggacaagaagcagctgcaggaggaggccgcccggctgatgaggcagcgggaggagctggaggacaaggtggccgcctgccagaaggagcaggccgacttcctgcccagaattgaggagaccaagtgggaggtgtgccagaaggccggggagatcagcctgctgaagcagcagctgaaggacagccaggctgatgtgtcccagaagctgtctgagatcgtgggcctgcggagccagctgcgggagggccgggccagcctgcgggagaaggaggagcagctgctgagcctgcgggacagcttcagcagcaagcaggccagcctggagctgggggagggggagctgcctgctgcctgcctgaagccagccctgacccctgtggaccctgctgagccccaggatgccctggccacctgtgagagtgatgaggccaagatgaggcggcaggccggcgtggccgccgccgccagcctggtgtctgtggatggagaggccgaggccggcggggagagcggcacccgggccctgcggcgggaggtgggccgcctgcaggccgagctggccgctgagcggcgggcccgggagcggcagggcgccagctttgctgaggagcggcgggtgtggctggaggagaaggagaaggtgattgagtaccagaagcagctgcagctgtcctatgtggagatgtaccagaggaaccagcagctggagcggcggctgcgggagagaggagctgctggaggagccagcacccccaccccccagcacggggaggagaagaaggcctggacccccagccggctggagcgcatcgagagcacagagatctag

SEQ ID NO: 37117 - DNA, 1884 bp, Artificial Sequence; identical to SEQ ID NO: 37116
  Description of Artificial Sequence: Synthetic coding sequence

SEQ ID NO: 37118 - DNA, 1188 bp, Artificial Sequence
  Description of Artificial Sequence: Synthetic coding sequence
atgtctgccaatgccaccctgaagcccctgtgccccatcctggagcagatgagccggctgcagagccacagcaacaccagcatccgctacatcgaccacgccgctgtgctgctgcacggcctggccagcctgctgggcctggtggagaatggagtcatcctgtttgtggtgggctgcaggatgaggcagacagtggtgaccacctgggtgctgcacctggccctgagtgacctgctggccagcgccagcctgcccttcttcacctacttcctggccgtgggccacagctgggagctgggcaccaccttctgcaagctgcacagcagcatcttcttcctgaacatgtttgccagcggcttcctgctgagcgccatcagcctggaccgctgcctgcaggtggtgcggcctgtgtgggcccagaaccacaggacagtggccgccgcccacaaggtgtgcctggtgctgtgggccctggccgtgctgaacacagtgccctactttgtgttccgggacaccatcagccggctggatggccgcatcatgtgctactacaacgtgctgctgctgaaccctggccctgacagagatgccacctgcaacagccggcaggtggccctggccgtgtccaagttcctgctggccttcctggtgcccctggccatcatcgccagcagccatgctgctgtgtccctgcggctgcagcaccggggcagaagaagacctggccgctttgtgcggctggtggccgctgtggtggccgcctttgccctgtgctggggcccctaccacgtgttcagcctgctggaggcccgggcccacgccaaccctggcctgcggcccctggtgtggaggggcctgccctttgtgaccagcctggccttcttcaacagcgtggccaaccctgtgctgtatgtgctgacctgcccagacatgctgaggaagctgcggcgcagcctgaggacagtgctggagagcgtgctggtggatgattctgagctgggcggggccggcagcagcagaagaagaaggaccagcagcacagcccggagcgccagccccctggccctgtgcagcaggcctgaggagccccggggccctgcccggctgctgggctggctgctgggcagctgtgccgccagcccccagacaggccccctgaacagagccctgagcagcaccagcagctag

SEQ ID NO: 37119 - DNA, 933 bp, Artificial Sequence
  Description of Artificial Sequence: Synthetic coding sequence
atggtgtacaagaccctgtttgccctgtgcatcctgacagctggctggagggtgcagagcctgcccaccagcgcccccctgtctgtgtccctgcccaccaacatcgtgccccccaccaccatctggaccagcagcccccagaacacagatgctgacacagccagccccagcaatggcacccacaacaacagcgtgctgcctgtgacagccagcgcccccaccagcctgctgcccaagaacatcagcattgagagccgggaggaggagatcaccagccctggcagcaactgggagggcaccaacacagaccccagccccagcggcttcagcagcaccagcggaggagtgcacctgaccaccaccctggaggagcacagcagcggcaccccagaggccggcgtggccgccaccctgagccagagcgctgctgagccccccaccctcatcagcccccaggccccagccagcagccccagcagcctgagcaccagccccccagaggtgttcagcgcctctgtgaccaccaaccacagcagcacagtgaccagcacccagcccactggagcccccacagcccctgagagccccacagaggagagcagcagtgaccacacccccaccagccacgccacagctgagcctgtgccccaggagaagaccccacccaccaccgtgtctgggaaggtgatgtgtgagctgattgacatggagaccaccaccaccttccccagggtcatcatgcaggaggtggagcacgccctgagcagcggcagcattgctgccatcaccgtgacagtgattgctgtggtgctgctggtgtttggagtggccgcctacctgaagatccgccacagcagctatggccgcctgctggatgaccatgactatggctcctggggcaactacaacaaccccctgtatgatgacagctag

SEQ ID NO: 37120 - DNA, 1191 bp, Artificial Sequence
  Description of Artificial Sequence: Synthetic coding sequence
atgggagagaggaaaggagtgaacaagtactaccccccagacttcaaccctgagaagcacggcagcctgaaccgctaccacaacagccaccccctgcgggagcgggccaggaagctgagccagggcatcctgatcatccgctttgagatgccctacaacatctggtgtgatggctgcaagaaccacatcggcatgggcgtgcgctacaatgctgagaagaagaaggtgggcaactactacaccacccccatctaccgcttcaggatgaagtgccacctgtgtgtgaactacatcgagatgcagacagatcctgccaactgtgactatgtgattgtgtctggggcccagaggaaggaggagcgctgggacatggctgacaatgagcaggtgctgaccacagaacatgagaagaagcagaagctggagacagatgccatgttccggctggagcacggggaggccgacaggagcaccctgaagaaggccctgcccaccctgagccacatccaggaggcccagagcgcctggaaggatgactttgccctgaacagcatgctgcggcggcgcttccgggagaagaagaaggccatccaggaggaggaggagcgggaccaggccctgcaggccaaggccagcctgaccatccccctggtgcctgagacagaagatgacaggaagctggccgccctgctgaagttccacaccctggacagctatgaggacaagcagaagctgaagaggacagagatcatcagccgctcctggttccccagcgcccctggcagcgccagcagcagcaaggtgtctggagtgctgaagaagctggcccagagcagaagaacagccctggccaccagccccatcaccgtgggggacctgggcatcgtgagaagaagaagcagagatgtgcctgagagcccccagcacgccgctgacacccccaagagcggggagccccgggtgcctgaggaggccgcccaggaccggcccatgagccctggggactgccccccagagaccacagagacccccaagtgcagcagcccccggggccaggagggcagccggcaggacaagcccctgagccctgctggcagcagccaggaggccgctgacaccccagacaccaggcacccctgcagcctgggcagcagcctggtggccgactacagcgacagcgagagcgagtag

SEQ ID NO: 37121 - DNA, 1251 bp, Artificial Sequence
  Description of Artificial Sequence: Synthetic coding sequence
atggtgcggccccggcgggccccctacagaagtggagctgggggccccctgggcggccggggccggcccccccggcccctggtggtgcgggctgtgcgcagccgctcctggccagccagcccccggggcccccagcccccacgcatccgggcccggagcgccccacccatggagggcgcccgggtgtttggagccctgggccccatcggccccagcagccctggcctgaccctgggcggcctggccgtgtctgagcaccggctgagcaacaagctgctggcctggagcggcgtgctggagtggcaggagaagagaagaccctacagcgacagcacagccaagctgaagaggaccctgccctgccaggcctacgtgaaccagggcgagaacctggagacagaccagtggccccagaagctgatcatgcagctgatcccccagcagctgctgaccaccctgggccccctcttcaggaacagccagctggcccagttccacttcaccaacagagactgtgacagcctgaagggcctgtgccgcatcatgggaaatggatttgctggctgcatgctgttcccccacatcagcccctgtgaggtgcgggtgctgatgctgctgtacagcagcaagaagaagatcttcatgggcctcatcccctatgaccagagcggctttgtgtctgccatccggcaggtgatcaccaccaggaagcaggccgtgggccctgggggcgtgaacagcggccctgtgcagatcgtgaacaacaagttcctggcctggagcggcgtgatggagtggcaggagcccaggcctgagcccaacagccgcagcaagcgctggctgcccagccacgtgtatgtgaaccagggcgagatcctgaggacagagcagtggcccaggaagctgtacatgcagctgatcccccagcagctgctgaccaccctggtgcccctcttcaggaacagccggctggtgcagttccacttcaccaaggacctggagaccctgaagagcctgtgccgcatcatggacaatggatttgctggctgtgtgcacttctcctacaaggccagctgtgagatccgggtgctgatgctgctgtacagcagcgagaagaagatcttcatcggcctcatcccccatgaccagggcaactttgtgaatggcatcagaagagtcatcgccaaccagcagcaggtgctgcagaggaacctggagcaggagcagcagcagaggggcatgggcggctag

SEQ ID NO: 37122 - DNA, 831 bp, Artificial Sequence
  Description of Artificial Sequence: Synthetic coding sequence
atgctgctcttctctgtgctgctgctgctgagcctggtgacaggcacccagctgggccccaggacccccctgcctgaggccggcgtggccatcctgggccgggcccggggggcccaccggccccagcccccccacccccccagccctgtgtctgaatgtggggacaggagcatctttgagggccgcacccgctacagccgcatcactggaggcatggaggccgaggtgggggagttcccctggcaggtgtccatccaggcccggtctgagcccttctgtggcggcagcatcctgaacaagtggtggatcctgacagctgcccactgcctgtacagcgaggagctgtttcctgaggagctgtctgtggtgctgggcaccaatgacctgaccagccccagcatggagatcaaggaggtggccagcatcatcctgcacaaggacttcaagagggccaacatggacaatgacatcgccctgctgctgctggccagccccatcaagctggatgacctgaaggtgcccatctgcctgcccacccagcccggccctgccacctggagggagtgctgggtggccggctggggccagaccaatgctgctgacaagaacagcgtgaagacagacctgatgaaggcccccatggtgatcatggactgggaggagtgcagcaagatgttccccaagctgaccaagaacatgctgtgtgccggctacaagaatgaaagctatgatgcctgcaagcagagctacttccccaccctgcagaggatgaacacaggcagcagccagaccaagcccccaggcagccacaccttccacctgcagaactag

SEQ ID NO: 37123 - DNA, 1059 bp, Artificial Sequence
  Description of Artificial Sequence: Synthetic coding sequence
atgctgctcttctctgtgctgctgctgctgagcctggtgacaggcacccagctgggccccaggacccccctgcctgaggccggcgtggccatcctgggccgggcccggggggcccaccggccccagcccccccacccccccagccctgtgtctgaatgtggggacaggagcatctttgagggccgcacccgctacagccgcatcactggaggcatggaggccgaggtgggggagttcccctggcaggtgtccatccaggcccggtctgagcccttctgtggcggcagcatcctgaacaagtggtggatcctgacagctgcccactgcctgtacagcgaggagctgtttcctgaggagctgtctgtggtgctgggcaccaatgacctgaccagccccagcatggagatcaaggaggtggccagcatcatcctgcacaaggacttcaagagggccaacatggacaatgacatcgccctgctgctgctggccagccccatcaagctggatgacctgaaggtgcccatctgcctgcccacccagcccggccctgccacctggagggagtgctgggtggccggctggggccagaccaatgctgctgacaagaacagcgtgaagacagacctgatgaaggcccccatggtgatcatggactgggaggagtgcagcaagatgttccccaagctgaccaagaacatgctgtgtgccggctacaagaatgaaagctatgatgcctgcaagggggacagcggcggccccctggtgtgcaccccagagcccggggagaagtggtaccaggtgggcatcatctcctggggcaagagctgtggggagaagaacaccccaggcatctacaccagcctggtgaactacaacctgtggattgagaaggtgacccagctggagggccggcccttcaatgctgagaagaggaggacctctgtgaagcagaagcccatgggcagccctgtgtctggagtgcctgagcccggcagccccaggtcctggctgctgctgtgccccctgagccacgtgctcttccgggccatcctgtactag

SEQ ID NO: 37124 - DNA, 1185 bp, Artificial Sequence
  Description of Artificial Sequence: Synthetic coding sequence
atgggcatgaagcacagcagccgctgcctgctgctgcggaggaagatggccgagaatgctgctgagagcacagaggtgaacagcccccccagccagcccccccagcctgtggtgcctgccaagcctgtgcagtgtgtgcaccacgtgtccacccagcccagctgccccggccggggcaagatgagcaagctgctgaaccctgaggagatgaccagccgggactactactttgacagctatgcccacttcggcatccacgaggagatgctgaaggatgaggtgaggaccctgacctacagaaacagcatgtaccacaacaagcacgtgttcaaggacaaggtggtgctggatgtgggcagcggcaccggcatcctgtccatgtttgctgccaaggccggggccaagaaggtgtttggaattgaatgtagcagcatcagtgactacagcgagaagatcatcaaggccaaccacctggacaacatcatcaccatcttcaagggcaaggtggaggaggtggagctgcctgtggagaaggtggacatcatcatcagcgagtggatgggctactgcctcttctatgaatccatgctgaacacagtcatctttgcccgggacaagtggctgaagccaggcggcctgatgtttcctgacagagctgccctgtatgtggtggccattgaagatcggcagtacaaggacttcaagatccactggtgggagaatgtgtatggctttgacatgacctgcatcagagatgtggccatgaaggagcccctggtggacatcgtggaccccaagcaggtggtgaccaatgcctgcctgatcaaggaggtggacatctacacagtgaagacagaggagctgtccttcaccagcgccttctgcctgcagatccagagaaatgactatgtgcacgccctggtgacctacttcaacatcgagttcaccaagtgccacaagaagatgggcttcagcacagccccagatgccccctacacccactggaagcagaccgtcttctacctggaggactacctgactgtgagaagaggagaggagatctacggcaccatctccatgaagcccaatgccaagaatgtgcgggacctggacttcaccgtggacctggacttcaagggccagctgtgtgagacctctgtgtccaatgactacaagatgaggtag

SEQ ID NO: 37125 - DNA, 1158 bp, Artificial Sequence
  Description of Artificial Sequence: Synthetic coding sequence
atggagagcctggccagtgatggcttcaagctgaaggaggtgtcctctgtgaacagcccccccagccagcccccccagcctgtggtgcctgccaagcctgtgcagtgtgtgcaccacgtgtccacccagcccagctgccccggccggggcaagatgagcaagctgctgaaccctgaggagatgaccagccgggactactactttgacagctatgcccacttcggcatccacgaggagatgctgaaggatgaggtgaggaccctgacctacagaaattccatgtaccacaacaagcacgtgttcaaggacaaggtggtgctggatgtgggcagcggcaccggcatcctgtccatgtttgctgccaaggccggggccaagaaggtgtttggaattgagtgcagcagcatcagtgactacagcgagaagatcatcaaggccaaccacctggacaacatcatcaccatcttcaagggcaaggtggaggaggtggagctgcctgtggagaaggtggacatcatcatcagcgagtggatgggctactgcctcttctatgagagcatgctgaacacagtcatctttgcccgggacaagtggctgaagccaggcggcctgatgtttcctgaccgggccgccctgtatgtggtggccatcgaggaccggcagtacaaggacttcaagatccactggtgggagaatgtgtatggctttgacatgacctgcatcagagatgtggccatgaaggagcccctggtggacatcgtggaccccaagcaggtggtgaccaatgcctgcctgatcaaggaggtggacatctacacagtgaagacagaggagctgtccttcaccagcgccttctgcctgcagatccagagaaatgactatgtgcacgccctggtgacctacttcaacatcgagttcaccaagtgccacaagaagatgggcttcagcacagccccagatgccccctacacccactggaagcagacagtgttctacctggaggactacctgactgtgcggcggggggaggagatctacggcaccatctccatgaagcccaatgccaagaatgtgcgggacctggacttcaccgtggacctggacttcaagggccagctgtgtgagacctctgtgtccaatgactacaagatgaggtag

SEQ ID NO: 37126 - DNA, 3498 bp, Artificial Sequence
  Description of Artificial Sequence: Synthetic coding sequence
atgtacttcctgagcggctggcccaagaggctgctgtgccccctgggcagccctgctgaggcccccttccacgtgcagagcgacccccagagggccttctttgctgtgctggccgccgcccggctgagcatctggtacagccggcccagcgtgctgattgtgacctacaaggagcccgccaagagcagcacccagtttggcagctacaagcaggccgagtggaggccagacagcaccatgattgctgtgtccacagccaacggctacatcctcttcttccacatcaccagcaccaggggggacaagtacctgtatgagcctgtgtaccccaagggcagcccccagatgaagggcaccccccacttcaaggaggagcagtgtgccccagccctgaacctggagatgaggaagatcctggacctgcaggcccccatcatgagcctgcagagcgtgctggaggacctgctggtggccaccagtgatggcctgctgcacctgatccactgggagggcatgaccaacggcaggaaggccatcaacctgtgcaccgtgcccttctctgtggacctgcagagcagccgggtgggcagcttcctgggcttcacagatgtgcacatccgggacatggagtactgtgccaccctggatggctttgctgtggtgttcaatgatggcaaggtgggcttcatcacccctgtgagcagccgcttcaccgctgagcagctgcatggagtgtggccccaggatgtggtggatggcacctgtgtggccgtgaacaacaagtaccgcctgatggccttcggctgtgtgtctggctctgtgcaggtgtacaccatcgacaacagcactggagccatgctgctgagccacaagctggagctgacagccaagcagtacccagacatctggaacaagacaggagctgtgaagctgatgcgctggagcccagacaacagcgtggtgattgtgacctgggagtatggaggcctgagcctgtggagcgtgtttggagcccagctgatctgcaccctgggcggggactttgcctacagaagtgatggcaccaagaaggaccccctgaagatcaacagcatgtcctggggcgctgagggctaccacctgtgggtgatcagcggcttcggcagccagaacacagaaattgaaagtgacctgcggtctgtggtgaagcagcccagcatcctgctcttccagttcatcaagtctgtgctgactgtgaacccctgcatgagcaaccaggagcaggtgctgctgcagggagaagatcggctgtacctgaactgtggggaggccagccagacccagaaccccaggagcagcagcacccacagcgagcacaagcccagccgggagaagagcccctttgctgatggcggcctggagagccagggcctgagcaccctgctgggccaccgccactggcacgtggtgcagatcagcagcacctacctggagagcaactggcccatccgcttcagcgccatcgacaagctgggccagaacattgctgtggtgggcaagtttggatttgcccactacagcctgctgaccaagaagtggaagctgtttggaaacatcacccaggagcagaacatgattgtgactggaggcctggcctggtggaatgacttcatggtgctggcctgctacaacatcaatgaccggcaggaggagctgcgggtgtacctgcggaccagcaacctggacaatgcctttgcccacgtgaccaaggcccaggccgagaccctgctgctgagcgtcttccaggacatggtgattgtgttccgggctgactgcagcatctgcctgtacagcattgaaaggaagagtgatggccccaacaccacagctggcatccaggtgctgcaggaggtgtccatgagccgctacatcccccaccccttcctggtggtgtctgtgaccctgacctctgtgtccacagaaaatggcatcaccctgaagatgccccagcaggcccggggagctgagagcatcatgctgaacctggccggccagctgatcatgatgcagagggacagaagtggcccccagatccgggagaaggacagcaaccccaacaaccagaggaagctgctgcccttctgcccccctgtggtgctggcccagagcgtggagaatgtgtggaccacctgccgggccaacaagcagaagaggcacctgctggaggccctgtggctgagctgtggcggggccggcatgaaggtgtggctgcccctcttcccccgggaccacaggaagccccacagcttcctgagccagaggatcatgctgcccttccacatcaacatctaccccctggccgtgctgtttgaagatgccctggtgctgggcgctgtgaatgacaccctgctgtatgacagcctgtacaccaggaacaatgcccgggagcagctggaggtgctcttccccttctgtgtggtggagaggaccagccagatctacctgcaccacatcctgcggcagctgctggtgaggaacctgggggagcaggccctgctgctggcccagagctgtgccaccctgccctacttcccccacgtgctggagctgatgctgcacgaggtgctggaggaggaggccaccagccgggagcccatcccagaccccctgctgcccaccgtggccaagttcatcacagagttccccctcttcctgcagacagtggtgcactgtgccaggaagacagaatatgccctgtggaactacctgtttgctgctgtgggcaaccccaaggacctgtttgaagaatgtctgatggcccaggacctggacacagctgccagctacctgatcatcctgcagaacatggaggtgcctgctgtgtcccggcagcacgccaccctgctcttcaacacagccctggagcagggcaagtgggacctgtgccgccacatgatccgcttcctgaaggccatcggcagcggggagagcgagaccccacccagcacccccacagcccaggagcccagcagcagcggcggctttgagttcttcaggaacagaagcatcagcctgagccagagcgcagaaaatgtgcctgccagcaagttcagcctgcagaagaccctgtccatgcccagcggccccagcggcaagcgctggagcaaggacagcgactgtgccgagaacatgtacatcgacatgatgctgtggaggcatgcccggcggctgctggaggatgtgcggctgaaggacctgggctgctttgctgcccagctgggctttgagctgatctcctggctgtgcaaggagaggaccagggctgcccgggtggacaactttgtgattgccctgaagaggctgcacaaggacttcctgtggcccctgcccatcatcccagccagcagcatcagcagccccttcaagaatggcaagtacagaactggaaatgtggacttcatgagcctggtgcagggcgagctgtacttcaccccctgcatctacaccttctgctactag

SEQ ID NO: 37127 - DNA, 2043 bp, Artificial Sequence
  Description of Artificial Sequence: Synthetic coding sequence
atgtacaccttcctgcctgacaacttctccccagccaagcccaagcccagcaaggacctgaagcccctgctgggcagcgctgtgctgggcctgctgctggtgctggccgctgtggtggcctggtgctactacagcgtgtccctgaggaaggccgagcggctgcgggcagagctgctggacctgaaggccggcggcttcagcatccggaaccagaagggggagcaggtgttccggctggccttccgcagcggggccctggacctggacagctgcagcagagatggagccctgctgggctgcagcctgacagcagatggcctgcccctgcacttcttcatccagacagtgcggcccaaggacacagtgatgtgctacagagtgcgctgggaggaggccgcccctggccgggctgtggagcacgccatgttcctgggagatgctgctgcccactggtacggcggcgctgagatgaggacccagcactggcccatccggctggatggccagcaggagccccagccctttgtgaccagtgatgtgtacagcagtgatgctgcctttggaggcatcctggagcgctactggctgagcagcagagctgctgccatcaaggtgaatgacagcgtgcccttccacctgggctggaacagcacagagaggagcctgcggctgcaggcccgctaccatgacaccccctacaagcccccagctggccgggctgctgcccctgagctgagctacagagtgtgtgtgggcagtgatgtgaccagcatccacaagtacatggtgcggcgctacttcaacaagcccagccgggtgcctgcccctgaggccttccgggaccccatctggagcacctgggccctgtatggccgggctgtggaccaggacaaggtgctgcgctttgcccagcagatccggctgcaccacttcaacagcagccacctggagattgatgacatgtacaccccagcctacggggactttgattttgatgaggtgaagttccccaatgccagtgacatgttccggcggctgagagatgctggcttccgggtgaccctgtgggtgcacccctttgtgaactacaacagcagcagatttggagaaggagtggagcgggagctgtttgtgcgggagcccaccggccgcctgcctgccctggtgcgctggtggaatggaattggagctgtgctggacttcacccaccccaaggcccgggactggttccagggccacctgcggcggctgcggagccgctacagcgtggccagcttcaagtttgatgctggggaggtgtcctacctgccccgggacttcagcacctaccggcccctgcctgaccccagcgtgtggagccgccgctacacagagatggccctgcccttcttcagcctggccgaggtgcgggtgggctaccagagccagaacatcagctgcttcttccggctggtggaccgggacagcgtgtggggctatgacctgggcctgcggagcctcatcccagctgtgctgactgtgtccatgctgggctaccccttcatcctgcctgacatggtgggcggcaatgctgtgccccagaggacagctggaggagatgtgcctgagcgggagctgtacatccgctggctggaggtggccgccttcatgcctgccatgcagttcagcatccccccctggaggtatgatgctgaggtggtggccatcgcccagaagtttgctgccctgcgggccagcctggtggcccccctgctgctggagctggccggggaggtgacagacacaggagaccccatcgtgcggcccctgtggtggatcgcccctggagatgaaacagcccacagaattgacagccagttcctgattggagacaccctgctggtggcccctgtgctggagcccgggaagcaggagagagatgtgtacctgcctgctgggaagtggaggagctacaagggggagctgtttgacaagacccctgtgctgctgacagactaccctgtggacctggatgaaattgcctacttcacctgggccagctag

SEQ ID NO: 37128 - DNA, 228 bp, Artificial Sequence
  Description of Artificial Sequence: Synthetic coding sequence
atggctgctgagtgggccagccgcttctggctgtgggccaccctgctgatcccagctgctgctgtgtatgaggaccaggtgggcaagtttgactggaggcagcagtatgtgggcaaggtgaagtttgccagcctggagttcagccctggcagcaagaagctggtggtggccacagagaagaatgtgattgctgccctgaacagcaggactggagagatctgtgagtag

SEQ ID NO: 37129 - DNA, 1665 bp, Artificial Sequence
  Description of Artificial Sequence: Synthetic coding sequence
gcccccaccggccgggctgacctgagcggcaaccagggcaatgctgctggccgcctggccaccgtgcatgagcctgtggtgacccagtgggccgtgcaccccccagccccagcccaccccagcctgctggacaagatggagaaggccccaccccagccccagcacgagggcctgaagagcaaggagcacctgccccagcagcctgctgagggcaagacagccagccggcgggtgccccggctgcgggctgtggtggagagccaggccttcaagaacatcctggtggatgagatggacatgatgcacgcccgggccgccaccctcatccaggccaactggaggggctactggctgcggcagaagctgatcagccagatgatggccgccaaggccatccaggaggcctggaggcgcttcaacaagaggcacatcctgcacagcagcaagagcctggtgaagaagaccagggctgaggagggggacatcccctaccacgccccccagcaggtgcgcttccagcacccagaagaaaatcggctgctgagcccccccatcatggtgaacaaggagacccagttccccagctgtgacaacctggtgctgtgccggccccagagcagccccctgctgcagcccccagctgcccagggcaccccagagccctgtgtgcagggcccccacgccgcccgggtgcggggcctggccttcctgccccaccagacagtgaccatccgcttcccctgccctgtgtccctggatgccaagtgccagccctgcctgctgaccaggaccatccgcagcacctgcctggtgcacattgaaggagacagcgtgaagaccaagagggtgtctgcccggaccaacaaggcccgggcccctgagacccccctgagcagaagatatgaccaggccgtgacccggcccagccgggcccagacccagggccctgtgaaggccgagacccccaaggcccccttccagatctgccccggccccatgatcaccaagaccctgctgcagacctaccctgtggtgtctgtgaccctgccccagacctacccagccagcaccatgaccaccaccccacccaagaccagccctgtgcccaaggtgaccatcatcaagaccccagcccagatgtacccaggccccaccgtgaccaagacagccccccacacctgccccatgcccaccatgaccaagatccaggtgcaccccacagccagcaggacaggcaccccccggcagacctgcccagccaccatcacagccaagaaccggccccaggtgtccctgctggccagcatcatgaagagcccccccagcgtggtgatgctggtgggcagcagccccaggacctgccacacctgtggccgcacccagcccaccagggtggtgcagggcatgggccagggcacagagggccctggagctgtgtcctgggccagcgcctaccagctggccgccctgagcccccggcagccccaccggcaggacaaggccgccacagccatccagagcgcctggaggggcttcaagatccggcagcagatgaggcagcagcagatggccgccaagatcgtgcaggccacctggtggcacctgggcccctggctgcctgctgtgggcacctcctgggaggccctgatggccctgtgggtgtag

SEQ ID NO: 37130 - DNA, 657 bp, Artificial Sequence
  Description of Artificial Sequence: Synthetic coding sequence
caggtgaagaaggtgctgtttgaagatgatgagaggagcacagacagcagccagcagtgcagcagtgaagatgaggacatctttgaggagacagcccaggtgagccccccccggggcaaggagaagaggcagtggagggccaggatgcccctgctgtctgtgcagcctgtgtccaatgctgactgggtgtggctggtgaagaggctgcacaagctgtgcatggagctgtgcaacaactacatccagatgcacctggacctggagaactgcatggaggagccccccatcttcaagggggaccccttcttcatcctgcccagcttccagagcgagagcagcacccccagcactggaggcttcagcggcaaggagaccccatctgaagatgacaggagccagcccaggagcggcagcacaggcagcagcctgtctgtgtctgtgagagatgctgaggcccagatccaggcctggaccaacatggtgctgactgtgctgaaccagatccagatcctgcctgaccagaccttcaccgccctgcagcctgctgtgttcccctgcatcagccagctgacctgccacgtgacagacatccgggtgcggcaggccgtgcgggagtggctgggccgggtgggccgggtgtatgacatcatcgtgtag

SEQ ID NO: 37131 - DNA, 1035 bp, Artificial Sequence
  Description of Artificial Sequence: Synthetic coding sequence
atggagaagaggctgggcgtgaagcccaacccagcctcctggatcctgagcggctactactggcagaccagcgccaagtggctgcggagcctgtacctgttctacacctgcttctgcttctctgtgctgtggctgagcacagatgccagcgagagccgctgccagcagggcaagacccagtttggagtgggcctgcggtctggaggagagaaccacctgtggctgctggagggcacccccagcctgcagagctgctgggccgcctgctgccaggacagcgcctgccacgtgttctggtggctggagggcatgtgcatccaggccgactgcagccggccccagagctgccgggccttccgcacccacagcagcaacagcatgctggtgttcctgaagaagttccagacagcagatgacctgggcttcctgcctgaagatgatgtgccccacctgctgggcctgggctggaactgggcctcctggaggcagagccccccccgggccgccctgcggcctgctgtgagcagcagtgaccagcagagcctcatcaggaagctgcagaagaggggcagccccagtgatgtggtgacccccatcgtgacccagcacagcaaggtgaatgacagcaatgagctgggcggcctgaccaccagcggcagcgctgaggtgcacaaggccatcaccatcagcagccccctgaccacagacctgacagctgagctgagcggcggccccaagaatgtgtctgtgcagcctgagatcagcgagggcctggccaccacccccagcacccagcaggtgaagagcagcgagaagacccagattgctgtgccccagcctgtggcccccagctacagctatgccacccccaccccccaggccagcttccagagcaccagcgccccctaccctgtgatcaaggagctggtggtgtctgctggggagagcgtgcagatcaccctgcccaagaatgaggtgcagctgaatgcctacgtgctgcaggagccccccaaggcccacagcaggcctgtgtag

SEQ ID NO: 37132 - DNA, 2979 bp, Artificial Sequence
  Description of Artificial Sequence: Synthetic coding sequence
atggctgctgagtgggccagccgcttctggctgtgggccaccctgctgatcccagctgctgctgtgtatgaggaccaggtgggcaagtttgactggaggcagcagtatgtgggcaaggtgaagtttgccagcctggagttcagccctggcagcaagaagctggtggtggccacagagaagaatgtgattgctgccctgaacagcaggactggagagatcctgtggaggcatgtggacaagggcacagctgagggcgctgtggatgccatgctgctgcacggccaggacgtcatcaccgtgtccaatggaggccgcatcatgaggtcctgggagaccaacatcggcggcctgaactgggagatcaccctggacagcggcagcttccaggccctgggcctggtgggcctgcaggagagcgtgcgctacatcgctgtgctgaagaagaccaccctggccctgcaccacctgagcagcggccacctgaagtgggtggagcacctgcctgagagtgacagcatccactaccagatggtgtacagctatggcagcggcgtggtgtgggccctgggcgtggtgcccttcagccacgtgaacatcgtgaagttcaacgtggaggatggagaaattgtgcagcaggtgcgggtgtccaccccctggctgcagcacctgagcggggcctgtggggtggtggatgaagctgtgctggtgtgcccagaccccagcagccgcagcctgcagaccctggccctggagacagagtgggagctgcggcagatccccctgcagagcctggacctggagtttggcagcggcttccagccccgggtgctgcccacccagcccaaccctgtggatgccagccgggcccagttcttcctgcacctgagccccagccactacgccctgctgcagtaccactacggcaccctgagcctgctgaagaacttcccccagacagccctggtgtcctttgccaccactggagagaagacagtggccgctgtgatggcctgcagaaatgaggtgaagagcagcagcagtgaagatggctccatgggcagcttcagcgagaagagcagcagcaaggacagcctggcctgcttcaaccagacctacaccatcaacctgtacctggtggagactggaagaaggctgctggacaccaccatcaccttcagcctggagcagagcggcaccaggcctgagcggctgtacatccaggtgttcctgaagaaggatgattctgtgggctaccgggccctggtgcagacagaggaccacctgctgctcttcctgcagcagctggccggcaaggtggtgctgtggagccgggaggagagcctggccgaggtggtgtgcctggagatggtggacctgcccctgaccggggcccaggccgagctggagggggagtttgggaagaaggcagatggcctgctgggcatgttcctgaagaggctgagcagccagctgatcctgctgcaggcctggaccagccacctgtggaagatgttttatgatgccaggaagcccaggagccagatcaagaatgagatcaacatcgacaccctggccagagatgagttcaacctgcagaagatgatggtgatggtgacagccagcggcaagctgtttggaattgagagcagcagcggcaccatcctgtggaagcagtacctgcccaacgtgaagccagacagcagcttcaagctgatggtgcagaggaccacagcccacttcccccaccccccccagtgcaccctgctggtgaaggacaaggagagcggcatgagcagcctgtatgtgttcaaccccatctttgggaagtggagccaggtggcccctcctgtgctgaagaggcccatcctgcagagcctgctgctgcctgtgatggaccaggactatgccaaggtgctgctgctgattgatgatgagtacaaggtgacagccttccctgccaccagaaatgtgctgcggcagctgcacgagctggcccccagcatcttcttctacctggtggatgctgagcagggccgcctgtgtggctaccgcctgaggaaggacctgaccacagagctgtcctgggagctgaccatccccccagaggtgcagagaattgtgaaggtgaagggcaagaggagcagcgagcacgtgcacagccagggccgggtgatgggagacagatctgtgctgtacaagagcctgaaccccaacctgctggccgtggtgacagagagcacagatgcccaccacgagaggaccttcatcggcatcttcctgattgatggagtgacaggccgcatcatccacagctctgtgcagaagaaggccaagggccctgtgcacatcgtgcacagcgagaactgggtggtgtaccagtactggaacaccaaggccaggagaaatgagttcaccgtgctggagctgtatgagggcacagagcagtacaatgccacagccttcagcagcctggaccggccccagctgccccaggtgctgcagcagagctacatcttccccagcagcatcagcgccatggaggccaccatcacagagcggggcatcaccagccgccacctgctgattggcctgcccagcggggccatcctgagcctgcccaaggccctgctggacccccggcggcctgagatccccacagagcagagccgggaggagaacctgatcccctacagcccagatgtgcagatccatgctgagcgcttcatcaactacaaccagacagtgtccaggatgaggggcatctacacagcccccagcggcctggagagcacctgcctggtggtggcctacggcctggacatctaccagaccagggtgtaccccagcaagcagtttgatgtgctgaaggatgattatgactatgtgctgatcagctctgtgctgtttggcctggtgtttgccaccatgatcaccaagaggctggcccaggtgaagctgctgaacagagcctggaggtag

SEQ ID NO: 37133 - DNA, 2916 bp, Artificial Sequence
  Description of Artificial Sequence: Synthetic coding sequence
atggctgctgagtgggccagccgcttctggctgtgggccaccctgctgatcccagctgctgctgtgtatgaggaccaggtgggcaagtttgactggaggcagcagtatgtgggcaaggtgaagtttgccagcctggagttcagccctggcagcaagaagctggtggtggccacagagaagaatgtgattgctgccctgaacagcaggactggagagatctacgtgatcaccgtgtccaatggaggccgcatcatgaggtcctgggagaccaacatcggcggcctgaactgggagatcaccctggacagcggcagcttccaggccctgggcctggtgggcctgcaggagagcgtgcgctacatcgctgtgctgaagaagaccaccctggccctgcaccacctgagcagcggccacctgaagtgggtggagcacctgcctgagagtgacagcatccactaccagatggtgtacagctatggcagcggcgtggtgtgggccctgggcgtggtgcccttcagccacgtgaacatcgtgaagttcaacgtggaggatggagaaattgtgcagcaggtgcgggtgtccaccccctggctgcagcacctgagcggggcctgtggggtggtggatgaagctgtgctggtgtgcccagaccccagcagccgcagcctgcagaccctggccctggagacagagtgggagctgcggcagatccccctgcagagcctggacctggagtttggcagcggcttccagccccgggtgctgcccacccagcccaaccctgtggatgccagccgggcccagttcttcctgcacctgagccccagccactacgccctgctgcagtaccactacggcaccctgagcctgctgaagaacttcccccagacagccctggtgtcctttgccaccactggagagaagacagtggccgctgtgatggcctgcagaaatgaggtgcagaagagcagcagcagtgaagatggctccatgggcagcttcagcgagaagagcagcagcaaggacagcctggcctgcttcaaccagacctacaccatcaacctgtacctggtggagaccggccggcggctgctggacaccaccatcaccttcagcctggagcagagcggcaccaggcctgagcggctgtacatccaggtgttcctgaagaaggatgacagcgtgggctaccgggccctggtgcagacagaggaccacctgctgctcttcctgcagcagctggccggcaaggtggtgctgtggagccgggaggagagcctggccgaggtggtgtgcctggagatggtggacctgcccctgactggagcccaggccgagctggagggggagtttgggaagaaggcagatggcctgctgggcatgttcctgaagaggctgagcagccagctgatcctgctgcaggcctggaccagccacctgtggaagatgttttatgatgccaggaagcccaggagccagatcaagaatgagatcaacatcgacaccctggccagagatgagttcaacctgcagaagatgatggtgatggtgacagccagcggcaagctgtttggcatcgagagcagcagcggcaccatcctgtggaagcagtacctgcccaacgtgaagccagacagcagcttcaagctgatggtgcagaggaccacagcccacttcccccaccccccccagtgcaccctgctggtgaaggacaaggagagcggcatgagcagcctgtatgtgttcaaccccatctttgggaagtggagccaggtggcccctcctgtgctgaagaggcccatcctgcagagcctgctgctgcctgtgatggaccaggactatgccaaggtgctgctgctgattgatgatgagtacaaggtgacagccttccctgccaccagaaatgtgctgcggcagctgcacgagctggcccccagcatcttcttctacctggtggatgctgagcagggccgcctgtgtggctaccgcctgaggaaggacctgaccacagagctgtcctgggagctgaccatccccccagaggtgcagagaattgtgaaggtgaagggcaagaggagcagcgagcacgtgcacagccagggccgggtgatgggagacagatctgtgctgtacaagagcctgaaccccaacctgctggccgtggtgacagagagcacagatgcccaccacgagaggaccttcatcggcatcttcctgattgatggagtgacaggccgcatcatccacagctctgtgcagaagaaggccaagggccctgtgcacatcgtgcacagcgagaactgggtggtgtaccagtactggaacaccaaggccaggagaaatgagttcaccgtgctggagctgtatgagggcacagagcagtacaatgccacagccttcagcagcctggaccggccccagctgccccaggtgctgcagcagagctacatcttccccagcagcatcagcgccatggaggccaccatcacagagcggggcatcaccagccgccacctgctgattggcctgcccagcggggccatcctgagcctgcccaaggccctgctggaccccaggaggcctgagatccccacagagcagagccgggaggagaacctgatcccctacagcccagatgtgcagatccacgccgagcgcttcatcaactacaaccagacagtgtccaggatgaggggcatctacacagcccccagcggcctggagagcacctgcctggtggtggcctacggcctggacatctaccagaccagggtgtaccccagcaagcagtttgatgtgctgaaggatgattatgactatgtgctgatcagctctgtgctgtttggcctggtgtttgccaccatgatcaccaagaggctggcccaggtgaagctgctgaacagagcctggaggtag

SEQ ID NO: 37134 - DNA, 4101 bp, Artificial Sequence
  Description of Artificial Sequence: Synthetic coding sequence
atgctgttcaagcaggccgagctgtggatgccccaccagggcaaaggaaacaagggggagcccccatctgccctgggcctgagcaccaggaaggccctgtctgtgctgaaggagcagctggaggccgtgctggagggccacctgcgggagaggaagaagtgcctgacctggaaggaggtgtggaggagcagcttcctgcaccacagcaaccgctgcagctgcttccactggccaggggccagcctgatgctgctggccgtgctgctgctgctgggctgctgcggcggccagcctgctggcagcagaggagtgggcctggtgaatgccagcgccctcttcctgctgctgctgctgaacctggtgctgattggccggcaggaccggctgaagagaagagaggtggagcggcggctgcggggcatcatcgaccagatccaggatgccctgagagatggccgggagatccagtggcccagcgccatgtacccagacctgcacatgccctttgcccccagctggagcctgcactgggcctacagagatggccacctggtgaacctgcctgtgtccctgctggtggagggggacatcatcgccctgcggcccggccaggagagctttgccagcctgcggggcatcaaggatgatgagcacatcgtgctggagcccggggacctcttcccccccttcagccccccacccagccccagaggagaggtggagcggggcccccagagcccccagcagcacaggctcttccgggtgctggagacccctgtgattgacaacatccgctggtgcctggacatggccctgagcaggcctgtgacagccctggacaatgaacgcttcaccgtgcagagcgtgatgctgcactatgctgtgcctgtggtgctggccggcttcctgatcaccaatgccctgcgcttcatcttcagcgcccctggggtgacctcctggcagtacaccctgctgcagctgcaggtgaatggagtgctgcccatcctgcccctgctcttccctgtgctgtgggtgctggccacagcctgtggggaggcccgggtgctggcccagatgagcaaggccagccccagcagcctgctggccaagttcagcgaggacaccctgagcagctacacagaggccgtgagcagccaggagatgctgcgctgcatctggggccacttcctgcgggtgctgggcggcaccagccccaccctgagccacagcagcagcctgctgcacagcctgggctctgtgacagtgctgtgctgcgtggacaagcagggcatcctgtcctggcccaaccccagccctgagaccgtgctcttcttcagcggcaaggtggagcccccccacagcagccatgaggacctgacagatggcctgagcaccaggagcttctgccaccctgagccccatgaaagagatgccctgctggccggcagcctgaacaacaccctgcacctgagcaatgagcaggagcggggggactggccaggagaggcccccaagcccccagagccctacagccaccacaaggcccacggccgcagcaagcaccccagcggcagcaatgtgtccttcagccgggacacagaaggaggagaggaggagcccagcaagacccagcccggcatggagagtgacccctatgaagcagaagattttgtgtgtgactaccacctggagatgctgagcctgagccaggaccagcagaaccccagctgcatccagtttgatgacagcaactggcagctgcacctgaccagcctgaagcccctgggcctgaatgtgctgctgaacctgtgtgatgcctctgtgacagagcggctgtgccgcttcagtgaccacctgtgcaacatcgccctgcaggagagccacagcgctgtgctgcctgtgcacgtgccctggggcctgtgtgagctggcccggctgattggcttcacccctggggccaaggagctgttcaagcaggagaaccacctggccctgtaccgcctgcccagcgctgagaccatgaaggagaccagcctgggccgcctgagctgtgtgaccaagaggcggccccccctgagccacatgatcagcctcttcatcaaggacaccaccaccagcacagagcagatgctgagccatggaacagcagatgtggtgctggaggcctgcacagacttctgggatggagctgacatctaccccctgagcggcagtgacaggaagaaggtgctggacttctaccagagggcctgcctgagcggctactgcagcgcctttgcctacaagcccatgaactgtgccctgagcagccagctgaatggaaaatgtattgagctggtgcaggtgcccggccagagcagcatcttcaccatgtgtgagctgcccagcaccatccccatcaagcagaatgcccggcgcagctcctggagcagtgatgagggcattggagaggtgctggagaaggaggactgcatgcaggccctgagcggccagatcttcatgggcatggtgagcagccagtaccaggcccggctggacatcgtgcggctgattgatggcctggtgaatgcctgcatccgctttgtgtacttcagcctggaggatgagctgaagagcaaggtgtttgctgagaagatgggcctggagaccggctggaactgccacatcagcctgacccccaacggggacatgcctggcagcgagatcccccccagcagccccagccacgccggcagcctgcatgatgacctgaaccaggtgtccagagatgatgctgagggcctgctgctgatggaggaggagggccacagcgacctgatctccttccagcccacagacagcgacatccccagcttcctggaggacagcaacagagccaagctgccccggggcatccaccaggtgcggccccacctgcagaacatcgacaacgtgcccctgctggtgcccctcttcacagactgcaccccagagaccatgtgtgagatgatcaagatcatgcaggagtatggagaggtgacctgctgcctgggcagcagcgccaacctgaggaacagctgcctcttcctgcagagcgacatcagcatcgccctggaccccctgtaccccagccgctgctcctgggagaccttcggctacgccaccagcatctccatggcccaggccagtgatggcctgagccccctgcagctgagcggccagctgaacagcctgccctgcagcctgaccttccggcaggaggagaccatcagcatcatccggctgattgagcaggcccggcatgccacctacggcatcaggaagtgcttcctgttcctgctgcagtgccagctgaccctggtggtgatccagttcctgagctgcctggtgcagctgccccccctgctgagcaccacagacatcctgtggctgagctgcttctgctaccccctgctgagcatcagcctgctgggcaagccaccccacagcagcatcatgtccatggccaccgggaagaacctgcagagcatccccaagaagacccagcactacttcctgctgtgcttcctgctgaagttcagcctgaccatcagcagctgcctgatctgcttcggcttcaccctgcagagcttctgtgacagcagccgggacaggaacctgaccaactgcagctctgtgatgctgcccagcaatgatgaccgggccccagcctggtttgaagattttgccaacggcctgctgagcgcccagaagctgacagctgccctgattgtgctgcacacagtgttcatcagcatcacccacgtgcacaggaccaagcccctgtggaggaagagccccctgaccaacctgtggtgggccgtgacagtgcctgtggtgctgctgggccaggtggtgcagacagctgtggacctgcagctgtggacccaccgggacagccacgtgcacttcggcctggaggatgtgcccctgctgacctggctgctgggctgcctgagcctggtgctggtggtggtgaccaatgagatcgtgaagctgcacgagatccgggtgcgggtgcgctaccagaagaggcagaagctgcagtttgagaccaagctgggcatgaacagccccttctag

SEQ ID NO: 37135 - DNA, 2004 bp, Artificial Sequence
  Description of Artificial Sequence: Synthetic coding sequence
atgtggctgcagcagaggctgaagggcctgcccggcctgctgagcagctcctgggcccggcggctgctgtgcctgctgggcctgctgctgctgctgctgtggtttggaggcagcggggccaggagagctgctgggggcctgcacctgctgccctggagcagaggagagcctggagctgctgagcccagcgcctgcctggaggccgccacccgggcctggaggggcctgcgggagcggggggaggtggtgcccctgggccctggggtgcctgccctggtggccaacggcttcctggccctggatgtggccgccaaccggctgtgggtgaccccaggagagcgggagcctgctgtggccccagactttgtgccctttgtgcagctgcggcccctgagcgccctggccgaggccggggaggccgtgctgctgctgcgggagggcctgctgcggcgggtgcgctgcctgcagctgggcagccctggccctggccctgtggccgccggccctggccctgcctctgtgtctggcctggccgccggcagcggccgggactgtgtgctgctgcaggaggacttcctggcccaccggggccggccccacgtgtacctgcagaggatccagctgaacaaccccacagagcgggtggccgccctgcagacagtgggccccacagctggccctgcccccaaggccttcaccagcaccctggagaaggtgggggaccaccagttcctgctgtacagcggccgcagcccccccacccccaccggcctggtgcacctggtggtggtggccgccaagaagctggtgaaccggctgcaggtggcccccaagacccagctggatgagaccgtgctgtgggtggtgcacgtgtctggccccatcaacccccaggtgctgaagagcaaggccgccaaggagctgaaggccctgcaggacctggccaggaaggagatgctggagctgctggacatgcctgctgctgagctgctgcaggaccaccagctgctgtgggcccagctgttcagccctggggtggagatgaagaagatcacagacacccacacccccagcggcctgactgtgaacctgaccctgtactacatgctgagctgcagccctgcccccctgctgagccccagcctgagccaccgggagcgggaccagatggagagcaccctgaactatgaggaccactgcttcagcggccacgccaccatgcatgctgagaacctgtggccaggccgcctgagctctgtgcagcagatcctgcagctgagtgacctgtggaggctgaccctgcagaagaggggctgcaagggcctggtgaaggtgggcgcccctggcatcctgcagggcatggtgctgagctttggaggcctgcagttcacagagaaccacctgcagttccaggccgaccctgatgtgctgcacaacagctatgccctgcacggcatccgctacaagaatgaccacatcaacctggccgtgctggctgatgctgagggcaagccctacctgcacgtgtctgtggagagccggggccagcctgtgaagatctatgcctgcaaggccggctgcctggatgagcctgtggagctgaccagcgcccccaccggccacaccttctctgtgatggtgacccagcccatcacccccctgctgtacatcagcacagacctgacccacctgcaggacctgcggcacaccctgcacctgaaggccatcctggcccatgatgagcacatggcccagcaggaccccggcctgcccttcctgttctggttctctgtggccagcctcatcaccctcttccacctgttcctgttcaagctgatctacaatgagtactgcggccctggggccaagcccctcttccgcagcaaggtgggcagccgccacctggtggagacccggggcctgggcctggccctgagccctgtgtccaggaagggcctggcctggaggggcggcgtgcggcccggccaggagtgggtgtcctag

SEQ ID NO: 37136 - DNA, 483 bp, Artificial Sequence
  Description of Artificial Sequence: Synthetic coding sequence
ttcctgcctgacaacttcagccctgccaagcccaagcccagcaaggacctgaagcccctgctgggcagcgctgtgctgggcctgctgctggtgctggccgctgtggtggcctggtgctactacagcgtgtccctgaggaaggccgagcggctgcgggcagagctgctggacctgaaggccggcggcttcagcatccggaaccagaagggggagcaggagccccagccctttgtgaccagtgatgtgtacagcagtgatgctgcctttggaggcatcctggagcgctactggctgagcagcagagctgctgccatcaaggtgaatgacagcgtgcccttccacctgggctggaacagcacagagaggagcctgcggctgcaggcccgctaccatgacaccccctacaagcccccagctggccgggctgctgcccctgagctgagctacagagtgtgtgtgggcagtgatgtgaccagcatctag

SEQ ID NO: 37137 - DNA, 3261 bp, Artificial Sequence
  Description of Artificial Sequence: Synthetic coding sequence
atgattgctgtgtccacagccaacggctacatcctcttcttccacatcaccagcaccaggggggacaagtacctgtatgagcctgtgtaccccaagggcagcccccagatgaagggcaccccccacttcaaggaggagcagtgtgccccagccctgaacctggagatgaggaagatcctggacctgcaggcccccatcatgagcctgcagagcgtgctggaggacctgctggtggccaccagtgatggcctgctgcacctgatccactgggagggcatgaccaatggaaggaaggccatcaacctgtgcaccgtgcccttctctgtggacctgcagagcagccgggtgggcagcttcctgggcttcacagatgtgcacatccgggacatggagtactgtgccaccctggatggctttgctgtggtgttcaatgatggcaaggtgggcttcatcacccctgtgagcagccgcttcaccgctgagcagctgcacggcgtgtggccccaggatgtggtggatggcacctgtgtggccgtgaacaacaagtaccgcctgatggccttcggctgtgtgtctggctctgtgcaggtgtacaccatcgacaacagcactggagccatgctgctgagccacaagctggagctgacagccaagcagtacccagacatctggaacaagacaggagctgtgaagctgatgcgctggagcccagacaacagcgtggtgattgtgacctgggagtatggaggcctgagcctgtggagcgtgtttggagcccagctgatctgcaccctgggcggggactttgcctacagaagtgatggcaccaagaaggaccccctgaagatcaacagcatgtcctggggcgctgagggctaccacctgtgggtgatcagcggcttcggcagccagaacacagaaattgaaagtgacctgcggtctgtggtgaagcagcccagcatcctgctcttccagttcatcaagtctgtgctgactgtgaacccctgcatgagcaaccaggagcaggtgctgctgcagggcgaggaccggctgtacctgaactgtggggaggccagccagacccagaaccccaggagcagcagcacccacagcgagcacaagcccagccgggagaagagcccctttgctgatggcggcctggagagccagggcctgagcaccctgctgggccaccgccactggcacgtggtgcagatcagcagcacctacctggagagcaactggcccatccgcttcagcgccatcgacaagctgggccagaacattgctgtggtgggcaagtttggatttgcccactacagcctgctgaccaagaagtggaagctgtttggaaacatcacccaggagcagaacatgattgtgactggaggcctggcctggtggaatgacttcatggtgctggcctgctacaacatcaatgaccggcaggaggagctgcgggtgtacctgcggaccagcaacctggacaatgcctttgcccacgtgaccaaggcccaggccgagaccctgctgctgtctgtgttccaggacatggtgattgtgttccgggctgactgcagcatctgcctgtacagcattgaaaggaagagtgatggccccaacaccacagctggcatccaggtgctgcaggaggtgtccatgagccgctacatcccccaccccttcctggtggtgtctgtgaccctgacctctgtgtccacagaaaatggcatcaccctgaagatgccccagcaggcccggggagctgagagcatcatgctgaacctggccggccagctgatcatgatgcagagggacaggagcggcccccagatccgggagaaggacagcaaccccaacaaccagaggaagctgctgcccttctgcccccctgtggtgctggcccagagcgtggagaatgtgtggaccacctgccgggccaacaagcagaagaggcacctgctggaggccctgtggctgagctgtggcggggccggcatgaaggtgtggctgcccctcttcccccgggaccacaggaagccccacagcttcctgagccagaggatcatgctgcccttccacatcaacatctaccccctggccgtgctgtttgaagatgccctggtgctgggcgctgtgaatgacaccctgctgtatgacagcctgtacaccagaaataatgcccgggagcagctggaggtgctcttccccttctgtgtggtggagaggaccagccagatctacctgcaccacatcctgcggcagctgctggtgaggaacctgggggagcaggccctgctgctggcccagagctgtgccaccctgccctacttcccccacgtgctggagctgatgctgcacgaggtgctggaggaggaggccaccagccgggagcccatcccagaccccctgctgcccaccgtggccaagttcatcacagagttccccctcttcctgcagacagtggtgcactgtgccaggaagacagaatatgccctgtggaactacctgtttgctgctgtgggcaaccccaaggacctgtttgaggagtgcctgatggcccaggacctggacacagctgccagctacctgatcatcctgcagaacatggaggtgcctgctgtgtcccggcagcacgccaccctgctcttcaacacagccctggagcagggcaagtgggacctgtgccgccacatgatccgcttcctgaaggccatcggcagcggggagagcgagaccccacccagcacccccacagcccaggagcccagcagcagcggcggctttgagttcttcaggaacagaagcatcagcctgagccagagcgcagaaaatgtgcctgccagcaagttcagcctgcagaagaccctgtccatgcccagcggccccagcggcaagcgctggagcaaggacagcgactgtgccgagaacatgtacatcgacatgatgctgtggaggcatgcccggcggctgctggaggatgtgcggctgaaggacctgggctgctttgctgcccagctgggctttgagctgatctcctggctgtgcaaggagaggacccgggccgcccgggtggacaacttcgtcatcgccctgaagaggctgcacaaggacttcctgtggcccctgcccatcatcccagccagcagcatcagcagccccttcaagaatggcaagtacagaactggaaatgtggacttcatgagcctggtgcagggcgagctgtacttcaccccctgcatctacaccttctgctactag

SEQ ID NO: 37138 - DNA, 1335 bp, Artificial Sequence
  Description of Artificial Sequence: Synthetic coding sequence
atggcccccagcagccgctgggatgccatgggccccaagaacagctacagatctgtgcacggcagaattgtgcctgagctgctggagagctctgtggcccgggtgcggcccctgcagtatgtgcagaggcagcccagccaggccagcgcccggagcggggccaaccccacccaccggcccagcgctgaggtgcggcctgtgatcagaactggagagatgacccacagcagcgtcatcccccccctggcccctggggtgagaagagtgtccctgggctatgagagcagccccagcggcagcctgcccccactcttcaaccaggagagcccctggaggcggcaggacagctacagcccccagaacccagctgtgagccacaaggccagcctgaacagcaccatcctgcagggccctgcagatgctggggtggtgggcggccagagctggaacagagcctgggagcccgcccggggagctgcctcctgggacacctggaggaacaaggctgtggtgcccccccggcgcagcggggagcccatggtgtccatgcaggccgctgaggagatccgcatcctggccgtcatcaccatccaggccggcgtgcggggctacctggcccggcggcgcatccggctgtggcacagaggagccatggtgatccaggccacctggaggggctacagagtgagaagaaacctggcccacctgtgccgggccaccaccaccatccagagcgcctggaggggctacagcacccggcgggaccaggcccggcactggcagatgctgcaccctgtgacctgggtggagctgggcagcagagctggggtgatgtctgaccgctcctggttccaggacggccgggccaggacagtgtctgaccaccgctgcttccagagctgccaggcccacgcctgcagcgtgtgccacagcctgagcagccgcatcggcagccccccatctgtggtgatgctggtgggcagcagccccaggacctgccacacctgtggccgcacccagcccaccagggtggtgcagggcatgggccagggcacagagggccctggagctgtgtcctgggccagcgcctaccagctggccgccctgagcccccggcagccccaccggcaggacaaggccgccacagccatccagagcgcctggaggggcttcaagatccggcagcagatgaggcagcagcagatggccgccaagatcgtgcaggccacctggaggggccaccacaccaggagctgcctgaagaacacagaggccctgctgggccctgctgaccccagcgccagcagccgccacatgcactggccaggcatctag

SEQ ID NO: 37139 - DNA, 4104 bp, Artificial Sequence
  Description of Artificial Sequence: Synthetic coding sequence
atgaccctgcagggccgggctgacctgagcggcaaccagggcaatgctgctggccgcctggccaccgtgcatgagcctgtggtgacccagtgggccgtgcaccccccagccccagcccaccccagcctgctggacaagatggagaaggccccaccccagccccagcacgagggcctgaagagcaaggagcacctgccccagcagcctgctgagggcaagacagccagcagaagagtgccccggctgcgggctgtggtggagagccaggccttcaagaacatcctggtggatgagatggacatgatgcacgcccgggccgccaccctcatccaggccaactggaggggctactggctgcggcagaagctgatcagccagatgatggccgccaaggccatccaggaggcctggaggcgcttcaacaagaggcacatcctgcacagcagcaagagcctggtgaagaagaccagggctgaggagggggacatcccctaccacgccccccagcaggtgcgcttccagcaccctgaggagaaccggctgctgagcccccccatcatggtgaacaaggagacccagttccccagctgtgacaacctggtgctgtgccggccccagagcagccccctgctgcagcccccagctgcccagggcaccccagagccctgtgtgcagggcccccatgctgcccgggtgcggggcctggccttcctgccccaccagacagtgaccatccgcttcccctgccctgtgtccctggatgccaagtgccagccctgcctgctgaccaggaccatccgcagcacctgcctggtgcacatcgagggggacagcgtgaagaccaagagggtgtctgcccggaccaacaaggcccgggcccctgagacccccctgagccgccgctatgaccaggccgtgacccggcccagccgggcccagacccagggccctgtgaaggccgagacccccaaggcccccttccagatctgccccggccccatgatcaccaagaccctgctgcagacctaccctgtggtgtctgtgaccctgccccagacctacccagccagcaccatgaccaccaccccacccaagaccagccctgtgcccaaggtgaccatcatcaagaccccagcccagatgtacccaggccccaccgtgaccaagacagccccccacacctgccccatgcccaccatgaccaagatccaggtgcaccccacagccagcaggacaggcaccccccggcagacctgcccagccaccatcacagccaagaaccggccccaggtgtccctgctggccagcatcatgaagagcctgccccaggtgtgccccggccctgccatggccaagaccccaccccagatgcaccctgtgaccaccccagccaagaaccccctgcagacctgcctgagcgccaccatgagcaagaccagcagccagaggagccctgtgggcgtgaccaagcccagcccccagacccggctgcctgccatgatcaccaagaccccagcccagctgcggtctgtggccaccatcctgaagaccctgtgcctggccagccccaccgtggccaacgtgaaggccccaccccaggtggccgtggccgccggcacccccaacaccagcggcagcatccatgaaaatccacccaaggccaaggccaccgtgaatgtgaagcaggccgccaaggtggtgaaggccagcagccccagctacctggccgagggcaagatccgctgcctggcccagccccaccctggcaccggggtgcccagggctgctgctgagctgcccctggaggccgagaagatcaagacaggcacccagaagcaggccaagacagacatggccttcaagacctctgtggccgtggagatggccggggcccccagctggaccaaggtggccgaggagggggacaagccaccccacgtgtatgtgcctgtggacatggctgtgaccctgccccggggccagctggccgcccccctgaccaatgccagcagccagaggcaccccccctgcctgagccagaggcccctggccgcccccctgaccaaggccagcagccagggccacctgcccacagagctgaccaagacccccagcctggcccacctggacacctgcctgagcaagatgcacagccagacccacctggccaccggggctgtgaaggtgcagagccaggcccccctggccacctgcctgaccaagacccagagccggggccagcccatcacagacatcaccacctgcctgatcccagcccaccaggccgctgacctgagcagcaacacccacagccaggtgctgctgaccggcagcaaggtgagcaaccacgcctgccagaggctgggcggcctgagcgccccaccctgggccaagccagaggaccggcagacccagccccagccccacggccacgtgcctgggaagaccacccagggcggcccctgcccagctgcctgtgaggtgcagggcatgctggtgccccccatggcccccaccggccacagcacctgcaatgtggagagctggggagacaacggggccacccgggcccagcccagcatgcctggccaggccgtgccctgccaggaggacacagtgggcagcctgctggccagcctgtgtgccgaggtggccggcgtgctggccagccaggaggacctgcggaccctgctggccaaggccctgagccagggcgaggtgtgggccgccctgaaccaggccctgagcaaggaggtgctgggcgccaccgtgaccaaggccctgccccagagcatgctgtccatggccctggtgaaggccctgtcctggagcgagctgcggctgaccctgagccgggccctgagcagaggagagctgcgggcagagctgaccaaggtgatgcagggcaagctggccgaggtgctgagcaaggccctgacagaggaggagtgggtggccctgagccaggccctgtgccagggcgagctgggcgccctgctgagccagagctggtgccgggtggccctgaggacaggcaccatcctgcccaaggccgccagcaagagcactggaagtggagtgaccaagaccccagccctggtgaaggtggcctgcagaagaagccccagcgctgcctggggccccagcctgggccctgtgcggccccagaccagcaaaggaccagcagatgctggggtggtgggcggccagagctggaacagagcctgggagcccgcccggggggccgcctcctgggacacctggaggaacaaggctgtggtgcccccaagaagaagtggagagcccatggtgtccatgcaggccgctgaggagatccgcatcctggccgtcatcaccatccaggccggcgtgcggggctacctggcccggcggcgcatccggctgtggcacagaggagccatggtgatccaggccacctggaggggctacagagtgagaagaaacctggcccacctgtgccgggccaccaccaccatccagagcgcctggaggggctacagcacccggcgggaccaggcccggcactggcagatgctgcaccctgtgacctgggtggagctgggcagccgggccggcgtgatgtctgaccgctcctggttccaggacggccgggccaggacagtgtctgaccaccgctgcttccagagctgccaggcccacgcctgcagcgtgtgccacagcctgagcagcagaattggcagcccccccagcgtggtgatgctggtgggcagcagccccaggacctgccacacctgtggccgcacccagcccaccagggtggtgcagggcatgggccagggcacagagggccctggagctgtgtcctgggccagcgcctaccagctggccgccctgagcccccggcagccccaccggcaggacaaggccgccacagccatccagagcgcctggaggggcttcaagatccggcagcagatgaggcagcagcagatggccgccaagatcgtgcaggccacctggaggggccaccacaccaggagctgcctgaagaacacagaggccctgctgggccctgctgaccccagcgccagcagccgccacatgcactggccaggcatctag

SEQ ID NO: 37140 - DNA, 4833 bp, Artificial Sequence
  Description of Artificial Sequence: Synthetic coding sequence
atggccggcctgcggcggccccagcccggctgctactgcaggacagctgctgctgtgaacctgctgctgggcgtcttccaggtgctgctgccctgctgcaggcctggaggagcccagggccaggccatcgagcccctgcccaacgtggtggagctgtggcaggccgaggagggggagctgctgctgcccacccagggcgacagcgaggagggcctggaggagcccagccaggagcagagcttcagtgacaagctgttcagcggcaagggcctgcacttccagcccagcgtgctggactttggcatccagttcctgggccaccctgtggccaagatcctgcacgcctacaaccccagccgggacagcgaggtggtggtgaacagcgtgtttgctgctgctggccacttccacgtgccccctgtgccctgcagggtcatcccagccatgggcaagaccagcttccgcatcatcttcctgcccacagaggagggcagcattgagagcagcctcttcatcaacaccagcagctatggagtgctgagctaccacgtgtctggaattggcacccggcgcatcagcacagagggcagcgccaagcagctgcccaatgcctacttcctgctgcccaaggtgcagagcatccagctgagccagatgcaggccgagaccaccaacaccagcctgctgcaggtgcagctggagtgcagcctgcacaacaaggtgtgccagcagctgaagggctgctacctggagagtgatgatgtgctgcggctgcagatgagcatcatggtgaccatggagaacttcagcaaggagtttgaggagaacacccagcacctgctggaccacctgagcatcgtgtatgtggccacagatgagagcgagaccagtgatgacagcgctgtgaacatgtacatcctgcacagcggcaacagcctcatctggatccaggacatccgccacttcagccagagagatgccctgagcctgcagtttgagcctgtgctgctgcccaccagcaccaccaacttcaccaagatcgccagcttcacctgcaaggccgccaccagctgtgacagcggcatcattgaagatgtgaagaagaccacccacacccccaccctgaaggcctgcctcttcagctctgtggcccagggctacttcaggatggacagcagcgccacccagttccacatcgagacccatgagaacaccagcggcctgtggagcatctggtacagaaaccactttgacagatctgtggtgctgaatgatgtgttcctgagcaaggagaccaagcacatgctgaagatcctgaacttcaccggccccctcttcctgcccccaggctgctggaacatcttcagcctgaagctggccgtgaaggacatcgccatcaacctcttcaccaacgtgttcctgaccaccaacatcggggccatctttgccatccccctgcagatctacagcgcccccaccaaggagggcagcctgggctttgaggtgattgcccactgcggcatgcactacttcatgggcaagagcaaggccggcaaccccaactggaatggcagcctgagcctggaccagagcacctggaatgtggacagcgagctggccaacaagctgtatgagcgctggaagaagtacaagaatggagatgtgtgcaagagaaatgtgctgggcaccaccaggtttgcccacctgaagaagagcaaggagagcgagagctttgtgttcttcctgccccggctgattgctgagcccggcctgatgctgaacttcagcgccacagccctgcggagcaggatgatcaagtactttgtggtgcagaaccccagctcctggcctgtgtccctgcagctgctgcccctgagcctgtaccccaagccagaggccctggtgcacctgctgcaccgctggtttggaacagacatgcagatgatcaacttcaccactggagagttccagctgacagaggcctgcccctacctgggcacccacagcgaggagagccgcttcggcatcctgcacctgcacctgcagcccctggagatgaagagggtgggcgtggtgttcaccccagctgactatggcaaggtgaccagcctcatcctgatccggaacaacctgaccgtcatcgacatgattggagtggagggctttggagcccgggagctgctgaaggtgggcggccgcctgcctggagctgggggcagcctgcgcttcaaggtgcctgagagcaccctgatggactgccggcggcagctgaaggacagcaagcagatcctgagcatcaccaagaacttcaaggtggagaacatcggccccctgcccatcaccgtgagcagcctgaagatcaatggctacaactgccagggctacggctttgaggtgctggactgccaccagttcagcctggaccccaacaccagccgggacatcagcatcgtgttcaccccagacttcaccagctcctgggtgatccgggacctgagcctggtgacagctgctgacctggagttccgcttcaccctgaatgtgaccctgccccaccacctgctgcccctgtgtgctgatgtggtgcccggccccagctgggaggagagcttctggaggctgactgtgttctttgtgtccctgagcctgctgggcgtcatcctgattgccttccagcaggcccagtacatcctgatggagttcatgaagacccggcagaggcagaatgccagcagcagcagccagcagaacaacggccccatggatgtgatcagcccccacagctacaagagcaactgcaagaacttcctggacacctacggccccagcgacaagggccggggcaagaactgcctgcctgtgaacaccccccagagccgcatccagaatgctgccaagaggagccctgccacctacggccacagccagaagaagcacaagtgcagcgtgtactacagcaagcacaagaccagcacagctgctgccagcagcaccagcaccaccacagaggagaagcagaccagccccctgggcagcagcctgcctgctgccaaggaggacatctgcacagatgccatgagggagaactggatcagcctgcgctatgccagcggcatcaacgtgaacctgcagaagaacctgaccctgcccaagaacctgctgaacaaggaggagaacaccctgaagaacaccatcgtgttcagcaaccccagcagtgaatgttccatgaaggagggcatccagacctgcatgttccccaaggagacagacatcaagaccagtgaaaatacagctgagttcaaggagcgggagctgtgccccctgaagaccagcaagaagctgcctgagaaccacctgcccaggaacagcccccagtaccaccagcctgacctgcctgagatcagcaggaagaacaatggaaacaaccagcaggtgcctgtgaagaatgaggtggaccactgtgagaacctgaagaaggtggacaccaagcccagcagcgagaagaagatccacaagaccagccgggaggacatgttcagcgagaagcaggacatcccctttgtggagcaggaggacccctacaggaagaagaagctgcaggagaagcgggagggcaacctgcagaacctgaactggagcaagagcaggacctgcaggaagaacaagaagaggggcgtggcccctgtgtcccggcccccagagcagagcgacctgaagctggtgtgcagcgactttgagaggtctgagctgagcagtgacatcaacgtgcgctcctggtgcatccaggagagcacccgggaggtgtgcaaggcagatgctgagatcgccagcagcctgcctgctgcccagcgggaggccgagggctactaccagaagccagagaagaagtgtgtggacaagttctgcagcgacagcagcagtgactgtggcagcagcagcggctctgtgcgggccagccggggctcctggggctcctggagcagcaccagcagcagtgatggagacaagaagcccatggtggatgcccagcacttcctgcctgctggggacagcgtgtcccagaatgacttccccagcgaggcccccatcagcctgaacctgagccacaacatctgcaaccccatgacagtgaacagcctgccccagtatgcagagcccagctgccccagcctgcctgctggccccaccggggtggaggaggacaagggcctgtacagccctggggacctgtggcccaccccacctgtgtgtgtgaccagcagcctgaactgcaccctggagaatggagtgccctgcgtcatccaggagagcgcccctgtgcacaacagcttcatcgactggagcgccacctgtgagggccagttcagcagcgcctactgccccctggagctgaatgactacaatgccttccctgaggagaacatgaactatgccaacggcttcccctgcccagcagatgtgcagacagacttcatcgaccacaacagccagagcacctggaacaccccacccaacatgcctgctgcctggggccacgccagcttcatcagcagccccccctacctgaccagcaccaggagcctgagccccatgagcggcctgtttggcagcatctgggccccccagagtgatgtgtatgagaactgctgccccatcaaccccaccacagagcacagcacccacatggagaaccaggccgtggtgtgcaaggagtactacccaggcttcaaccccttccgggcctacatgaacctggacatctggaccaccacagccaacagaaatgccaacttccccctgagccgggacagcagctactgtggaaatgtgtag

SEQ ID NO: 37141 - DNA, 2385 bp, Artificial Sequence
  Description of Artificial Sequence: Synthetic coding sequence
atgaccctgcagggccgggctgacctgagcggcaaccagggcaatgctgctggccgcctggccaccgtgcatgagcctgtggtgacccagtgggccgtgcaccccccagccccagcccaccccagcctgctggacaagatggagaaggccccaccccagccccagcacgagggcctgaagagcaaggagcacctgccccagcagcctgctgagggcaagacagccagcagaagagtgccccggctgcgggctgtggtggagagccaggccttcaagaacatcctggtggatgagatggacatgatgcacgcccgggccgccaccctcatccaggccaactggaggggctactggctgcggcagaagctgatcagccagatgatggccgccaaggccatccaggaggcctggaggcgcttcaacaagaggcacatcctgcacagcagcaagagcctggtgaagaagaccagggctgaggagggggacatcccctaccacgccccccagcaggtgcgcttccagcaccctgaggagaaccggctgctgagcccccccatcatggtgaacaaggagacccagttccccagctgtgacaacctggtgctgtgccggccccagagcagccccctgctgcagcccccagctgcccagggcaccccagagccctgtgtgcagggcccccatgctgcccgggtgcggggcctggccttcctgccccaccagacagtgaccatccgcttcccctgccctgtgtccctggatgccaagtgccagccctgcctgctgaccaggaccatccgcagcacctgcctggtgcacatcgagggggacagcgtgaagaccaatgccagcagccagaggcaccccccctgcctgagccagaggcccctggccgcccccctgaccaaggccagcagccagggccacctgcccacagagctgaccaagacccccagcctggcccacctggacacctgcctgagcaagatgcacagccagacccacctggccaccggggctgtgaaggtgcagagccaggcccccctggccacctgcctgaccaagacccagagccggggccagcccatcacagacatcaccacctgcctgatcccagcccaccaggccgctgacctgagcagcaacacccacagccaggtgctgctgaccggcagcaaggtgagcaaccacgcctgccagaggctgggcggcctgagcgccccaccctgggccaagccagaggaccggcagacccagccccagccccacggccacgtgcctgggaagaccacccagggcggcccctgcccagctgcctgtgaggtgcagggcatgctggtgccccccatggcccccaccggccacagcacctgcaatgtggagagctggggagacaacggggccacccgggcccagcccagcatgcctggccaggccgtgccctgccaggaggacaccggccctgcagatgctggggtggtgggcggccagagctggaacagagcctgggagcccgcccggggagctgcctcctgggacacctggaggaacaaggctgtggtgcccccccggcgcagcggggagcccatggtgtccatgcaggccgctgaggagatccgcatcctggccgtcatcaccatccaggccggcgtgcggggctacctggcccggcggcgcatccggctgtggcacagaggagccatggtgatccaggccacctggaggggctacagagtgagaagaaacctggcccacctgtgccgggccaccaccaccatccagagcgcctggaggggctacagcacccggcgggaccaggcccggcactggcagatgctgcaccctgtgacctgggtggagctgggcagcagagctggggtgatgtctgaccgctcctggttccaggacggccgggccaggacagtgtctgaccaccgctgcttccagagctgccaggcccacgcctgcagcgtgtgccacagcctgagcagccgcatcggcagccccccatctgtggtgatgctggtgggcagcagccccaggacctgccacacctgtggccgcacccagcccaccagggtggtgcagggcatgggccagggcacagagggccctggagctgtgtcctgggccagcgcctaccagctggccgccctgagcccccggcagccccaccggcaggacaaggccgccacagccatccagagcgcctggaggggcttcaagatccggcagcagatgaggcagcagcagatggccgccaagatcgtgcaggccacctggaggggccaccacaccaggagctgcctgaagaacacagaggccctgctgggccctgctgaccccagcgccagcagccgccacatgcactggccaggcatctag

SEQ ID NO: 37142 - DNA, 4272 bp, Artificial Sequence
  Description of Artificial Sequence: Synthetic coding sequence
atgtacttcctgagcggctggcccaagaggctgctgtgccccctgggcagccctgctgaggcccccttccacgtgcagagcgacccccagagggccttctttgctgtgctggccgccgcccggctgagcatctggtacagccggcccagcgtgctgattgtgacctacaaggagcccgccaagagcagcacccagtttggcagctacaagcaggccgagtggaggccagacagcaccatgattgctgtgtccacagccaacggctacatcctcttcttccacatcaccagcaccaggggggacaagtacctgtatgagcctgtgtaccccaagggcagcccccagatgaagggcaccccccacttcaaggaggagcagtgtgccccagccctgaacctggagatgaggaagatcctggacctgcaggcccccatcatgagcctgcagagcgtgctggaggacctgctggtggccaccagtgatggcctgctgcacctgatccactgggagggcatgaccaacggcaggaaggccatcaacctgtgcaccgtgcccttctctgtggacctgcagagcagccgggtgggcagcttcctgggcttcacagatgtgcacatccgggacatggagtactgtgccaccctggatggctttgctgtggtgttcaatgatggcaaggtgggcttcatcacccctgtgagcagccgcttcaccgctgagcagctgcatggagtgtggccccaggatgtggtggatggcacctgtgtggccgtgaacaacaagtaccgcctgatggccttcggctgtgtgtctggctctgtgcaggtgtacaccatcgacaacagcactggagccatgctgctgagccacaagctggagctgacagccaagcagtacccagacatctggaacaagacaggagctgtgaagctgatgcgctggagcccagacaacagcgtggtgattgtgacctgggagtatggaggcctgagcctgtggagcgtgtttggagcccagctgatctgcaccctgggcggggactttgcctacagaagtgatggcaccaagaaggaccccctgaagatcaacagcatgtcctggggcgctgagggctaccacctgtgggtgatcagcggcttcggcagccagaacacagaaattgaaagtgacctgcggtctgtggtgaagcagcccagcatcctgctcttccagttcatcaagtctgtgctgactgtgaacccctgcatgagcaaccaggagcaggtgctgctgcagggagaagatcggctgtacctgaactgtggggaggccagccagacccagaaccccaggagcagcagcacccacagcgagcacaagcccagccgggagaagagcccctttgctgatggcggcctggagagccagggcctgagcaccctgctgggccaccgccactggcacgtggtgcagatcagcagcacctacctggagagcaactggcccatccgcttcagcgccatcgacaagctgggccagaacattgctgtggtgggcaagtttggatttgcccactacagcctgctgaccaagaagtggaagctgtttggaaacatcacccaggagcagaacatgattgtgactggaggcctggcctggtggaatgacttcatggtgctggcctgctacaacatcaatgaccggcaggaggagctgcgggtgtacctgcggaccagcaacctggacaatgcctttgcccacgtgaccaaggcccaggccgagaccctgctgctgagcgtcttccaggacatggtgattgtgttccgggctgactgcagcatctgcctgtacagcattgaaaggaagagtgatggccccaacaccacagctggcatccaggtgctgcaggaggtgtccatgagccgctacatcccccaccccttcctggtggtgtctgtgaccctgacctctgtgtccacagaaaatggcatcaccctgaagatgccccagcaggcccggggagctgagagcatcatgctgaacctggccggccagctgatcatgatgcagagggacagaagtggcccccagatccgggagaaggacagcaaccccaacaaccagaggaagctgctgcccttctgcccccctgtggtgctggcccagagcgtggagaatgtgtggaccacctgccgggccaacaagcagaagaggcacctgctggaggccctgtggctgagctgtggcggggccggcatgaaggtgtggctgcccctcttcccccgggaccacaggaagccccacagcttcctgagccagaggatcatgctgcccttccacatcaacatctaccccctggccgtgctgtttgaagatgccctggtgctgggcgctgtgaatgacaccctgctgtatgacagcctgtacaccaggaacaatgcccgggagcagctggaggtgctcttccccttctgtgtggtggagaggaccagccagatctacctgcaccacatcctgcggcagctgctggtgaggaacctgggggagcaggccctgctgctggcccagagctgtgccaccctgccctacttcccccacgtgctggagctgatgctgcacgaggtgctggaggaggaggccaccagccgggagcccatcccagaccccctgctgcccaccgtggccaagttcatcacagagttccccctcttcctgcagacagtggtgcactgtgccaggaagacagaatatgccctgtggaactacctgtttgctgctgtgggcaaccccaaggacctgtttgaagaatgtctgatggcccaggacctggacacagctgccagctacctgatcatcctgcagaacatggaggtgcctgctgtgtcccggcagcacgccaccctgctcttcaacacagccctggagcagggcaagtgggacctgtgccgccacatgatccgcttcctgaaggccatcggcagcggggagagcgagaccccacccagcacccccacagcccaggagcccagcagcagcggcggctttgagttcttcaggaacagaagcatcagcctgagccagagcgcagaaaatgtgcctgccagcaagttcagcctgcagaagaccctgtccatgcccagcggccccagcggcaagcgctggagcaaggacagcgactgtgccgagaacatgtacatcgacatgatgctgtggaggcatgcccggcggctgctggaggatgtgcggctgaaggacctgggctgctttgctgcccagctgggctttgagctgatctcctggctgtgcaaggagaggaccagggctgcccgggtggacaactttgtgattgccctgaagaggctgcacaaggacttcctgtggcccctgcccatcatcccagccagcagcatcagcagccccttcaagaatggcaagtacagaacagtgggggagcagctgctgaagagccagagcgctgaccccttcctgaacctggagatggatgctggcatcagcaacatccagaggagccagagctggctgagcaacatcggccccacccaccacgagattgacacagccagcagccacggcccccagatgcaggatgccttcctgagccccctgagcaacaagggagatgagtgcagcatcggcagcgccacagacctgacagagagcagctccatggtggatggagactggaccatggtggatgagaacttcagcaccctgagcctgacccagagcgagctggagcacatctccatggagctggccagcaagggcccccacaagagccaggtgcagctgcgctacctgctgcacatcttcatggaggccggctgcctggactggtgcatcgtgattggcctcatcctgcgggagagcagcatcatcaaccagatcctggtgatcacccagagcagcgaggtggatggagagatgctgcagaacatcaagacaggcctgcatgctgtggaccgctgggccagcacagactgccccggctacaagcccttcctgaacatcatcaagccccagctgcagaagctgtctgagatcacagaggagcaggtgcagccagatgccttccagcccatcaccatgggcaagaccccagagcagaccagccccagggctgaggagagccggggcagcagcagccacggcagcatcccccagggcgaggtgggcagcagcaacatggtgtccaggaaggaggaggacacagcccaggccgaggaggaggagcccttccaggacggcacctatgactgcagcgtgtcctag

SEQ ID NO: 37143 - DNA, 4035 bp, Artificial Sequence
  Description of Artificial Sequence: Synthetic coding sequence
atgattgctgtgtccacagccaacggctacatcctcttcttccacatcaccagcaccaggggggacaagtacctgtatgagcctgtgtaccccaagggcagcccccagatgaagggcaccccccacttcaaggaggagcagtgtgccccagccctgaacctggagatgaggaagatcctggacctgcaggcccccatcatgagcctgcagagcgtgctggaggacctgctggtggccaccagtgatggcctgctgcacctgatccactgggagggcatgaccaatggaaggaaggccatcaacctgtgcaccgtgcccttctctgtggacctgcagagcagccgggtgggcagcttcctgggcttcacagatgtgcacatccgggacatggagtactgtgccaccctggatggctttgctgtggtgttcaatgatggcaaggtgggcttcatcacccctgtgagcagccgcttcaccgctgagcagctgcacggcgtgtggccccaggatgtggtggatggcacctgtgtggccgtgaacaacaagtaccgcctgatggccttcggctgtgtgtctggctctgtgcaggtgtacaccatcgacaacagcactggagccatgctgctgagccacaagctggagctgacagccaagcagtacccagacatctggaacaagacaggagctgtgaagctgatgcgctggagcccagacaacagcgtggtgattgtgacctgggagtatggaggcctgagcctgtggagcgtgtttggagcccagctgatctgcaccctgggcggggactttgcctacagaagtgatggcaccaagaaggaccccctgaagatcaacagcatgtcctggggcgctgagggctaccacctgtgggtgatcagcggcttcggcagccagaacacagaaattgaaagtgacctgcggtctgtggtgaagcagcccagcatcctgctcttccagttcatcaagtctgtgctgactgtgaacccctgcatgagcaaccaggagcaggtgctgctgcagggcgaggaccggctgtacctgaactgtggggaggccagccagacccagaaccccaggagcagcagcacccacagcgagcacaagcccagccgggagaagagcccctttgctgatggcggcctggagagccagggcctgagcaccctgctgggccaccgccactggcacgtggtgcagatcagcagcacctacctggagagcaactggcccatccgcttcagcgccatcgacaagctgggccagaacattgctgtggtgggcaagtttggatttgcccactacagcctgctgaccaagaagtggaagctgtttggaaacatcacccaggagcagaacatgattgtgactggaggcctggcctggtggaatgacttcatggtgctggcctgctacaacatcaatgaccggcaggaggagctgcgggtgtacctgcggaccagcaacctggacaatgcctttgcccacgtgaccaaggcccaggccgagaccctgctgctgtctgtgttccaggacatggtgattgtgttccgggctgactgcagcatctgcctgtacagcattgaaaggaagagtgatggccccaacaccacagctggcatccaggtgctgcaggaggtgtccatgagccgctacatcccccaccccttcctggtggtgtctgtgaccctgacctctgtgtccacagaaaatggcatcaccctgaagatgccccagcaggcccggggagctgagagcatcatgctgaacctggccggccagctgatcatgatgcagagggacaggagcggcccccagatccgggagaaggacagcaaccccaacaaccagaggaagctgctgcccttctgcccccctgtggtgctggcccagagcgtggagaatgtgtggaccacctgccgggccaacaagcagaagaggcacctgctggaggccctgtggctgagctgtggcggggccggcatgaaggtgtggctgcccctcttcccccgggaccacaggaagccccacagcttcctgagccagaggatcatgctgcccttccacatcaacatctaccccctggccgtgctgtttgaagatgccctggtgctgggcgctgtgaatgacaccctgctgtatgacagcctgtacaccagaaataatgcccgggagcagctggaggtgctcttccccttctgtgtggtggagaggaccagccagatctacctgcaccacatcctgcggcagctgctggtgaggaacctgggggagcaggccctgctgctggcccagagctgtgccaccctgccctacttcccccacgtgctggagctgatgctgcacgaggtgctggaggaggaggccaccagccgggagcccatcccagaccccctgctgcccaccgtggccaagttcatcacagagttccccctcttcctgcagacagtggtgcactgtgccaggaagacagaatatgccctgtggaactacctgtttgctgctgtgggcaaccccaaggacctgtttgaggagtgcctgatggcccaggacctggacacagctgccagctacctgatcatcctgcagaacatggaggtgcctgctgtgtcccggcagcacgccaccctgctcttcaacacagccctggagcagggcaagtgggacctgtgccgccacatgatccgcttcctgaaggccatcggcagcggggagagcgagaccccacccagcacccccacagcccaggagcccagcagcagcggcggctttgagttcttcaggaacagaagcatcagcctgagccagagcgcagaaaatgtgcctgccagcaagttcagcctgcagaagaccctgtccatgcccagcggccccagcggcaagcgctggagcaaggacagcgactgtgccgagaacatgtacatcgacatgatgctgtggaggcatgcccggcggctgctggaggatgtgcggctgaaggacctgggctgctttgctgcccagctgggctttgagctgatctcctggctgtgcaaggagaggacccgggccgcccgggtggacaacttcgtcatcgccctgaagaggctgcacaaggacttcctgtggcccctgcccatcatcccagccagcagcatcagcagccccttcaagaatggcaagtacagaacagtgggggagcagctgctgaagagccagagcgctgaccccttcctgaacctggagatggatgctggcatcagcaacatccagaggagccagagctggctgagcaacatcggccccacccaccatgaaattgacacagccagcagccacggcccccagatgcaggatgccttcctgagccccctgagcaacaagggagatgaatgttccatcggcagcgccacagacctgacagagagcagctccatggtggatggagactggaccatggtggatgagaacttcagcaccctgagcctgacccagagcgagctggagcacatctccatggagctggccagcaagggcccccacaagagccaggtgcagctgcgctacctgctgcacatcttcatggaggccggctgcctggactggtgcatcgtcatcggcctcatcctgcgggagagcagcatcatcaaccagatcctggtgatcacccagagcagcgaggtggatggagagatgctgcagaacatcaagacaggcctgcatgctgtggaccgctgggccagcacagactgccccggctacaagcccttcctgaacatcatcaagccccagctgcagaagctgtctgagatcacagaggagcaggtgcagccagatgccttccagcccatcaccatgggcaagaccccagagcagaccagccccagggctgaggagagccggggcagcagcagccacggcagcatcccccagggcgaggtgggcagcagcaacatggtgtccaggaaggaggaggacacagcccaggccgaggaggaggagcccttccaggacggcacctatgactgcagcgtgtcctag

SEQ ID NO: 37144 - DNA, 3081 bp, Artificial Sequence
  Description of Artificial Sequence: Synthetic coding sequence
atggagaagaggctgggcgtgaagcccaacccagcctcctggatcctgagcggctactactggcagaccagcgccaagtggctgcggagcctgtacctgttctacacctgcttctgcttctctgtgctgtggctgagcacagatgccagcgagagccgctgccagcagggcaagacccagtttggagtgggcctgcggtctggaggagagaaccacctgtggctgctggagggcacccccagcctgcagagctgctgggccgcctgctgccaggacagcgcctgccacgtgttctggtggctggagggcatgtgcatccaggccgactgcagccggccccagagctgccgggccttccgcacccacagcagcaacagcatgctggtgttcctgaagaagttccagacagcagatgacctgggcttcctgcctgaagatgatgtgccccacctgctgggcctgggctggaactgggcctcctggaggcagagccccccccgggccgccctgcggcctgctgtgagcagcagtgaccagcagagcctcatcaggaagctgcagaagaggggcagccccagtgatgtggtgacccccatcgtgacccagcacagcaaggtgaatgacagcaatgagctgggcggcctgaccaccagcggcagcgctgaggtgcacaaggccatcaccatcagcagccccctgaccacagacctgacagctgagctgagcggcggccccaagaatgtgtctgtgcagcctgagatcagcgagggcctggccaccacccccagcacccagcaggtgaagagcagcgagaagacccagattgctgtgccccagcctgtggcccccagctacagctatgccacccccaccccccaggccagcttccagagcaccagcgccccctaccctgtgatcaaggagctggtggtgtctgctggggagagcgtgcagatcaccctgcccaagaatgaggtgcagctgaatgcctacgtgctgcaggagccccccaagggggagacctacacctatgactggcagctgatcacccacccccgggactacagcggggagatggagggcaagcacagccagatcctgaagctgagcaagctgaccccaggcctgtatgagttcaaggtgattgtggagggccagaatgcccatggagagggctacgtgaatgtgacagtgaagccagagcccaggaagaacagaccacccatcgccatcgtgagcccccagttccaggagatcagcctgcccaccaccagcacagtgattgatggcagccagagcacagatgatgacaagatcgtgcagtaccactgggaggagctgaagggccccctgcgggaggagaagatcagcgaggacacagccatcctgaagctgagcaagctggtgcccggcaactacaccttcagcctgactgtggtggacagtgatggagccaccaacagcaccacagccaacctgactgtgaacaaggctgtggactacccacctgtggccaatgccggccccaaccaggtgatcaccctgccccagaacagcatcaccctgtttggaaaccagagcacagatgaccacggcatcaccagctatgagtggagcctgagccccagcagcaagggcaaggtggtggagatgcagggcgtgaggacccccaccctgcagctgagcgccatgcaggagggggactacacctaccagctgactgtgacagacaccatcggccagcaggccacagcccaggtgaccgtcatcgtgcagcctgagaacaacaagccaccccaggctgatgctggccctgacaaggagctgaccctgcctgtggacagcaccaccctggatggcagcaagagcagtgatgaccagaagatcatctcctacctgtgggagaagacccagggcccagatggagtgcagctggagaatgccaacagctctgtggccaccgtgacaggcctgcaggtgggcacctacgtgttcaccctgactgtgaaggatgaaagaaacctgcagagccagagctctgtgaatgtcatcgtgaaggaggagatcaacaagccacccatcgccaagatcactggaaatgtggtgatcaccctgcccaccagcacagctgagctggatggcagcaagagcagtgatgacaagggcatcgtgtcctacctgtggaccagagatgagggcagccctgctgctggggaggtgctgaaccacagcgaccaccaccccatcctcttcctgagcaacctggtggagggcacctacaccttccacctgaaggtgacagatgccaagggggagagtgacacagacaggaccaccgtggaggtgaagccagaccccaggaagaacaacctggtggagatcatcctggacatcaacgtgtcccagctgacagagcggctgaagggcatgttcatccggcagattggagtgctgctgggcgtgctggacagcgacatcatcgtgcagaagatccagccctacacagagcagagcaccaagatggtgttctttgtgcagaatgaaccaccccaccagatcttcaagggccacgaggtggccgccatgctgaagtctgagctgaggaagcagaaggctgacttcctgatcttccgggccctggaggtgaacacagtgacctgccagctgaactgcagcgaccacggccactgtgacagcttcaccaagcgctgcatctgtgaccccttctggatggagaacttcatcaaggtgcagctgagagatggagacagcaactgtgagtggagcgtgctgtatgtgatcatcgccaccttcgtcatcgtggtggccctgggcatcctgtcctggacagtcatctgctgctgcaagaggcagaagggcaagcccaagaggaagagcaagtacaagatcctggatgccacagaccaggagagcctggagctgaagcccaccagcagagctggcatcaagcagaagggcctgctgctgagcagcagcctgatgcacagcgagagcgagctggacagtgatgatgccatcttcacctggccagaccgggagaagggcaagctgctgcactag

SEQ ID NO: 37145 - DNA, 3405 bp, Artificial Sequence
  Description of Artificial Sequence: Synthetic coding sequence
atggagaaggccccaccccagccccagcacgagggcctgaagagcaaggagcacctgccccagcagcctgctgagggcaagacagccagcagaagagtgccccggctgcgggctgtggtggagagccaggccttcaagaacatcctggtggatgagatggacatgatgcacgcccgggccgccaccctcatccaggccaactggaggggctactggctgcggcagaagctgatcagccagatgatggccgccaaggccatccaggaggcctggaggcgcttcaacaagaggcacatcctgcacagcagcaagagcctggtgaagaagaccagggctgaggagggggacatcccctaccacgccccccagcaggtgcgcttccagcaccctgaggagaaccggctgctgagcccccccatcatggtgaacaaggagacccagttccccagctgtgacaacctggtgctgtgccggccccagagcagccccctgctgcagcccccagctgcccagggcaccccagagccctgtgtgcagggcccccatgctgcccgggtgcggggcctggccttcctgccccaccagacagtgaccatccgcttcccctgccctgtgtccctggatgccaagtgccagccctgcctgctgaccaggaccatccgcagcacctgcctggtgcacatcgagggggacagcgtgaagaccaagagggtgtctgcccggaccaacaaggcccgggcccctgagacccccctgagccgccgctatgaccaggccgtgacccggcccagccgggcccagacccagggccctgtgaaggccgagacccccaaggcccccttccagatctgccccggccccatgatcaccaagaccctgctgcagacctaccctgtggtgtctgtgaccctgccccagacctacccagccagcaccatgaccaccaccccacccaagaccagccctgtgcccaaggtgaccatcatcaagaccccagcccagatgtacccaggccccaccgtgaccaagacagccccccacacctgccccatgcccaccatgaccaagatccaggtgcaccccacagccagcaggacaggcaccccccggcagacctgcccagccaccatcacagccaagaaccggccccaggtgtccctgctggccagcatcatgaagagcctgccccaggtgtgccccggccctgccatggccaagaccccaccccagatgcaccctgtgaccaccccagccaagaaccccctgcagacctgcctgagcgccaccatgagcaagaccagcagccagaggagccctgtgggcgtgaccaagcccagcccccagacccggctgcctgccatgatcaccaagaccccagcccagctgcggtctgtggccaccatcctgaagaccctgtgcctggccagccccaccgtggccaacgtgaaggccccaccccaggtggccgtggccgccggcacccccaacaccagcggcagcatccatgaaaatccacccaaggccaaggccaccgtgaatgtgaagcaggccgccaaggtggtgaaggccagcagccccagctacctggccgagggcaagatccgctgcctggcccagccccaccctggcaccggggtgcccagggctgctgctgagctgcccctggaggccgagaagatcaagacaggcacccagaagcaggccaagacagacatggccttcaagacctctgtggccgtggagatggccggggcccccagctggaccaaggtggccgaggagggggacaagccaccccacgtgtatgtgcctgtggacatggctgtgaccctgccccggggccagctggccgcccccctgaccaatgccagcagccagaggcaccccccctgcctgagccagaggcccctggccgcccccctgaccaaggccagcagccagggccacctgcccacagagctgaccaagacccccagcctggcccacctggacacctgcctgagcaagatgcacagccagacccacctggccaccggggctgtgaaggtgcagagccaggcccccctggccacctgcctgaccaagacccagagccggggccagcccatcacagacatcaccacctgcctgatcccagcccaccaggccgctgacctgagcagcaacacccacagccaggtgctgctgaccggcagcaaggtgagcaaccacgcctgccagaggctgggcggcctgagcgccccaccctgggccaagccagaggaccggcagacccagccccagccccacggccacgtgcctgggaagaccacccagggcggcccctgcccagctgcctgtgaggtgcagggcatgctggtgccccccatggcccccaccggccacagcacctgcaatgtggagagctggggagacaacggggccacccgggcccagcccagcatgcctggccaggccgtgccctgccaggaggacaccggccctgcagatgctggggtggtgggcggccagagctggaacagagcctgggagcccgcccggggagctgcctcctgggacacctggaggaacaaggctgtggtgcccccccggcgcagcggggagcccatggtgtccatgcaggccgctgaggagatccgcatcctggccgtcatcaccatccaggccggcgtgcggggctacctggcccggcggcgcatccggctgtggcacagaggagccatggtgatccaggccacctggaggggctacagagtgagaagaaacctggcccacctgtgccgggccaccaccaccatccagagcgcctggaggggctacagcacccggcgggaccaggcccggcactggcagatgctgcaccctgtgacctgggtggagctgggcagcagagctggggtgatgtctgaccgctcctggttccaggacggccgggccaggacagtgtctgaccaccgctgcttccagagctgccaggcccacgcctgcagcgtgtgccacagcctgagcagccgcatcggcagccccccatctgtggtgatgctggtgggcagcagccccaggacctgccacacctgtggccgcacccagcccaccagggtggtgcagggcatgggccagggcacagagggccctggagctgtgtcctgggccagcgcctaccagctggccgccctgagcccccggcagccccaccggcaggacaaggccgccacagccatccagagcgcctggaggggcttcaagatccggcagcagatgaggcagcagcagatggccgccaagatcgtgcaggccacctggaggggccaccacaccaggagctgcctgaagaacacagaggccctgctgggccctgctgaccccagcgccagcagccgccacatgcactggccaggcatctag

SEQ ID NO: 37146 - DNA, 2058 bp, Artificial Sequence
  Description of Artificial Sequence: Synthetic coding sequence
atggagaagaggctgggcgtgaagcccaacccagcctcctggatcctgagcggctactactggcagaccagcgccaagtggctgcggagcctgtacctgttctacacctgcttctgcttctctgtgctgtggctgagcacagatgccagcgagagccgctgccagcagggcaagacccagtttggagtgggcctgcggtctggaggagagaaccacctgtggctgctggagggcacccccagcctgcagagctgctgggccgcctgctgccaggacagcgcctgccacgtgttctggtggctggagggcatgtgcatccaggccgactgcagccggccccagagctgccgggccttccgcacccacagcagcaacagcatgctggtgttcctgaagaagttccagacagcagatgacctgggcttcctgcctgaagatgatgtgccccacctgctgggcctgggctggaactgggcctcctggaggcagagccccccccgggccgccctgcggcctgctgtgagcagcagtgaccagcagagcctcatcaggaagctgcagaagaggggcagccccagtgatgtggtgacccccatcgtgacccagcacagcaaggtgaatgacagcaatgagctgggcggcctgaccaccagcggcagcgctgaggtgcacaaggccatcaccatcagcagccccctgaccacagacctgacagctgagctgagcggcggccccaagaatgtgtctgtgcagcctgagatcagcgagggcctggccaccacccccagcacccagcaggtgaagagcagcgagaagacccagattgctgtgccccagcctgtggcccccagctacagctatgccacccccaccccccaggccagcttccagagcaccagcgccccctaccctgtgatcaaggagctggtggtgtctgctggggagagcgtgcagatcaccctgcccaagaatgaggtgcagctgaatgcctacgtgctgcaggagccccccaagggggagacctacacctatgactggcagctgatcacccacccccgggactacagcggggagatggagggcaagcacagccagatcctgaagctgagcaagctgaccccaggcctgtatgagttcaaggtgattgtggagggccagaatgcccatggagagggctacgtgaatgtgacagtgaagccagagcccaggaagaacagaccacccatcgccatcgtgagcccccagttccaggagatcagcctgcccaccaccagcacagtgattgatggcagccagagcacagatgatgacaagatcgtgcagtaccactgggaggagctgaagggccccctgcgggaggagaagatcagcgaggacacagccatcctgaagctgagcaagctggtgcccggcaactacaccttcagcctgactgtggtggacagtgatggagccaccaacagcaccacagccaacctgactgtgaacaaggctgtggactacccacctgtggccaatgccggccccaaccaggtgatcaccctgccccagaacagcatcaccctgtttggaaaccagagcacagatgaccacggcatcaccagctatgagtggagcctgagccccagcagcaagggcaaggtggtggagatgcagggcgtgaggacccccaccctgcagctgagcgccatgcaggagggggactacacctaccagctgactgtgacagacaccatcggccagcaggccacagcccaggtgaccgtcatcgtgcagcctgagaacaacaagccaccccaggctgatgctggccctgacaaggagctgaccctgcctgtggacagcaccaccctggatggcagcaagagcagtgatgaccagaagatcatctcctacctgtgggagaagacccagggcccagatggagtgcagctggagaatgccaacagctctgtggccaccgtgacaggcctgcaggtgggcacctacgtgttcaccctgactgtgaaggatgaaagaaacctgcagagccagagctctgtgaatgtcatcgtgtag

SEQ ID NO: 37147 - DNA, 4581 bp, Artificial Sequence
  Description of Artificial Sequence: Synthetic coding sequence
atggccggcctgcggcggccccagcccggctgctactgcaggacagctgctgctgtgaacctgctgctgggcgtcttccaggtgctgctgccctgctgcaggcctggaggagcccagggccaggccatcgagcccctgcccaacgtggtggagctgtggcaggccgaggagggggagctgctgctgcccacccagggcgacagcgaggagggcctggaggagcccagccaggagcagagcttcagtgacaagctgttcagcggcaagggcctgcacttccagcccagcgtgctggactttggcatccagttcctgggccaccctgtggccaagatcctgcacgcctacaaccccagccgggacagcgaggtggtggtgaacagcgtgtttgctgctgctggccacttccacgtgccccctgtgccctgcagggtcatcccagccatgggcaagaccagcttccgcatcatcttcctgcccacagaggagggcagcattgagagcagcctcttcatcaacaccagcagctatggagtgctgagctaccacgtgtctggaattggcacccggcgcatcagcacagagggcagcgccaagcagctgcccaatgcctacttcctgctgcccaaggtgcagagcatccagctgagccagatgcaggccgagaccaccaacaccagcctgctgcaggtgcagctggagtgcagcctgcacaacaaggtgtgccagcagctgaagggctgctacctggagagtgatgatgtgctgcggctgcagatgagcatcatggtgaccatggagaacttcagcaaggagtttgaggagaacacccagcacctgctggaccacctgagcatcgtgtatgtggccacagatgagagcgagaccagtgatgacagcgctgtgaacatgtacatcctgcacagcggcaacagcctcatctggatccaggacatccgccacttcagccagagagatgccctgagcctgcagtttgagcctgtgctgctgcccaccagcaccaccaacttcaccaagatcgccagcttcacctgcaaggccgccaccagctgtgacagcggcatcattgaagatgtgaagaagaccacccacacccccaccctgaaggcctgcctcttcagctctgtggcccagggctacttcaggatggacagcagcgccacccagttccacatcgagacccatgagaacaccagcggcctgtggagcatctggtacagaaaccactttgacagatctgtggtgctgaatgatgtgttcctgagcaaggagaccaagcacatgctgaagatcctgaacttcaccggccccctcttcctgcccccaggctgctggaacatcttcagcctgaagctggccgtgaaggacatcgccatcaacctcttcaccaacgtgttcctgaccaccaacatcggggccatctttgccatccccctgcagatctacagcgcccccaccaaggagggcagcctgggctttgaggtgattgcccactgcggcatgcactacttcatgggcaagagcaaggccggcaaccccaactggaatggcagcctgagcctggaccagagcacctggaatgtggacagcgagctggccaacaagctgtatgagcgctggaagaagtacaagaatggagatgtgtgcaagtttggaacagacatgcagatgatcaacttcaccactggagagttccagctgacagaggcctgcccctacctgggcacccacagcgaggagagccgcttcggcatcctgcacctgcacctgcagcccctggagatgaagagggtgggcgtggtgttcaccccagctgactatggcaaggtgaccagcctcatcctgatccggaacaacctgaccgtcatcgacatgattggagtggagggctttggagcccgggagctgctgaaggtgggcggccgcctgcctggagctgggggcagcctgcgcttcaaggtgcctgagagcaccctgatggactgccggcggcagctgaaggacagcaagcagatcctgagcatcaccaagaacttcaaggtggagaacatcggccccctgcccatcaccgtgagcagcctgaagatcaatggctacaactgccagggctacggctttgaggtgctggactgccaccagttcagcctggaccccaacaccagccgggacatcagcatcgtgttcaccccagacttcaccagctcctgggtgatccgggacctgagcctggtgacagctgctgacctggagttccgcttcaccctgaatgtgaccctgccccaccacctgctgcccctgtgtgctgatgtggtgcccggccccagctgggaggagagcttctggaggctgactgtgttctttgtgtccctgagcctgctgggcgtcatcctgattgccttccagcaggcccagtacatcctgatggagttcatgaagacccggcagaggcagaatgccagcagcagcagccagcagaacaacggccccatggatgtgatcagcccccacagctacaagagcaactgcaagaacttcctggacacctacggccccagcgacaagggccggggcaagaactgcctgcctgtgaacaccccccagagccgcatccagaatgctgccaagaggagccctgccacctacggccacagccagaagaagcacaagtgcagcgtgtactacagcaagcacaagaccagcacagctgctgccagcagcaccagcaccaccacagaggagaagcagaccagccccctgggcagcagcctgcctgctgccaaggaggacatctgcacagatgccatgagggagaactggatcagcctgcgctatgccagcggcatcaacgtgaacctgcagaagaacctgaccctgcccaagaacctgctgaacaaggaggagaacaccctgaagaacaccatcgtgttcagcaaccccagcagtgaatgttccatgaaggagggcatccagacctgcatgttccccaaggagacagacatcaagaccagtgaaaatacagctgagttcaaggagcgggagctgtgccccctgaagaccagcaagaagctgcctgagaaccacctgcccaggaacagcccccagtaccaccagcctgacctgcctgagatcagcaggaagaacaatggaaacaaccagcaggtgcctgtgaagaatgaggtggaccactgtgagaacctgaagaaggtggacaccaagcccagcagcgagaagaagatccacaagaccagccgggaggacatgttcagcgagaagcaggacatcccctttgtggagcaggaggacccctacaggaagaagaagctgcaggagaagcgggagggcaacctgcagaacctgaactggagcaagagcaggacctgcaggaagaacaagaagaggggcgtggcccctgtgtcccggcccccagagcagagcgacctgaagctggtgtgcagcgactttgagaggtctgagctgagcagtgacatcaacgtgcgctcctggtgcatccaggagagcacccgggaggtgtgcaaggcagatgctgagatcgccagcagcctgcctgctgcccagcgggaggccgagggctactaccagaagccagagaagaagtgtgtggacaagttctgcagcgacagcagcagtgactgtggcagcagcagcggctctgtgcgggccagccggggctcctggggctcctggagcagcaccagcagcagtgatggagacaagaagcccatggtggatgcccagcacttcctgcctgctggggacagcgtgtcccagaatgacttccccagcgaggcccccatcagcctgaacctgagccacaacatctgcaaccccatgacagtgaacagcctgccccagtatgcagagcccagctgccccagcctgcctgctggccccaccggggtggaggaggacaagggcctgtacagccctggggacctgtggcccaccccacctgtgtgtgtgaccagcagcctgaactgcaccctggagaatggagtgccctgcgtcatccaggagagcgcccctgtgcacaacagcttcatcgactggagcgccacctgtgagggccagttcagcagcgcctactgccccctggagctgaatgactacaatgccttccctgaggagaacatgaactatgccaacggcttcccctgcccagcagatgtgcagacagacttcatcgaccacaacagccagagcacctggaacaccccacccaacatgcctgctgcctggggccacgccagcttcatcagcagccccccctacctgaccagcaccaggagcctgagccccatgagcggcctgtttggcagcatctgggccccccagagtgatgtgtatgagaactgctgccccatcaaccccaccacagagcacagcacccacatggagaaccaggccgtggtgtgcaaggagtactacccaggcttcaaccccttccgggcctacatgaacctggacatctggaccaccacagccaacagaaatgccaacttccccctgagccgggacagcagctactgtggaaatgtgtag

SEQ ID NO: 37148 - DNA, 3924 bp, Artificial Sequence
  Description of Artificial Sequence: Synthetic coding sequence
atgattgctgtgtccacagccaacggctacatcctcttcttccacatcaccagcaccaggggggacaagtacctgtatgagcctgtgtaccccaagggcagcccccagatgaagggcaccccccacttcaaggaggagcagtgtgccccagccctgaacctggagatgaggaagatcctggacctgcaggcccccatcatgagcctgcagagcgtgctggaggacctgctggtggccaccagtgatggcctgctgcacctgatccactgggagggcatgaccaatggaaggaaggccatcaacctgtgcaccgtgcccttctctgtggacctgcagagcagccgggtgggcagcttcctgggcttcacagatgtgcacatccgggacatggagtactgtgccaccctggatggctttgctgtggtgttcaatgatggcaaggtgggcttcatcacccctgtgagcagccgcttcaccgctgagcagctgcacggcgtgtggccccaggatgtggtggatggcacctgtgtggccgtgaacaacaagtaccgcctgatggccttcggctgtgtgtctggctctgtgcaggtgtacaccatcgacaacagcactggagccatgctgctgagccacaagctggagctgacagccaagcagtacccagacatctggaacaagacaggagctgtgaagctgatgcgctggagcccagacaacagcgtggtgattgtgacctgggagtatggaggcctgagcctgtggagcgtgtttggagcccagctgatctgcaccctgggcggggactttgcctacagaagtgatggcaccaagaaggaccccctgaagatcaacagcatgtcctggggcgctgagggctaccacctgtgggtgatcagcggcttcggcagccagaacacagaaattgaaagtgacctgcggtctgtggtgaagcagcccagcatcctgctcttccagttcatcaagtctgtgctgactgtgaacccctgcatgagcaaccaggagcaggtgctgctgcagggcgaggaccggctgtacctgaactgtggggaggccagccagacccagaaccccaggagcagcagcacccacagcgagcacaagcccagccgggagaagagcccctttgctgatggcggcctggagagccagggcctgagcaccctgctgggccaccgccactggcacgtggtgcagatcagcagcacctacctggagagcaactggcccatccgggagcagaacatgattgtgactggaggcctggcctggtggaatgacttcatggtgctggcctgctacaacatcaatgaccggcaggaggagctgcgggtgtacctgcggaccagcaacctggacaatgcctttgcccacgtgaccaaggcccaggccgagaccctgctgctgagcgtcttccaggacatggtgattgtgttccgggctgactgcagcatctgcctgtacagcattgaaaggaagagtgatggccccaacaccacagctggcatccaggtgctgcaggaggtgtccatgagccgctacatcccccaccccttcctggtggtgtctgtgaccctgacctctgtgtccacagaaaatggcatcaccctgaagatgccccagcaggcccggggagctgagagcatcatgctgaacctggccggccagctgatcatgatgcagagggacagaagtggcccccagatccgggagaaggacagcaaccccaacaaccagaggaagctgctgcccttctgcccccctgtggtgctggcccagagcgtggagaatgtgtggaccacctgccgggccaacaagcagaagaggcacctgctggaggccctgtggctgagctgtggcggggccggcatgaaggtgtggctgcccctcttcccccgggaccacaggaagccccacagcttcctgagccagaggatcatgctgcccttccacatcaacatctaccccctggccgtgctgtttgaagatgccctggtgctgggcgctgtgaatgacaccctgctgtatgacagcctgtacaccaggaacaatgcccgggagcagctggaggtgctcttccccttctgtgtggtggagaggaccagccagatctacctgcaccacatcctgcggcagctgctggtgaggaacctgggggagcaggccctgctgctggcccagagctgtgccaccctgccctacttcccccacgtgctggagctgatgctgcacgaggtgctggaggaggaggccaccagccgggagcccatcccagaccccctgctgcccaccgtggccaagttcatcacagagttccccctcttcctgcagacagtggtgcactgtgccaggaagacagaatatgccctgtggaactacctgtttgctgctgtgggcaaccccaaggacctgtttgaagaatgtctgatggcccaggacctggacacagctgccagctacctgatcatcctgcagaacatggaggtgcctgctgtgtcccggcagcacgccaccctgctcttcaacacagccctggagcagggcaagtgggacctgtgccgccacatgatccgcttcctgaaggccatcggcagcggggagagcgagaccccacccagcacccccacagcccaggagcccagcagcagcggcggctttgagttcttcaggaacagaagcatcagcctgagccagagcgcagaaaatgtgcctgccagcaagttcagcctgcagaagaccctgtccatgcccagcggccccagcggcaagcgctggagcaaggacagcgactgtgccgagaacatgtacatcgacatgatgctgtggaggcatgcccggcggctgctggaggatgtgcggctgaaggacctgggctgctttgctgcccagctgggctttgagctgatctcctggctgtgcaaggagaggaccagggctgcccgggtggacaactttgtgattgccctgaagaggctgcacaaggacttcctgtggcccctgcccatcatcccagccagcagcatcagcagccccttcaagaatggcaagtacagaacagtgggggagcagctgctgaagagccagagcgctgaccccttcctgaacctggagatggatgctggcatcagcaacatccagaggagccagagctggctgagcaacatcggccccacccaccacgagattgacacagccagcagccacggcccccagatgcaggatgccttcctgagccccctgagcaacaagggagatgagtgcagcatcggcagcgccacagacctgacagagagcagctccatggtggatggagactggaccatggtggatgagaacttcagcaccctgagcctgacccagagcgagctggagcacatctccatggagctggccagcaagggcccccacaagagccaggtgcagctgcgctacctgctgcacatcttcatggaggccggctgcctggactggtgcatcgtgattggcctcatcctgcgggagagcagcatcatcaaccagatcctggtgatcacccagagcagcgaggtggatggagagatgctgcagaacatcaagacaggcctgcatgctgtggaccgctgggccagcacagactgccccggctacaagcccttcctgaacatcatcaagccccagctgcagaagctgtctgagatcacagaggagcaggtgcagccagatgccttccagcccatcaccatgggcaagaccccagagcagaccagccccagggctgaggagagccggggcagcagcagccacggcagcatcccccagggcgaggtgggcagcagcaacatggtgtccaggaaggaggaggacacagcccaggccgaggaggaggagcccttccaggacggcacctatgactgcagcgtgtcctag

SEQ ID NO: 37149 - DNA, 822 bp, Artificial Sequence
  Description of Artificial Sequence: Synthetic coding sequence
atggagaagaggctgggcgtgaagcccaacccagcctcctggatcctgagcggctactactggcagaccagcgccaagtggctgcggagcctgtacctgttctacacctgcttctgcttctctgtgctgtggctgagcacagatgccagcgagagccgctgccagcagggcaagacccagtttggagtgggcctgcggtctggaggagagaaccacctgtggctgctggagggcacccccagcctgcagagctgctgggccgcctgctgccaggacagcgcctgccacgtgttctggtggctggagggcatgtgcatccaggccgactgcagccggccccagagctgccgggccttccgcacccacagcagcaacagcatgctggtgttcctgaagaagttccagacagcagatgacctgggcttcctgcctgaagatgatgtgccccacctgctgggcctgggctggaactgggcctcctggaggcagagccccccccgggccgccctgcggcctgctgtgagcagcagtgaccagcagagcctcatcaggaagctgcagaagaggggcagccccagtgatgtggtgacccccatcgtgacccagcacagcaaggtgaatgacagcaatgagctgggcggcctgaccaccagcggcagcgctgaggtgcacaaggccatcaccatcagcagccccctgaccacagacctgacagctgagctgagcggcggccccaagaatgtgtctgtgcagcctgagatcagcgagggcctggccaccacccccagcacccagcaggtgaagagcagcgagaagacctag

SEQ ID NO: 37150 - DNA, 540 bp, Artificial Sequence
  Description of Artificial Sequence: Synthetic coding sequence
atggagaagaggctgggcgtgaagcccaacccagcctcctggatcctgagcggctactactggcagaccagcgccaagtggctgcggagcctgtacctgttctacacctgcttctgcttctctgtgctgtggctgagcacagatgccagcgagagccgctgccagcagggcaagacccagtttggagtgggcctgcggtctggaggagagaaccacctgtggctgctggagggcacccccagcctgcagagctgctgggccgcctgctgccaggacagcgcctgccacgtgttctggtggctggagggcatgtgcatccaggccgactgcagccggccccagagctgccgggccttccgcacccacagcagcaacagcatgctggtgttcctgaagaagttccagacagcagatgacctgggcttcctgcctgaagatgatgtgccccacctgctgggcctgggctggaactgggcctcctggaggcagagccccccccgggccgccctgcggcctgctgtgagcagcagtgaccagtag

SEQ ID NO: 37151 - DNA, 471 bp, Artificial Sequence
  Description of Artificial Sequence: Synthetic coding sequence
atggccgagcccggccacagccaccacctgagcgcccgggtgcggggccgcacagagcggcgcatcccccggctgtggaggctgctgctgtgggccggcacagccttccaggtgacccagggcaccggccctgagctgcacgcctgcaaggagagcgagtaccactatgagtacacagcctgtgacagcacaggcagccgctggagggtggccgtgccccacaccccaggcctgtgcaccagcctgcctgaccccatcaagggcacagagtgcagcttcagctgcaatgctggggagttcctggacatgaaggaccagagctgcaagccctgtgccgagggccgctacagcctgggcaccggcatccgctttgatgagtgggatgagctgccccacggctttgccagcctgagcgccaacatggagctggatgacagcgctgctgagagcactggaaactgcaccagctag

SEQ ID NO: 37152 - DNA, 2781 bp, Artificial Sequence
  Description of Artificial Sequence: Synthetic coding sequence
atggccgagcccggccacagccaccacctgagcgcccgggtgcggggccgcacagagcggcgcatcccccggctgtggaggctgctgctgtgggccggcacagccttccaggtgacccagggcaccggccctgagctgcacgcctgcaaggagagcgagtaccactatgagtacacagcctgtgacagcacaggcagccgctggagggtggccgtgccccacaccccaggcctgtgcaccagcctgcctgaccccatcaagggcacagagtgcagcttcagctgcaatgctggggagttcctggacatgaaggaccagagctgcaagccctgtgccgagggccgctacagcctgggcaccggcatccgctttgatgagtgggatgagctgccccacggctttgccagcctgagcgccaacatggagctggatgacagcgctgctgagagcactggaaactgcaccagcagcaagtgggtgcccaggggggactacatcgccagcaacacagatgagtgcacagccaccctgatgtatgctgtgaacctgaagcagagcggcaccgtgaactttgagtactactacccagacagcagcatcatctttgagttctttgtgcagaatgaccagtgccagcccaatgctgatgacagccgctggatgaagaccacagagaagggctgggagttccacagcgtggagctgaacagaggcaacaacgtgctgtactggaggaccacagccttctctgtgtggaccaaggtgcccaagcctgtgctgacccagctgatgtacaagtgggccaagcccaagatctgcagcgaggacctggagggcgctgtgaagctgcctgccagcggcgtgaagacccactgccccccctgcaaccctggcttcttcaagaccaacaacagcacctgccagccctgcccctacggcagctacagcaatggaagtgactgcacccgctgcccagctggaacagagcctgctgtgggctttgagtacaagtggtggaacaccctgcccaccaacatggagaccaccgtgctgagcggcatcaactttgagtacaagggcatgacaggctgggaggtggccggggaccacatctacacagctgctggggccagtgacaatgacttcatgatcctgaccctggtggtgcccggcttccggcccccccagagcgtgatggctgacacagagaacaaggaggtggcccgcatcacctttgtgtttgagaccctgtgcagcgtgaactgtgagctgtacttcatggtgggcgtgaacagcaggaccaacacccctgtggagacctggaagggcagcaagggcaagcagagctacacctacatcatcgaggagaacaccaccaccagcttcacctgggccttccagaggaccaccttccacgaggccagcaggaagtacaccaatgatgtggccaagatctacagcatcaacgtgaccaacgtgatgaatggagtggccagctactgccggccctgtgccctggaggccagtgatgtgggcagcagctgcaccagctgcccagctggctactacatcgaccgggacagcggcacctgccacagctgccccaccaacaccatcctgaaggcccaccagccctacggcgtgcaggcctgtgtgccctgtggccctggcaccaagaacaacaagatccacagcctgtgctacaatgactgcaccttcagcaggaacacccccaccaggaccttcaactacaacttcagcgccctggccaacacagtgaccctggccggcggccccagcttcaccagcaagggcctgaagtacttccaccacttcaccctgagcctgtgtggcaaccagggcaggaagatgtctgtgtgcacagacaacgtgacagacctgcgcatccctgagggggagagcggcttcagcaagagcatcacagcctacgtgtgccaggccgtcatcatccccccagaggtgacaggctacaaggccggcgtgagcagccagcctgtgtccctggccgacaggctcatcggcgtgaccacagacatgaccctggatggcatcaccagccctgctgagctgttccacctggagagcctgggcatcccagatgtgatcttcttctaccgcagcaatgatgtgacccagagctgcagcagcggccgcagcaccaccatccgggtgcgctgcagcccccagaagacagtgcccggcagcctgctgctgcccggcacctgcagtgatggcacctgtgatggctgcaacttccacttcctgtgggagagcgctgctgcctgccccctgtgcagcgtggccgactaccacgccatcgtgagcagctgtgtggccggcatccagaagaccacctacgtgtggagggagcccaagctgtgcagcggcggcatcagcctgcctgagcagagggtgaccatctgcaagaccatcgacttctggctgaaggtgggcatctctgctggcacctgcacagccatcctgctgactgtgctgacctgctacttctggaagaagaaccagaagctggagtacaagtacagcaagctggtgatgaatgccaccctgaaggactgtgacctgcctgctgctgacagctgtgccatcatggagggggaggatgtggaggatgacctgatcttcaccagcaagaagagcctgtttgggaagatcaagagcttcaccagcaagaggaccccagatggctttgacagcgtgcccctgaagaccagcagcggcggcctggacatggacctgtag

SEQ ID NO: 37153 - DNA, 618 bp, Artificial Sequence
  Description of Artificial Sequence: Synthetic coding sequence
atggccgagcccggccacagccaccacctgagcgcccgggtgcggggccgcacagagcggcgcatcccccggctgtggaggctgctgctgtgggccggcacagccttccaggtgacccagggcaccggccctgagctgcacgcctgcaaggagagcgagtaccactatgagtacacagcctgtgacagcacaggcagccgctggagggtggccgtgccccacaccccaggcctgtgcaccagcctgcctgaccccatcaagggcacagagtgcagcttcagctgcaatgctggggagttcctggacatgaaggaccagagctgcaagccctgtgccgagggccgctacagcctgggcaccggcatccgctttgatgagtgggatgagctgccccacggctttgccagcctgagcgccaacatggagctggatgacagcgctgctgagagcactggaaactgcaccagcagcaagtgggtgcccaggggggactacatcgccagcaacacagatgagtgcacagccaccctgatgtatgctgtgaacctgaagcagagcggcaccgtgaactttgagtactactacccagacagcagcatcatctttgagttcttctag

SEQ ID NO: 37154 - DNA, 276 bp, Artificial Sequence
  Description of Artificial Sequence: Synthetic coding sequence
atggccgagcccggccacagccaccacctgagcgcccgggtgcggggccgcacagagcggcgcatcccccggctgtggaggctgctgctgtgggccggcacagccttccaggtgacccagggcaccggccctgagctgcacgcctgcaaggagagcgagtaccactatgagtacacagcctgtgacagcacaggcagccgctggagggtggccgtgccccacaccccaggcctgtgcaccagcctgcctgaccccatcaagggcacagagtgctag

SEQ ID NO: 37155 - DNA, 459 bp, Artificial Sequence
  Description of Artificial Sequence: Synthetic coding sequence
atggccgagcccggccacagccaccacctgagcgcccgggtgcggggccgcacagagcggcgcatcccccggctgtggaggctgctgctgtgggccggcacagccttccaggtgacccagggcaccggccctgagctgcacgcctgcaaggagagcgagtaccactatgagtacacagcctgtgacagcacaggcagccgctggagggtggccgtgccccacaccccaggcctgtgcaccagcctgcctgaccccatcaagggcacagagtgcagcttcagctgcaatgctggggagttcctggacatgaaggaccagagctgcaagccctgtgccgagggccgctacagcctgggcaccggcatccgctttgatgagtgggatgagctgccccacggctttgccagcctgagcgccaacatggagctggatgacagcgctgctgagagcactggatag

SEQ ID NO: 37156 - DNA, 1923 bp, Artificial Sequence
  Description of Artificial Sequence: Synthetic coding sequence
atggtggtgcccagcaagaccaagatcgtgtgccacttcagcaccctggtgctgacctgtggccagccccacaccctgcagatcgtgcccagagatgaatatgacaaccccaccaacaacagcatgagcctgagagatgagcacaactacaccctgagcatccacgagctgggcccccaggaggaggagagcactggagtgtcctttgagaagtctgtgaccagcaaccggcagaccttccaggtgttcctgcggctgaccctgcacagccggggctgcttccacgcctgcatctcctaccagaaccagcccatcaacaatggagaatttgacatcatcgtgctgtctgaagatgagaagaacatcgtggagagaaatgtgtccaccagcggcgtgtccatctactttgaggcctacctgtacaatgccaccaactgcagcagcaccccctggcacctgccccccatgcacatgaccagcagccagaggcggcccagcacagctgtggatgaggaggatgaggacagccccagcgagtgccacaccccagagaaggtgaagaagcccaagaaggtgtactgctacgtgagccccaagcagttctctgtgaaggagttctacctgaagatcatcccctggaggctgtacaccttccgggtgtgccccggcaccaagttctcctacctgggccctgaccctgtgcacaagctgctgaccctggtggtggatgatggcatccagccccctgtggagctgagctgcaaggagaggaacatcctggccgccaccttcatccgcagcctgcacaagaacatcggcggcagcgagaccttccaggacaaggtgaacttcttccagcgggagctgcggcaggtgcacatgaagaggccccacagcaaggtgaccctgaaggtgtccagacatgccctgctggagagcagcctgaaggccaccaggaacttcagcatcagtgactggagcaagaactttgaggtggtgttccaggatgaggaggccctggactggggcggcccccggcgggagtggtttgagctgatctgcaaggccctgtttgacaccaccaaccagctgttcacccgcttcagtgacaacaaccaggccctggtgcaccccaaccccaacagacctgcccacctgcggctgaagatgtatgaatttgctggccgcctggtgggcaagtgcctgtatgagagcagcctgggcggggcctacaagcagctggtgcgggcccgcttcaccaggagcttcctggcccagatcatcggcctgaggatgcactacaagtactttgaaacagatgatcctgagttctacaagagcaaggtgtgcttcatcctgaacaatgacatgtctgagatggagctggtgtttgctgaggagaagtacaacaagagcggccagctggacaaggtggtggagctgatgactggaggagcccagacccctgtgaccaatgccaacaagatcttctacctgaacctgctggcccagtaccgcctggccagccaggtgaaggaggaggtggagcacttcctgaagggcctgaatgagctggtgcctgagaacctgctggccatctttgatgaaaatgagctggagctgctgatgtgtggcaccggggacatctctgtgtctgacttcaaggcccatgctgtggtggtgggcggctcctggcacttccgggagaaggtgatgcgctggttctggacagtggtgagcagcctgacccaggaggagctggcccggctgctgcagttcaccaccggcagcagccagctgcccccaggcggctttgctgccctgtgccccagcttccagatcatcgccgcccccacccacagcaccctgcccacagcccacacctgcttcaaccaggtgaagggccctggcagctgcagctag

SEQ ID NO: 37157 - DNA, 390 bp, Artificial Sequence
  Description of Artificial Sequence: Synthetic coding sequence
atgttttatgtgattggaggcatcaccgtgtctgtggtggccttcttcttcaccatcaagttcctgtttgagctggccgcccgggtggtgtccttcctgcagaatgaagatcgggagcggcggggggacaggaccatctatgactatgtgcggggcaactacctggaccccaggagctgcaaggtgtcctgggactggaaggacccctatgaggtgggccacagcatggccttccgggtgcacctgttctacaagaatggccagcccttccctgcccacaggcctgtgggcctgcgggtgcacatcagccacgtggagctggccgtggagatccctgtgacccaggaggtgctgcaggagcccaacagcaatgtggtgaaggtggcctag

SEQ ID NO: 37158 - DNA, 1548 bp, Artificial Sequence
  Description of Artificial Sequence: Synthetic coding sequence
atgtggaggctgcccggcctgctgggccgggccctgcccaggaccctgggccccagcctgtggagggtgacccccaagagcaccagcccagatggcccccagaccaccagcagcaccctgctggtgcctgtgcccaacctggacaggagcggcccccacggccctggcaccagcggcggccccaggagccacggctggaaggatgccttccagtggatgagcagccgggtgagccccaacaccctgtgggatgccatctcctggggcaccctggccgtgctggccctgcagctggcccggcagatccacttccaggccagcctgcctgctggcccccagagggtggagcactgctcctggcacagccccctggaccgcttcttcagcagccccctgtggcacccctgcagcagcctgcggcagcacatcctgcccagcccagatggccctgcccccaggcacacaggcctgcgggagccccggctgggccaggaggaggccagcgcccagcccaggaacttcagccacaacagcctgcggggggcccggccccaggaccccagcgaggagggccctggggactttggcttcctgcacgccagcagcagcattgagagcgaggccaagccagcccagccccagcccaccggggagaaggagcaggacaagagcaagaccctgagcctggaggaggccgtgaccagcatccagcagctgttccagctgtctgtgtccatcgccttcaacttcctgggcacagagaacatgaagagcggggaccacacagctgccttctcctacttccagaaggccgccgcccggggctacagcaaggcccagtacaatgccggcctgtgccatgaacatggccggggcaccccccgggacatcagcaaggctgtgctgtactaccagctggccgccagccagggccacagcctggcccagtaccgctatgcccgctgcctgctgcgggaccctgccagctcctggaaccctgagcggcagagagctgtgtccctgctgaagcaggccgctgacagcggcctgcgggaggcccaggccttcctgggcgtgctcttcaccaaggagccctacctggatgagcagagagctgtgaagtacctgtggctggccgccaacaacggggacagccagagccgctaccacctgggcatctgctatgagaagggcctgggcgtgcagaggaacctgggggaggccctgcgctgctaccagcagagcgctgccctgggcaatgaggccgcccaggagcggctgcgggccctcttctccatgggcgccgccgcccctggccccagcgacctgactgtgacaggcctgaagagcttcagcagccccagcctgtgcagcctgaacaccctgctggccggcaccagccggctgccccacgccagcagcactggaaacctgggcctgctgtgccgcagcggccacctgggcgccagcctggaggccagcagccgggccatccccccccacccctaccccctggagaggtctgtggtgcggctgggcttcggctag

SEQ ID NO: 37159 - DNA, 1548 bp, Artificial Sequence; identical to SEQ ID NO: 37158
  Description of Artificial Sequence: Synthetic coding sequence

SEQ ID NO: 37160 - DNA, 654 bp, Artificial Sequence
  Description of Artificial Sequence: Synthetic coding sequence
tgagctgtgctgtactaccagctggccgccagccagggccacagcctggcccagtaccgctatgcccgctgcctgctgcgggaccctgccagctcctggaaccctgagcggcagagagctgtgtccctgctgaagcaggccgctgacagcggcctgcgggaggcccaggccttcctgggcgtgctcttcaccaaggagccctacctggatgagcagagagctgtgaagtacctgtggctggccgccaacaacggggacagccagagccgctaccacctgggcatctgctatgagaagggcctgggcgtgcagaggaacctgggggaggccctgcgctgctaccagcagagcgctgccctgggcaatgaggccgcccaggagcggctgcgggccctcttctccatgggcgccgccgcccctggccccagcgacctgactgtgacaggcctgaagagcttcagcagccccagcctgtgcagcctgaacaccctgctggccggcaccagccggctgccccacgccagcagcactggaaacctgggcctgctgtgccgcagcggccacctgggcgccagcctggaggccagcagccgggccatccccccccacccctaccccctggagaggtctgtggtgcggctgggcttcggctag

SEQ ID NO: 37161 - DNA, 1560 bp, Artificial Sequence
  Description of Artificial Sequence: Synthetic coding sequence
atggcccgggccggccctgcctggctgctgctggccatctgggtggtgctgcccagctggctgagcagcgccaaggtgagcagcctcatcgagcgcatcagtgaccccaaggacctgaagaagctgctgcggaccaggaacaacgtgctggtgctgtacagcaagtctgaggtggccgctgagaaccacctgcggctgctgagcacagtggcccaggccgtgaagggccagggcaccatctgctgggtggactgtggagatgctgagagcaggaagctgtgcaagaagatgaaggtggacctgagccccaaggacaagaaggtggagctgttccactaccaggatggagccttccacacagagtacaacagagctgtgaccttcaagagcatcgtggccttcctgaaggaccccaagggcccccccctgtgggaggaggaccccggggccaaggatgtggtgcacctggacagcgagaaggacttccggcggctgctgaagaaggaggagaagcccctgctgatcatgttctacgccccctggtgcagcatgtgcaagaggatgatgccccacttccagaaggccgccacccagctgcggggccatgctgtgctggccggcatgaatgtgtacagcagcgagtttgagaacatcaaggaggagtacagcgtgcggggcttccccaccatctgctactttgagaagggccgcttcctgttccagtatgacaactacggcagcacagctgaggacatcgtggagtggctgaagaacccccagcccccccagccccaggtgcctgagaccccctgggcagatgaaggaggctctgtgtaccacctgacagatgaggactttgaccagtttgtgaaggagcacagctctgtgctggtgatgtttcatgccccctggtgtggccactgcaagaagatgaagccagagtttgagaaggctgctgaggccctgcatggagaggccgacagcagtggagtgctggccgctgtggatgccaccgtgaacaaggccctggccgagcgcttccacatcagcgagttccccaccctgaagtacttcaagaatggagagaagtatgctgtgcctgtgctgcggaccaagaagaagttcctggagtggatgcagaaccctgaggcccctcctcctcctgagcccacctgggaggagcagcagacctctgtgctgcacctggtgggggacaacttccgggagaccctgaagaagaagaagcacaccctggtgatgttctacgccccctggtgcccccactgcaagaaggtgatcccccacttcaccgccacagcagatgccttcaaggatgacaggaagatcgcctgtgccgctgtggactgtgtgaaggacaagaaccaggacctgtgccagcaggaggccgtgaagggctaccccaccttccactactaccactacggcaagtttgctgagaagtatgacagcgacagaacagagctgggcttcaccaactacatccgggccctgcgggagggggaccacgagcggctgggcaagaagaaggaggagctgtag

SEQ ID NO: 37162 - DNA, 1755 bp, Artificial Sequence
  Description of Artificial Sequence: Synthetic coding sequence
atggacctgctgtggatgcccctgctgctggtggccgcctgtgtgtctgctgtgcacagcagccctgaggtgaatgctggggtgagcagcatccacatcaccaagcctgtgcacatcctggaggagaggagcctgctggtgctgaccccagctggcctgacccagatgctgaaccagacccgcttcctgatggtgctcttccacaaccccagcagcaagcagagcaggaacctggccgaggagctgggcaaggctgtggagatcatgggcaagggcaagaatggcatcggctttgggaaggtggacatcaccatcgagaaggagctgcagcaggagtttggcatcaccaaggcccctgagctgaagctgttctttgagggcaacagaagtgagcccatcagctgcaagggcgtggtggagagcgctgccctggtggtgtggctgcggcggcagatcagccagaaggccttcctgttcaacagcagcgagcaggtggccgagtttgtgatcagccggcccctggtgattgtgggcttcttccaggacctggaggaggaggtggccgagctgttctatgatgtgatcaaggacttccctgagctgacctttggagtcatcaccatcggaaatgtcatcggccgcttccacgtgaccctggacagcgtgctggtgttcaagaagggcaagatcgtgaaccggcagaagctgatcaatgacagcaccaacaagcaggagctgaacagagtcatcaagcagcacctgacagactttgtgattgagtacaacacagagaacaaggacctgatcagcgagctgcacatcatgagccacatgctgctgtttgtgtccaagagcagcgagagctatggcatcatcatccagcactacaagctggccagcaaggagttccagaacaagatcctcttcatcctggtggatgctgatgagcccagaaatggccgggtcttcaagtacttccgggtgacagaggtggacatccccagcgtgcagatcctgaacctgagcagtgatgcccgctacaagatgcccagtgatgacatcacctatgagagcctgaagaagtttggccgctccttcctgagcaagaatgccaccaagcaccagagcagcgaggagatccccaagtactgggaccagggcctggtgaagcagctggtgggcaagaacttcaacgtggtggtgtttgacaaggagaaggatgtgtttgtgatgttttatgccccctggagcaagaagtgcaagatgctgttccccctgctggaggagctgggcaggaagtaccagaaccacagcaccatcatcatcgccaagattgatgtgacagccaatgacatccagctgatgtacctggaccgctaccccttcttccgcctcttccccagcggcagccagcaggccgtgctgtacaagggggagcacaccctgaagggcttcagtgacttcctggagagccacatcaagaccaagattgaagatgaagatgagctgctgtctgtggagcagaatgaagtcatcgaggaggaggtgctggccgaggagaaggaggtgcccatgatgaggaagggcctgcctgagcagcagagccctgagctggagaacatgaccaagtatgtgtccaagctggaggagcctgctgggaagaagaagaccagcgaggaggtggtggtggtggtggccaagcccaagggcccccctgtgcagaagaagaagcccaaggtgaaggaggagctgtag

SEQ ID NO: 37163 - DNA, 819 bp, Artificial Sequence
  Description of Artificial Sequence: Synthetic coding sequence
atgggcaacaccaccagtgacagagtgtctggagagcggcacggggccaaggccgcccggtctgagggcgctgggggccacgcccctgggaaggagcacaagatcatggtgggcagcacagatgaccccagcgtcttcagcctgcctgacagcaagctgcccggggacaaggagtttgtgtcctggcagcaggacctggaggacagcgtgaagcccacccagcaggcccggcccaccgtcatccgctggagcgagggcggcaaggaggtgttcatcagcggcagcttcaacaactggagcaccaagatccccctcatcaagagccacaatgactttgtggccatcctggacctgcctgagggggagcaccagtacaagttctttgtggatggccagtgggtgcatgaccccagcgagcctgtggtgaccagccagctgggcaccatcaacaacctgatccacgtgaagaagagtgactttgaggtgtttgatgccctgaagctggacagcatggagagcagcgagaccagctgccgggacctgagcagcagccccccaggcccctacggccaggagatgtatgccttccgctctgaggagcgcttcaagagcccccccatcctgcccccccacctgctgcaggtgatcctgaacaaggacaccaacatcagctgtgaccctgccctgctgcctgagcccaaccacgtgatgctgaaccacctgtatgccctgagcatcaaggacagcgtgatggtgctgagcgccacccaccgctacaagaagaagtatgtgaccaccctgctgtacaagcccatctag

SEQ ID NO: 37164 - DNA, 573 bp, Artificial Sequence
  Description of Artificial Sequence: Synthetic coding sequence
atgccccggggccgcagcaccaggtcctggtggggcgtgaggaccaccccagcctgcagcgccagcctgacccccagccacaatgactttgtggccatcctggacctgcctgagggggagcaccagtacaagttctttgtggatggccagtgggtgcatgaccccagcgagcctgtggtgaccagccagctgggcaccatcaacaacctgatccacgtgaagaagagtgactttgaggtgtttgatgccctgaagctggacagcatggagagcagcgagaccagctgccgggacctgagcagcagccccccaggcccctacggccaggagatgtatgccttccgctctgaggagcgcttcaagagcccccccatcctgcccccccacctgctgcaggtgatcctgaacaaggacaccaacatcagctgtgaccctgccctgctgcctgagcccaaccacgtgatgctgaaccacctgtatgccctgagcatcaaggacagcgtgatggtgctgagcgccacccaccgctacaagaagaagtatgtgaccaccctgctgtacaagcccatctag

SEQ ID NO: 37165 - DNA, 1053 bp, Artificial Sequence
  Description of Artificial Sequence: Synthetic coding sequence
atggagaagcagccccagaacagcagaagaggcctggccccccgggaggtgcccccagctgtgggcctgctgctgatcatggccctgatgaacaccctgctgtacctgtgcctggaccacttcttcatcgccccccggcagagcacagtggaccccacccactgcccctacggccacttccgcatcggccagatgaagaactgcagcccctggctgagctgtgaggagctgaggacagaggtgcggcagctgaagagggtgggggagggcgctgtgaagagggtcttcctgtctgagtggaaggagcacaaggtggccctgagccagctgaccagcctggagatgaaggatgacttcctgcacggcctgcagatgctgaagagcctgcagggcacccacgtggtgaccctgctgggctactgtgaagatgacaacaccatgctgacagagtaccaccccctgggcagcctgagcaacctggaggagaccctgaacctgagcaagtaccagaatgtgaacacctggcagcaccggctggagctggccatggactatgtgtccatcatcaactacctgcaccacagccctgtgggcaccagggtgatgtgtgacagcaatgacctgcccaagaccctgagccagtacctgctgaccagcaacttcagcatcctggccaatgacctggatgccctgcccctggtgaaccacagcagcggcatgctggtgaagtgtggccaccgggagctgcacggggactttgtggcccctgagcagctgtggccctacggggaggatgtgcccttccatgatgacctgatgcccagctatgatgagaagattgacatctggaagatcccagacatcagcagcttcctgctgggccacatcgagggcagtgacatggtgcgcttccacctgtttgacatccacaaggcctgcaagagccagaccccatctgagcggcccacagcccaggatgtgctggagacctaccagaaggtgctggacaccctgagagatgccatgatgagccaggcccgggagatgctgtag

SEQ ID NO: 37166 - DNA, 585 bp, Artificial Sequence
  Description of Artificial Sequence: Synthetic coding sequence
atgggcgccgccgcctgggcccggcccctgtctgtgtccttcctgctgctgctgctgcccctgcccggcatgcctgctggctcctgggaccctgctggctacctgctgtactgcccctgcatgggccgcttcggcaaccaggccgaccacttcctgggcagcctggcctttgccaagctgctgaacagaaccctggccgtgcccccctggattgagtaccagcaccacaagccacccttcaccaacctgcacgtgtcctaccagaagtacttcaagctggagcccctgcaggcctaccacagggtcatcagcctggaggacttcatggagaagctggcccccacccactggcccccagagaagagggtggcctactgctttgaggtggccgcccagaggagcccagacaagaagacctgccccatgaaggagggcaaccccttcggccccttctgggaccagttccacgtgtccttcaacaagtctgagctgttcaccggcatctccttcagcgccagctaccgggagcagtggagccagaggcgggagaaccacagctgtgtgaccctgctcttccccaggtag

SEQ ID NO: 37167 - DNA, 1167 bp, Artificial Sequence
  Description of Artificial Sequence: Synthetic coding sequence
atgggcgccgccgcctgggcccggcccctgtctgtgtccttcctgctgctgctgctgcccctgcccggcatgcctgctggctcctgggaccctgctggctacctgctgtactgcccctgcatgggccgcttcggcaaccaggccgaccacttcctgggcagcctggcctttgccaagctgctgaacagaaccctggccgtgcccccctggattgagtaccagcaccacaagccacccttcaccaacctgcacgtgtcctaccagaagtacttcaagctggagcccctgcaggcctaccacagggtcatcagcctggaggacttcatggagaagctggcccccacccactggcccccagagaagagggtggcctactgctttgaggtggccgcccagaggagcccagacaagaagacctgccccatgaaggagggcaaccccttcggccccttctgggaccagttccacgtgtccttcaacaagtctgagctgttcaccggcatctccttcagcgccagctaccgggagcagtggagccagcgcttcagccccaaggagcaccctgtgctggccctgcccggggccccagcccagtttcctgtgctggaggagcaccggcccctgcagaagtacatggtgtggagcgatgagatggtgaagacaggagaggcccagatccacgcccacctggtgcggccctacgtgggcatccacctgagaattggaagtgactggaagaatgcctgtgccatgctgaaggatggaacagctggcagccacttcatggccagcccccagtgtgtgggctacagccgcagcacagctgcccccctgaccatgaccatgtgcctgcctgacctgaaggagatccagagagctgtgaagctgtgggtgcgcagcctggatgcccagagcgtgtatgtggccacagacagcgagagctatgtgcctgagctgcagcagctgttcaagggcaaggtgaaggtggtgtccctgaagccagaggtggcccaggtggacctgtacatcctgggccaggccgaccacttcatcggcaactgtgtgtcctccttcaccgcctttgtgaagcgggagcgggacctgcagggccggcccagcagcttcttcggcatggacaggcctcccaagctgagagatgagttctag

SEQ ID NO: 37168 - DNA, 534 bp, Artificial Sequence
  Description of Artificial Sequence: Synthetic coding sequence
atggtgtggagcgatgagatggtgaagacaggagaggcccagatccacgcccacctggtgcggccctacgtgggcatccacctgcgcatcggcagtgactggaagaatgcctgtgccatgctgaaggatggaacagctggcagccacttcatggccagcccccagtgtgtgggctacagccgcagcacagctgcccccctgaccatgaccatgtgcctgcctgacctgaaggagatccagagagctgtgaagctgtgggtgcgcagcctggatgcccagagcgtgtatgtggccacagattctgagagctatgtgcctgagctgcagcagctgttcaagggcaaggtgaaggtggtgtccctgaagccagaggtggcccaggtggacctgtacatcctgggccaggccgaccacttcatcggcaactgtgtgagcagcttcaccgcctttgtgaagcgggagcgggacctgcagggccggcccagcagcttcttcggcatggaccggccccccaagctgagagatgagttctag

SEQ ID NO: 37169 - DNA, 1275 bp, Artificial Sequence
  Description of Artificial Sequence: Synthetic coding sequence
atggccaccctgagctttgtgttcctgctgctgggcgctgtgtcctggcccccagccagcgccagcggccaggagttctggccaggccagagcgctgctgacatcctgtctggagctgccagcagaagacgctacctgctgtatgatgtgaaccccccagagggcttcaacctgcggagagatgtgtacatccgcatcgccagcctgctgaagaccctgctgaagacagaggagtgggtgctggtgctgcccccctggggccgcctgtaccactggcagagcccagacatccaccaggtgcgcatcccctggagcgagttctttgacctgcccagcctgaacaagaacatccctgtgattgaatatgagcagttcatcgccgagagcggcggccccttcatcgaccaggtgtatgtgctgcagagctatgcagagggctggaaggagggcacctgggaggagaaggtggatgagcggccctgcatcgaccagctgctgtacagccaggacaagcatgagtactaccggggctggttctggggctatgaggagacccggggcctgaatgtgtcctgcctgtctgtgcagggcagcgccagcatcgtggcccccctgctgctgaggaacaccagcgcccggtctgtgatgctggacagagctgagaacctgctgcatgaccactacggcggcaaggagtactgggacaccaggaggtccatggtgtttgcccggcacctgcgggaggtgggagatgagttccgcagccgccacctgaacagcacagatgatgctgaccgcatccccttccaggaggactggatgaagatgaaggtgaagctgggcagcgccctgggcggcccctacctgggcgtgcacctgcggaggaaggacttcatctggggccaccggcaggatgtgcccagcctggagggcgctgtgaggaagatccgcagcctgatgaagacccaccggctggacaaggtgtttgtggccacagatgctgtgaggaaggagtatgaggagctgaagaagctgctgcctgagatggtgcgctttgagcccacctgggaggagctggagctgtacaaggatggcggcgtggccatcatcgaccagtggatctgtgcccacgcccgctgcctgcccaccagcctgtctgctgagagcggcagcggcggcttccagcgcttcttctgccccaagtacagcgtgtctgagcagatggtggcctgtgtgcacagcggccacttccacacagtgtgcctgctggtgtag

SEQ ID NO: 37170 - DNA, 1290 bp, Artificial Sequence
  Description of Artificial Sequence: Synthetic coding sequence
atggccaccctgagctttgtgttcctgctgctgggcgctgtgtcctggcccccagccagcgccagcggccaggagttctggccaggccagagcgctgctgacatcctgtctggagctgccagcagaagacgctacctgctgtatgatgtgaaccccccagagggcttcaacctgcggagagatgtgtacatccgcatcgccagcctgctgaagaccctgctgaagacagaggagtgggtgctggtgctgcccccctggggccgcctgtaccactggcagagcccagacatccaccaggtgcgcatcccctggagcgagttctttgacctgcccagcctgaacaagaacatccctgtgattgaatatgagcagttcatcgccgagagcggcggccccttcatcgaccaggtgtatgtgctgcagagctatgcagagggctggaaggagggcacctgggaggagaaggtggatgagcggccctgcatcgaccagctgctgtacagccaggacaagcatgagtactaccggggctggttctggggctatgaggagacccggggcctgaatgtgtcctgcctgtctgtgcagggcagcgccagcatcgtggcccccctgctgctgaggaacaccagcgcccggtctgtgatgctggacagagctgagaacctgctgcatgaccactacggcggcaaggagtactgggacaccaggaggtccatggtgtttgcccggcacctgcgggaggtgggagatgagttccgcagccgccacctgaacagcacagatgatgctgaccgcatccccttccaggaggactggatgaagatgaaggtgaagctgggcagcgccctgggcggcccctacctgggcgtgcacctgcggaggaaggacttcatctggggccaccggcaggatgtgcccagcctggagggcgctgtgaggaagatccgcagcctgatgaagacccaccggctggacaaggtgtttgtggccacagatgctgtgaggaaggagtatgaggagctgaagaagctgctgcctgagatggtgcgctttgagcccacctgggaggagctggagctgtacaaggatggcggcgtggccatcatcgaccagtggatctgtgcccacgcccgcttcttcatcggcacctctgtgtccaccttctccttccgcatccacgaggagcgggagatcctgggcctggaccccaagaccacctacaaccgcttctgtggggaccaggagaaggcctgtgagcagcccacccactggaagatcacctactag

SEQ ID NO: 37171 - DNA, 1179 bp, Artificial Sequence
  Description of Artificial Sequence: Synthetic coding sequence
atggagtggtgggccagcagccccctgcggctgtggctgctgctcttcctgctgcccagcgcccagggccggcagaaggagagcggcagcaagtggaaggtgttcatcgaccagatcaacagaagcctggagaactatgagccctgcagcagccagaactgcagctgctaccacggcgtgattgaggaggacctgacccccttccggggcggcatcagcaggaagatgatggccgaggtggtgcggaggaagctgggcacccactaccagatcaccaagaaccggctgtacagagaaaatgactgcatgttccccagccgctgcagcggcgtggagcacttcatcctggaggtgattggccgcctgcctgacatggagatggtgatcaacgtgcgggactacccccaggtgcccaagtggatggagcccgccatccctgtgttctccttcagcaagaccagcgagtaccatgacatcatgtacccagcctggaccttctgggagggcggccctgctgtgtggcccatctaccccaccggcctgggccgctgggacctcttccgggaggacctggtgcgctctgctgcccagtggccctggaagaagaagaacagcacagcctacttccggggcagcaggaccagccctgagcgggaccccctcatcctgctgagcaggaagaaccccaagctggtggatgctgagtacaccaagaaccaggcctggaagtccatgaaggacaccctgggcaagccagctgccaaggatgtgcacctggtggaccactgcaagtacaagtacctgttcaacttccggggcgtggccgccagcttccgcttcaagcacctgttcctgtgtggcagcctggtgttccacgtgggagatgagtggctggagttcttctacccccagctgaagccctgggtgcactacatccctgtgaagacagacctgagcaatgtgcaggagctgctgcagtttgtgaaggccaatgatgatgtggcccaggagattgctgagcggggcagccagttcatccggaaccacctgcagatggatgacatcacctgctactgggagaacctgctgtctgagtacagcaagttcctgagctacaacgtgaccaggaggaagggctatgaccagatcatccccaagatgctgaagacagagctgtag

SEQ ID NO: 37172 - DNA, 3273 bp, Artificial Sequence
  Description of Artificial Sequence: Synthetic coding sequence
atgatgcccatgatcctgactgtgttcctgagcaacaatgagcagatcctgacagaggtgcccatcaccccagagaccacctgcagagatgtggtggagttctgcaaggagcccggggagggcagctgccacctggccgaggtgtggagaggaaatgaaagacccatcccctttgaccacatgatgtatgagcacctgcagaagtggggcccccggcgggaggaggtgaagttcttcctgcggcatgaggacagccccacagagaacagcgagcagggcggccggcagacccaggagcagaggacccagagaaatgtcatcaacgtgcctggagagaagaggacagaaaatggagtgggcaacccccgggtggagctgaccctgtctgagctgcaggacatggccgcccggcagcagcagcagatcgagaaccagcagcagatgctggtggccaaggagcagaggctgcacttcctgaagcagcaggagcggcggcagcagcagagcatcagtgaaaatgagaagctgcagaagctgaaggagcgggtggaggcccaggagaacaagctgaagaagatccgggccatgaggggccaggtggactacagcaagatcatgaatggaaacctgtctgctgagattgagcgcttcagcgccatgttccaggagaagaagcaggaggtgcagacagccatcctgcgggtggaccagctgagccagcagctggaggacctgaagaagggcaagctgaatggcttccagagctacaacgggaagctgactggacctgctgctgtggagctgaagaggctgtaccaggagctgcagatccggaaccagctgaaccaggagcagaacagcaagctgcagcagcagaaggagctgctgaacaagaggaacatggaggtggccatgatggacaagaggatcagcgagctgcgggagcggctgtatggcaagaagatccagctgaacagagtgaatggcaccagcagcccccagagccccctgagcaccagcggccgggtggccgctgtgggcccctacatccaggtgcccagcgctggcagcttccctgtgctgggggaccccatcaagccccagagcctgagcatcgccagcaatgctgcccacggccgcagcaagagcgccaatgatggcaactggcccaccctgaagcagaacagcagcagctctgtgaagcctgtgcaggtggccggggctgactggaaggaccccagcgtggagggctctgtgaagcagggcaccgtgagcagccagcctgtgcccttcagcgccctgggccccacagagaagccaggcatcgagatcggcaaggtgcccccacccatccctggggtgggcaagcagctgcccccatcctatggcacctaccccagccccacccccctgggccctggcagcaccagcagcctggagaggaggaaggagggcagcctgccccggcccagcgctggcctgcccagccggcagaggcccaccctgctgcctgccaccggcagcaccccccagcccggcagcagccagcagatccagcagaggatctctgtgccccccagccccacctacccacctgctggccccccagccttccctgctggggacagcaagccagagctgcccctgactgtggccatccggcccttcctggccgacaagggcagccggccccagagccccaggaagggcccccagacagtgaacagcagcagcatctacagcatgtacctgcagcaggccaccccacccaagaactaccagcctgctgcccacagcgccctgaacaagtctgtgaaggctgtgtatggcaagcctgtgctgcccagcggcagcaccagccccagccccctgcccttcctgcacggcagcctgagcacaggcaccccccagccccagccccccagcgagagcacagagaaggagcctgagcaggacggccctgctgccccagcagatggcagcacagtggagagcctgccccggcccctgagccccaccaagctgacccccatcgtgcacagccccctgcgctaccagagtgatgctgacctggaggccctgcggaggaagctggccaatgccccccggcccctgaagaagaggagcagcatcacagagcctgagggccctgggggccccaacatccagaagctgctgtaccagcgcttcaacaccctggccggcggcatggagggcacccccttctaccagcccagccccagccaggacttcatgggcaccctggctgatgtggacaatggaaacaccaatgccaacggcaacctggaggagctgcccccagcccagcccacagcccccctgcctgctgagcccgcccccagcagtgatgccaatgacaatgagctgcccagccctgagcctgaggagctgatctgcccccagaccacccaccagacagctgagcctgctgaggacaacaacaacaacgtggccaccgtgcccaccacagagcagatccccagccctgtggccgaggcccccagccctggagaggagcaggtgcccccagcccccctgcccccagccagccaccccccagccaccagcaccaacaagaggaccaacctgaagaagcccaacagcgagaggacaggccacggcctgcgggtgcgcttcaaccccctggccctgctgctggatgccagcctggagggggagtttgacctggtgcagaggatcatctatgaggtggaggaccccagcaagcccaatgatgagggcatcacccccctgcacaatgctgtgtgtgccggccaccaccacatcgtgaagttcctgctggactttggagtgaatgtgaatgctgctgacagtgatggctggacccccctgcactgtgccgccagctgcaacagcgtgcacctgtgcaagcagctggtggagagcggggccgccatctttgccagcaccatcagtgacatcgagacagctgctgacaagtgtgaggagatggaggagggctacatccagtgcagccagttcctgtatggagtgcaggagaagctgggcgtgatgaacaagggcgtggcctatgccctgtgggactatgaggcccagaacagtgatgagctgtccttccatgaaggagatgccctgaccatcctgcggaggaaggatgaaagtgaaacagagtggtggtgggcccggctgggggaccgggagggctacgtgcccaagaacctgctgggcctgtacccccgcatcaagccccggcagaggaccctggcctag

SEQ ID NO: 37173 - DNA, 1884 bp, Artificial Sequence
  Description of Artificial Sequence: Synthetic coding sequence
atggccgcccggcagcagcagcagatcgagaaccagcagcagatgctggtggccaaggagcagaggctgcacttcctgaagcagcaggagcggcggcagcagcagagcatcagtgaaaatgagaagctgcagaagctgaaggagcgggtggaggcccaggagaacaagctgaagaagatccgggccatgaggggccaggtggactacagcaagatcatgaatggaaacctgtctgctgagattgagcgcttcagcgccatgttccaggagaagaagcaggaggtgcagacagccatcctgcgggtggaccagctgagccagcagctggaggacctgaagaagggcaagctgaatggcttccagagctacaacgggaagctgaccggccctgctgctgtggagctgaagaggctgtaccaggagctgcagatccggaaccagctgaaccaggagcagaacagcaagctgcagcagcagaaggagctgctgaacaagaggaacatggaggtggccatgatggacaagaggatcagcgagctgcgggagcggctgtatggcaagaagatccagctgaacagagtgaatggcaccagcagcccccagagccccctgagcaccagcggccgggtggccgctgtgggcccctacatccaggtgcccagcgctggcagcttccctgtgctgggggaccccatcaagccccagagcctgagcatcgccagcaatgctgcccacggccgcagcaagagcgccaatgatggcaactggcccaccctgaagcagaacagcagcagctctgtgaagcctgtgcaggtggccggggctgactggaaggaccccagcgtggagggctctgtgaagcagggcaccgtgagcagccagcctgtgcccttcagcgccctgggccccacagagaagccaggcattgaaattggcaaggtgcccccacccatccctggggtgggcaagcagctgccccccagctatggcacctaccccagccccacccccctgggccctggcagcaccagcagcctggagaggaggaaggagggcagcctgccccggcccagcgctggcctgcccagccggcagaggcccaccctgctgcctgccaccggcagcaccccccagcccggcagcagccagcagatccagcagaggatctctgtgccccccagccccacctaccccccagctggccccccagccttccctgctggggacagcaagccagagctgcccctgactgtggccatccggcccttcctggccgacaagggcagccggccccagagccccaggaagggcccccagacagtgaacagcagcagcatctacagcatgtacctgcagcaggccaccccacccaagaactaccagcctgctgcccacagcgccctgaacaagtctgtgaaggctgtgtatggcaagcctgtgctgcccagcggcagcaccagccccagccccctgcccttcctgcacggcagcctgagcacaggcaccccccagccccagcccccatctgagagcacagagaaggagcctgagcaggacggccctgctgccccagcagatggcagcacagtggagagcctgccccggcccctgagccccaccaagctgacccccatcgtgcacagccccctgcgctaccagagtgatgctgacctggaggccctgcggaggaagctggccaatgccccccggcccctgaagaagaggagcagcatcacagagcctgagggcccccccttcctgcctgcccagcccctgcccggcctgcacggccacctgggccgctgtggccagtggaagcaccagtgccagtggaagccaggccgggccccaccctgcccagcccacagccccaccccaagatag

SEQ ID NO: 37174 - DNA, 1197 bp, Artificial Sequence
  Description of Artificial Sequence: Synthetic coding sequence
atgtacctgcagcaggccaccccacccaagaactaccagcctgctgcccacagcgccctgaacaagtctgtgaaggctgtgtatggcaagcctgtgctgcccagcggcagcaccagccccagccccctgcccttcctgcacggcagcctgagcacaggcaccccccagccccagcccccatctgagagcacagagaaggagcctgagcaggacggccctgctgccccagcagatggcagcacagtggagagcctgccccggcccctgagccccaccaagctgacccccatcgtgcacagccccctgcgctaccagagtgatgctgacctggaggccctgcggaggaagctggccaatgccccccggcccctgaagaagaggagcagcatcacagagcctgagggccctgggggccccaacatccagaagctgctgtaccagcgcttcaacaccctggccggcggcatggagggcacccccttctaccagcccagccccagccaggacttcatgggcaccctggctgatgtggacaatggaaacaccaatgccaatggaaacctggaggagctgcccccagcccagcccacagcccccctgcctgctgagcccgcccccagcagtgatgccaatgacaatgagctgcccagccctgagcctgaggagctgatctgcccccagaccacccaccagacagctgagcctgctgaggacaacaacaacaacgtggccaccgtgcccaccacagagcagatccccagccctgtggccgaggcccccagccctggagaggagcaggtgcccccagcccccctgcccccagccagccaccccccagccaccagcaccaacaagaggaccaacctgaagaagcccaacagcgagaggactggacatggcctgcgggtgcgcttcaaccccctggccctgctgctggatgccagcctggagggggagtttgacctggtgcagaggatcatctatgaggtggaggaccccagcaagcccaatgatgagggcatcacccccctgcacaatgctgtgtgtgccggccaccaccacatcgtgaagttcctgctggactttggagtgaatgtgaatgctgctgacagtgatggctggggcgctgggaaggccggctgtgatgagcagagatgtggggtgtgcagcgtgggcctgcggggccctgagcagtag

SEQ ID NO: 37175 - DNA, 1908 bp, Artificial Sequence
  Description of Artificial Sequence: Synthetic coding sequence
tgagtgggcccctacatccaggtgcccagcgctggcagcttccctgtgctgggggaccccatcaagccccagagcctgagcatcgccagcaatgctgcccacggccgcagcaagagcgccaatgatggcaactggcccaccctgaagcagaacagcagcagctctgtgaagcctgtgcaggtggccggggctgactggaaggaccccagcgtggagggctctgtgaagcagggcaccgtgagcagccagcctgtgcccttcagcgccctgggccccacagagaagccaggcatcgagatcggcaaggtgcccccacccatccctggggtgggcaagcagctgcccccatcctatggcacctaccccagccccacccccctgggccctggcagcaccagcagcctggagaggaggaaggagggcagcctgccccggcccagcgctggcctgcccagccggcagaggcccaccctgctgcctgccaccggcagcaccccccagcccggcagcagccagcagatccagcagaggatctctgtgccccccagccccacctacccacctgctggccccccagccttccctgctggggacagcaagccagagctgcccctgactgtggccatccggcccttcctggccgacaagggcagccggccccagagccccaggaagggcccccagacagtgaacagcagcagcatctacagcatgtacctgcagcaggccaccccacccaagaactaccagcctgctgcccacagcgccctgaacaagtctgtgaaggctgtgtatggcaagcctgtgctgcccagcggcagcaccagccccagccccctgcccttcctgcacggcagcctgagcacaggcaccccccagccccagccccccagcgagagcacagagaaggagcctgagcaggacggccctgctgccccagcagatggcagcacagtggagagcctgccccggcccctgagccccaccaagctgacccccatcgtgcacagccccctgcgctaccagagtgatgctgacctggaggccctgcggaggaagctggccaatgccccccggcccctgaagaagaggagcagcatcacagagcctgagggccctgggggccccaacatccagaagctgctgtaccagcgcttcaacaccctggccggcggcatggagggcacccccttctaccagcccagccccagccaggacttcatgggcaccctggctgatgtggacaatggaaacaccaatgccaacggcaacctggaggagctgcccccagcccagcccacagcccccctgcctgctgagcccgcccccagcagtgatgccaatgacaatgagctgcccagccctgagcctgaggagctgatctgcccccagaccacccaccagacagctgagcctgctgaggacaacaacaacaacgtggccaccgtgcccaccacagagcagatccccagccctgtggccgaggcccccagccctggagaggagcaggtgcccccagcccccctgcccccagccagccaccccccagccaccagcaccaacaagaggaccaacctgaagaagcccaacagcgagaggacaggccacggcctgcgggtgcgcttcaaccccctggccctgctgctggatgccagcctggagggggagtttgacctggtgcagaggatcatctatgaggtggaggaccccagcaagcccaatgatgagggcatcacccccctgcacaatgctgtgtgtgccggccaccaccacatcgtgaagttcctgctggactttggagtgaatgtgaatgctgctgacagtgatggctggggcgccggcaaggccggctgtgatgagcagagatgtggggtgtgcagcgtgggcctgcggggccctgagcagtag

SEQ ID NO: 37176 - DNA, 1587 bp, Artificial Sequence
  Description of Artificial Sequence: Synthetic coding sequence
atggccgagcacctggagctgctggccgagatgcccatggtgggccgcatgagcacccaggagcggctgaagcacgcccagaagagaagagcccagcaggtgaagatgtgggcccaggccgagaaggaggcccagggcaagaagggccctggagagcggcccaggaaggaggccgccagccagggcctgctgaagcaggtgctcttcccccccagcgtggtgctgctggaggccgccgccagaaatgacctggaggaggtgcggcagttcctgggcagcggcgtgtccccagacctggccaatgaagatggcctgacagccctgcaccagtgctgcattgatgacttccgggagatggtgcagcagctgctggaggccggggccaacatcaatgcctgtgacagcgagtgctggacccccctgcatgctgctgccacctgtggccacctgcacctggtggagctgctgattgccagcggggccaacctgctggccgtgaacacagatggcaacatgccctatgacctgtgtgatgatgagcagaccctggactgcctggagacagccatggctgaccggggcatcacccaggacagcattgaggccgcccgggctgtgcctgagctgaggatgctggatgacatccgcagccggctgcaggccggggctgacctgcacgcccccctggaccatggagccaccctgctgcacgtggccgccgccaacggcttcagcgaggccgccgccctgctgctggagcaccgggccagcctgagcgccaaggaccaggacggctgggagcccctgcatgctgctgcctactggggccaggtgcccctggtggagctgctggtggcccatggagctgacctgaatgccaagagcctgatggatgagacccccctggatgtgtgtggagatgaggaggtgcgggccaagctgctggagctgaagcacaagcatgatgccctgctgcgggcccagagccggcagaggagcctgctgcggcggaggaccagcagcgctggcagccggggcaaggtggtgcggcgggtgtccctgacccagaggacagacctgtacaggaagcagcacgcccaggaggccatcgtgtggcagcagcccccacccaccagccctgagcccccagaggacaatgatgaccggcagacaggagctgagctgcggcccccacctcctgaggaggacaaccctgaggtggtgcggccccacaacggccgggtgggcggcagccctgtgcgccacctgtacagcaagaggctggacagatctgtgtcctaccagctgagccccctggacagcaccaccccccacaccctggtgcatgacaaggcccaccacaccctggccgacctgaagaggcagagagctgctgccaagctgcagaggcctcctcctgagggccctgagagccctgagacagctgagcccggcctgcccggggacacagtgaccccccagcctgactgtggcttccgggccggcggggacccccccctgctgaagctgacagccccagctgtggaggcccctgtggagcggcggccctgctgcctgctgatgtag

SEQ ID NO: 37177 - DNA, 1587 bp, Artificial Sequence; identical to SEQ ID NO: 37176
  Description of Artificial Sequence: Synthetic coding sequence

SEQ ID NO: 37178 - DNA, 840 bp, Artificial Sequence
  Description of Artificial Sequence: Synthetic coding sequence
atgagccgggagcggcccccaggcacagacatccccaggaacctgtccttcatcgccgccctgacagagcgggcctactaccgcagccagaggcccagcctggaggaggagcctgaggaggagcccggggagggcggcaccaggtttggagcccggagccgggcccacgcccccagccggggccggcgggcccggagcgccccagctgggggcggcggggcccgggcccccaggagccgcagcccagacaccaggaagagggtgcgctttgctgatgccctgggcctggagctggccgtggtgcggcgcttccggcctggagagctgccccgggtgcccaggcatgtgcagatccagctgcagagagatgccctgcggcactttgccccctgccagccccgggcccggggcctgcaggaggcccgggccgccctggagcccgccagcgagcccggctttgctgcccggctgctgacccagaggatctgcctggagagagctgaggccggccccctgggcgtggccggcagcgcccgggtggtggacctggcctatgagaagagggtgtctgtgcgctggagcgcagatggctggaggagccagcgggaggccccagctgcctatgccggccctgcccctcctccacccagggctgacagatttgccttccggctgcctgccccacccatcggcggggccctgctgtttgccctgcgctacagagtgactggacatgagttctgggacaacaatggaggccgggactatgccctgcggggccctgagcaccctggcagcggcggggcccctgagccccagggctggatccacttcatctag

SEQ ID NO: 37179 - DNA, 150 bp, Artificial Sequence
  Description of Artificial Sequence: Synthetic coding sequence
tgaggagccctgctgtttgccctgcgctacagagtgactggacatgagttctgggacaacaatggaggccgggactatgccctgcggggccctgagcaccctggcagcggcggggcccctgagccccagggctggatccacttcatctag

SEQ ID NO: 37180 - DNA, 105 bp, Artificial Sequence
  Description of Artificial Sequence: Synthetic coding sequence
tgattctgggacaacaacggcggccgggactatgccctgcggggccctgagcaccctggcagcggcggggcccctgagccccagggctggatccacttcatctag

SEQ ID NO: 37181 - DNA, 57 bp, Artificial Sequence
  Description of Artificial Sequence: Synthetic coding sequence
gagcaccctggcagcggcggggcccctgagccccagggctggatccacttcatctag

SEQ ID NO: 37182 - DNA, 90 bp, Artificial Sequence
  Description of Artificial Sequence: Synthetic coding sequence
aatggaggccgggactatgccctgcggggccctgagcaccctggcagcggcggggcccctgagccccagggctggatccacttcatctag

SEQ ID NO: 37183 - DNA, 42 bp, Artificial Sequence
  Description of Artificial Sequence: Synthetic coding sequence
tgaggagcccctgagccccagggctggatccacttcatctag

SEQ ID NO: 37184 - DNA, 2400 bp, Artificial Sequence
  Description of Artificial Sequence: Synthetic coding sequence
atggccaggacagcccctgtggagccccccctgcggcacagcgccccacccagccctgctgctggggagcccaggacctctgtggaggccgctgtggcccccaggagagtgctgtttgctgatgaggccctgggcctgcccctggcccagctgcggcgctaccggccctggggcggccctggggccggcaagatggctgctgctgctggccaggacggcggcggcggcggcggcgcagatgaagatgatgatggagaagatggagatgaaggagaggaggaggaggaggcctgcccagagcccagccccctgtgccctgtgcctgctgggggcggcttctacctggtgcccaccttcagcctgcccccagcccctggccgcctggagcggctgggccgggtgatggtggagctggaggccctgctgcccccacctggagctgtgcctggaggagctggggtgtgggtgcctgggggccggccccctgtgctgcggggcctggtgcgggtgctgaacagaagctttgagaaggctgtgcacgtgcgggccagccatgatggctgggccagcttctgtgaccacccagcccgctacgtgcccaggagccccccctgggccggggccggcggcactggagctggggaccccatcctggaccccggcctgggcctgggccctggccaggccagcgccagcagcccagatgatggcggccgcacagacagatttgccttccagctgccctttgctgagggcgctggagatggagcccggctggactttgtggtgcgctatgagaccccagagggcaccttctgggccaacaaccacggcaggaactacacagtgctgctgagaattgccccagcccccacccccacagatgctgagggcctgccccagcagcagcagctgccccagctggagccccagcctgagtgccagggccctgtggaggccgaggcccggcagctgaagagctgcatgaagcctgtgagaagaagacctgctgaggaggagctgaagaccaagaacatggatgacaacacctttgccatggccgagcacccagatgtgcaggagagcgtgggccccctggtggcccccacccccctgcggccctggccccagatgaccctgcaggtgtctgatgtgcccatgacaggcaacccagctgaggagggagatgtgcccaggagcagcccccctgtggccttcacagaggtgctgcaggccccagccatccgcatcccccccagcagccccctgtgtggcctgggcggcagcccccgggaccaggccagcggcccagatgccagcgagggcgccaccggccccttcctggagcccagccagcagcaggccgaggccacctggggcgtgtccagtgaaaatggaggcggcctggaggccgtgtctggcagcgaggagctgctgggggaggacaccatcgaccaggagctggagcagctgtacctgagccacctgagccggctgcgggctgctgtggccgccggcggggccggcggcggcggggagggcagcacagatggcggcatgagccccagccaccccctgggcatcctgacagaccgggacctgatcctgaagtggccaggccctgagcgggccctgaacagcgccctggccgaggagatcaccctgcactacgcccggctgggccggggcgtggagctgatcaaggacacagaagatcctgatgatgaaggagagggggaggagggcctgtctgtgacccccagcagccctgagggggacagccccaaggagagccccccagagatcctgagcggggcccggtctgtggtggccaccatgggagatgtgtggctgccctgggccgagggcagcggctgtgatggccctgtggtgctgggcacagagggccagttcatcggggaccctgagaagggcatgggcaaggacaccagcagcctgcacatgaacagagtgattgctggggtgacagagagcctgggggaggccggcacagaggcccagatcgaggtgaccagcgagtgggccggcagcctggaccccatcagcggcaaggagcccgccagccctgtgctgctgcagggccagaaccccaccctgctgagccccctgggcgctgaggtgtgcctgagctctgtggcccggccccacgtgagcagccaggatgagaaggatgctggccccagcctggagccccccaagaagagccccaccctggccgtgcctgcagaatgtgtgtgtgccctgcccccccagctgcggggccccctgacccagaccctgggcgtgctggccggcctggtggtggtgcctgtggccctgaacagcggcgtgtccctgctggtgctggccctgtgcctgagcctggcctggttctcctag

SEQ ID NO: 37185 - DNA, 1413 bp, Artificial Sequence
  Description of Artificial Sequence: Synthetic coding sequence
atgaagcctgtgagaagaagacctgctgaggaggagctgaagaccaagaacatggatgacaacacctttgccatggagcacccagatgtgcaggagagcgtgggccccctggtggcccccacccccctgcggccctggccccagatgaccctgcaggtgtctgatgtgcccatgactggaaatcctgctgaggagggagatgtgcccaggagcagcccccctgtggccttcacagaggtgctgcaggccccagccatccgcatcccccccagcagccccctgtgtggcctgggcggcagcccccgggaccaggccagcggcccagatgccagcgagggcgccaccggccccttcctggagcccagccagcagcaggccgaggccacctggggcgtgtccagtgaaaatggaggcggcctggaggccgtgtctggcagcgaggagctgctgggggaggacaccatcgaccaggagctggagcagctgtacctgagccacctgagccggctgcgggctgctgtggccgccggcggggccggcggcggcggggagggcagcacagatggcggcatgagccccagccaccccctgggcatcctgacagaccgggacctgatcctgaagtggccaggccctgagcgggccctgaacagcgccctggccgaggagatcaccctgcactacgcccggctgggccggggcgtggagctgatcaaggacacagaggaccctgatgatgaaggagagggggaggagggcctgtctgtgacccccagcagccctgagggggacagccccaaggagagccccccagagatcctgagcggggcccggtctgtggtggccaccatgggagatgtgtggctgccctgggccgagggcagcggctgtgatggccctgtggtgctgggcacagagggccagttcatcggggaccctgagaagggcatgggcaaggacaccagcagcctgcacatgaacagagtgattgctggggtgacagagagcctgggggaggccggcacagaggcccagatcgaggtgaccagcgagtgggccggcagcctggaccccatcagcggcaaggagcccgccagccctgtgctgctgcagggccagaaccccaccctgctgagccccctgggcgctgaggtgtgcctgagctctgtggcccggccccacgtgagcagccaggatgagaaggatgctggccccagcctggagccccccaagaagagccccaccctggccgtgcctgcagaatgtgtgtgtgccctgcccccccagctgcggggccccctgacccagaccctgggcgtgctggccggcctggtggtggtgcctgtggccctgaacagcggcgtgtccctgctggtgctggccctgtgcctgagcctggcctggttctcctag

SEQ ID NO: 37186 - DNA, 1368 bp, Artificial Sequence
  Description of Artificial Sequence: Synthetic coding sequence
atgttctgcagcggcaggaagtgggtggccgaggccaccatctgcaccaagctgatgaagcgggagaagaggaggatgggcaagagaagagccaagaaggccaagcgggaggagaagaagaagggcggggagaggagaagaaatgagaagaggggcaaccagatgaagaggatgtgtgagaggaagaagtatgaaacagacctggaggaccaggacatcatgggcgccttcctggacaagcccaagatggagaagcacaatgcccagggccagggcaatggcctgcgctatggcctgagctccatgcagggctggagggtggagatggaggatgcccacacagctgtgattggcctgcccagcggcctggagagctggagcttctttgctgtgtatgatggccacgccggcagccaggtggccaagtactgctgtgagcacctgctggaccacatcaccaacaaccaggacttcaagggcagcgctggggcccccagcgtggagaatgtgaagaatggcatcagaacaggcttcctggagattgatgagcacatgagggtgatgtctgagaagaagcatggagctgacaggagcggcagcacagctgtgggcgtgctgatcagcccccagcacacctacttcatcaactgtggggacagccggggcctgctgtgcaggaacaggaaggtgcacttcttcacccaggaccacaagcccagcaaccccctggagaaggagcgcatccagaatgccggcggctctgtgatgatccagagggtgaatggcagcctggccgtgtcccgggccctgggggactttgactacaagtgtgtgcacggcaagggccccacagagcagctggtgtccccagagcctgaggtgcatgacatcgagaggtctgaggaggatgaccagttcatcatcctggcctgtgatggcatctgggatgtgatgggaaatgaggagctgtgtgactttgtgcgcagccggctggaggtgacagatgacctggagaaggtgtgcaatgaggtggtggacacctgcctgtacaagggcagccgggacaacatgtctgtcatcctgatctgcttccccaatgcccccaaggtgtccccagaggccgtgaagaaggaggccgagctggacaagtacctggagtgccgggtggaggagatcatcaagaagcagggcgagggcgtgcctgacctggtgcacgtgatgaggaccctggccagcgagaacatccccagcctgcccccaggaggagagctggccagcaagagaaatgtgattgaagctgtgtacaaccggctgaacccctacaagaatgatgacacagacagcaccagcacagatgacatgtggtag

SEQ ID NO: 37187 - DNA, 975 bp, Artificial Sequence
  Description of Artificial Sequence: Synthetic coding sequence
atgggcgccttcctggacaagcccaagatggagaagcacaatgcccagggccagggcaatggcctgcgctatggcctgagctccatgcagggctggagggtggagatggaggatgcccacacagctgtgattggcctgcccagcggcctggagagctggagcttctttgctgtgtatgatggccatgctggcagccaggtggccaagtactgctgtgagcacctgctggaccacatcaccaacaaccaggacttcaagggcagcgctggggcccccagcgtggagaatgtgaagaatggcatcagaacaggcttcctggagattgatgagcacatgagggtgatgtctgagaagaagcacggggctgacagaagtggcagcacagctgtgggcgtgctgatcagcccccagcacacctacttcatcaactgtggggacagccggggcctgctgtgcaggaacaggaaggtgcacttcttcacccaggaccacaagcccagcaaccccctggagaaggagcgcatccagaatgctgggggctctgtgatgatccagagggtgaatggcagcctggccgtgtcccgggccctgggggactttgactacaagtgtgtgcacggcaagggccccacagagcagctggtgtccccagagcctgaggtgcatgacatcgagaggagtgaagaagatgaccagttcatcatcctggcctgtgatggcatctgggatgtgatgggaaatgaggagctgtgtgactttgtgcgcagccggctggaggtgacagatgacctggagaaggtgtgcaatgaggtggtggacacctgcctgtacaagggcagccgggacaacatgtctgtcatcctgatctgcttccccaatgcccccaaggtgtccccagaggccgtgaagaaggaggccgagctggacaagtacctggagtgccgggtggagggcggcagcttcaacaagaagtag

SEQ ID NO: 37188 - DNA, 1149 bp, Artificial Sequence
  Description of Artificial Sequence: Synthetic coding sequence
atgggcgccttcctggacaagcccaagatggagaagcacaatgcccagggccagggcaatggcctgcgctatggcctgagctccatgcagggctggagggtggagatggaggatgcccacacagctgtgattggcctgcccagcggcctggagagctggagcttctttgctgtgtatgatggccatgctggcagccaggtggccaagtactgctgtgagcacctgctggaccacatcaccaacaaccaggacttcaagggcagcgctggggcccccagcgtggagaatgtgaagaatggcatcagaacaggcttcctggagattgatgagcacatgagggtgatgtctgagaagaagcacggggctgacagaagtggcagcacagctgtgggcgtgctgatcagcccccagcacacctacttcatcaactgtggggacagccggggcctgctgtgcaggaacaggaaggtgcacttcttcacccaggaccacaagcccagcaaccccctggagaaggagcgcatccagaatgctgggggctctgtgatgatccagagggtgaatggcagcctggccgtgtcccgggccctgggggactttgactacaagtgtgtgcacggcaagggccccacagagcagctggtgtccccagagcctgaggtgcatgacatcgagaggagtgaagaagatgaccagttcatcatcctggcctgtgatggcatctgggatgtgatgggaaatgaggagctgtgtgactttgtgcgcagccggctggaggtgacagatgacctggagaaggtgtgcaatgaggtggtggacacctgcctgtacaagggcagccgggacaacatgtctgtcatcctgatctgcttccccaatgcccccaaggtgtccccagaggccgtgaagaaggaggccgagctggacaagtacctggagtgccgggtggaggagatcatcaagaagcagggcgagggcgtgcctgacctggtgcacgtgatgaggaccctggccagcgagaacatccccagcctgcccccaggaggagagctggccagcaagagaaatgtcatcgaggccgtgtacaaccggctgaacccctacaagaatgatgacacagacagcaccagcacagatgacatgtggtag

SEQ ID NO: 37189 - DNA, 564 bp, Artificial Sequence
  Description of Artificial Sequence: Synthetic coding sequence
atgggcgccttcctggacaagcccaagatggagaagcacaatgcccagggccagggcaatggcctgcgctatggcctgagctccatgcagggctggagggtggagatggaggatgcccacacagctgtgattggcctgcccagcggcctggagagctggagcttctttgctgtgtatgatggccatgctggcagccaggtggccaagtactgctgtgagcacctgctggaccacatcaccaacaaccaggacttcaagggcagcgctggggcccccagcgtggagaatgtgaagaatggcatcagaacaggcttcctggagattgatgagcacatgagggtgatgtctgagaagaagcacggggctgacagaagtggcagcacagctgtgggcgtgctgatcagcccccagcacacctacttcatcaactgtggggacagccggggcctgctgtgcaggaacaggaaggtgcacttcttcacccaggaccacaagcccagcaaccccctggagaaggagcgcatccagaatgctgggggctctgtgatgatccagagggtgtag

SEQ ID NO: 37190 - DNA, 390 bp, Artificial Sequence
  Description of Artificial Sequence: Synthetic coding sequence
atgggcgccttcctggacaagcccaagatggagaagcacaatgcccagggccagggcaatggcctgcgctatggcctgagctccatgcagggctggagggtggagatggaggatgcccacacagctgtgattggcctgcccagcggcctggagagctggagcttctttgctgtgtatgatggccatgctggcagccaggtggccaagtactgctgtgagcacctgctggaccacatcaccaacaaccaggacttcaagggcagcgctggggcccccagcgtggagaatgtgaagaatggcatcagaacaggcttcctggagattgatgagcacatgagggtgatgtctgagaagaagcacggggctgacagaagtggcagcacagcctag

SEQ ID NO: 37191 - DNA, 1149 bp, Artificial Sequence; identical to SEQ ID NO: 37188
  Description of Artificial Sequence: Synthetic coding sequence

SEQ ID NO: 37192 - DNA, 447 bp, Artificial Sequence
  Description of Artificial Sequence: Synthetic coding sequence
atgggcgccttcctggacaagcccaagatggagaagcacaatgcccagggccagggcaatggcctgcgctatggcctgagctccatgcagggctggagggtggagatggaggatgcccacacagctgtgattggcctgcccagcggcctggagagctggagcttctttgctgtgtatgatggccatgctggcagccaggtggccaagtactgctgtgagcacctgctggaccacatcaccaacaaccaggacttcaagggcagcgctggggcccccagcgtggagaatgtgaagaatggcatcagaacaggcttcctggagattgatgagcacatgagggtgatgtctgagaagaagcacggggctgacagaagtggcagcacagctgtgggcgtgctgatcagcccccagcacacctacttcatcaactgtggggacagcaggtag

SEQ ID NO: 37193 - DNA, 2367 bp, Artificial Sequence
  Description of Artificial Sequence: Synthetic coding sequence
acccactacctgagccctggcctgagtgacttctacctgaaccacagccctgccagcacctgcaccctgcggcgcagcctgggcagcgagaccgggaagtgcctgcctgcccacagcctgctgcccaagttcttcccctgcagagaagatgtgcacaaggtggacatcatgaccttctgccagcagaaggccgcccagagctgcaagtctgagaccctgggcagccgggacagcgccctgctgtggcagctgctggtgctgctgtgccggcagaatggctccatggtgggcagtgacattgctgagctgctgatgcaggactgcaagaagctggagaagtacaagaggcagccccctgtggccaacctgatcaacctgacagatgaggactggcctgtgctgagcagcggcacccccaacctgctgactggagagatccccccatctgtggagaccccagcccagatcgtggagaagttcacccggctgctgtactacggcaggaagaaggaggccctggagtgggccatgaagaaccacctgtggggccacgccctcttcctgagcagcaagatggacccccagacctacagctgggtgatgagcggcttcaccagcaccctggccctgaatgaccccctgcagaccctcttccagctgatgagcggccgcatcccccaggccgccacctgctgcggggagaagcagtggggagactggaggccccacctggccgtcatcctgagcaaccaggccggggaccctgagctgtaccagagggccatcgtggccatcggggacaccctggccggcaagggcctggtggaggccgcccacttctgctacctgatggcccacgtgcccttcggccactacacagtgaagacagaccacctggtgctgctgggcagcagccacagccaggagttcctgaagtttgccaccacagaggccatccagaggacagagatctttgagtactgccagatgctgggccggcccaagagcttcatccccagcttccaggtgtacaagctgctgtatgccagccggctggccgactatggcctggtgtcccaggccctgcactactgtgaggccatcggggctgctgtgctgagccagggcgagagcagccaccctgtgctgctggtggagctgatcaagctggccgagaagctgaagctgagtgaccccctggtgctggagcggcgcagcggggaccgggacctggagccagactggctggcccagctgcggcggcagctggagcagaaggtggccggggacattggagacccccaccccaccaggagtgacatcagcggggccggcggcaccaccacagagaacaccttctaccaggacttcagcggctgccagggctacagcgaggcccctggctacagaagtgccctgtggctgaccccagagcagacctgcctgctgcagcccagcccccagcagcccttccccctgcagcccggcagctacccagctgggggcggggccggccagacaggcaccccccggcccttctacagcgtgcctgagacccacctgcccggcaccggcagctctgtggccgtgacagaggccaccggcggcaccgtgtgggaggagatgctgcagacccacctgggccctggagaaaatacagtgtcccaggagaccagccagcccccagatggccaggaggtgatcagcaagccccagacccccctggccgcccggcccaggagcatcagcgagagcagcgccagcagcgccaaggaggatgagaaggagagcagtgatgaagctgacaagaacagccccaggaacacagcccagaggggcaagctgggagatggcaaggagcacaccaagagcagcggcttcggctggttctcctggttccgcagcaagcccaccaagaatgccagccctgctggagatgaggacagcagtgacagcccagattctgagcaggagaccccccgggccagcagcccccaccaggccggcctgggcctgagcctgacccccagccctgagagcccccccctgcctgatgtgtctgccttcagccggggccggggcggcggggagggccggggcagcgccagcagcggcggcgctgctgctggagctggggtgggcggcctgagcggccctgagagcgtgtcctttgagctgtgcagcaaccctggggtgctgctgcccccaccagccctgaagggagctgtgcccctgtacaaccccagccaggtgccccagctgcccacagccaccagcctgaaccggcccaaccggctgagcgccagcctgagccacccagccatgctgcgcatcaacacccggcccaggctcatcagccaggactag

SEQ ID NO: 37194 - DNA, 3183 bp, Artificial Sequence
  Description of Artificial Sequence: Synthetic coding sequence
atggagctgtgggccccccagaggctgccccagacccggggcaaggccacagcccccagcaaggaccctgaccggggcttcagaagagatggccaccacaggcctgtgccccacagctggcacaacggggagcgcttccaccagtggcaggacaacagaggcagcccccagccccagcaggagcccagggctgaccaccagcagcagccccactacgccagcaggcctggggactggcaccagcctgtgtctggagtggactactatgaaggaggctacagaaaccagctgtacagcaggcctggctatgagaacagctaccagagctaccagagccccaccatgagggaggagtatgcctacggcagctactactaccacggccacccccagtggctgcaggaggagcgggtgccccggcagaggagcccctacatctggcatgaggactaccgggagcagaagtacctggatgagcaccactatgagaaccagcacagccccttcggcaccaacagcgagacccacttccagagcaacagcaggaacccctgcaaggacagccctgccagcaacagcggccaggagtggccaggagagctgtttcctggcagcctgctggccgaggcccagaagaacaagcccagcctggccagcgagagcaacctgctgcagcagcgggagagcggcctgagcagcagcagctatgagctgagccagtacatcagagatgcccctgagagagatgatcctccagccagcgctgcctggagccctgtgcaggctgatgtgagcagcgctggccccaaggcccccatgaagttctacatcccccacgtgcctgtgtcctttggacctgggggccagctggtgcacgtgggccccagcagccccacagatggccaggccgccctggtggagctgcacagcatggaggtgatcctgaatgacagcgaggagcaggaggagatgaggagcttcagcggccccctcatccgggaggatgtgcacaaggtggacatcatgaccttctgccagcagaaggccgcccagagctgcaagtctgagaccctgggcagccgggacagcgccctgctgtggcagctgctggtgctgctgtgccggcagaatggctccatggtgggcagtgacattgctgagctgctgatgcaggactgcaagaagctggagaagtacaagaggcagccccctgtggccaacctgatcaacctgacagatgaggactggcctgtgctgagcagcggcacccccaacctgctgaccggggagatcccccccagcgtggagaccccagcccagatcgtggagaagttcacccggctgctgtactacggcaggaagaaggaggccctggagtgggccatgaagaaccacctgtggggccacgccctcttcctgagcagcaagatggacccccagacctacagctgggtgatgagcggcttcaccagcaccctggccctgaatgaccccctgcagaccctcttccagctgatgagcggccgcatcccccaggccgccacctgctgcggggagaagcagtggggagactggaggccccacctggccgtcatcctgagcaaccaggccggggaccctgagctgtaccagagggccatcgtggccatcggggacaccctggccggcaagggcctggtggaggccgcccacttctgctacctgatggcccacgtgcccttcggccactacacagtgaagacagaccacctggtgctgctgggcagcagccacagccaggagttcctgaagtttgccaccacagaggccatccagaggacagagatctttgagtactgccagatgctgggccggcccaagagcttcatccccagcttccaggtgtacaagctgctgtatgccagccggctggccgactatggcctggtgtcccaggccctgcactactgtgaggccatcggggctgctgtgctgagccagggcgagagcagccaccctgtgctgctggtggagctgatcaagctggccgagaagctgaagctgagtgaccccctggtgctggagaggagaagtggggaccgggacctggagccagactggctggcccagctgcggcggcagctggagcagaaggtggccggggacatcggggacccccaccccaccaggagtgacatctctggagctgggggcaccaccacagagaacaccttctaccaggacttcagcggctgccagggctacagcgaggcccctggctaccgcagcgccctgtggctgaccccagagcagacctgcctgctgcagcccagcccccagcagcccttccccctgcagcccggcagctacccagctgggggcggggccggccagacaggcaccccccggcccttctacagcgtgcctgagacccacctgcccggcaccggcagctctgtggccgtgacagaggccactggaggcaccgtgtgggaggagatgctgcagacccacctgggccctggagagaacacagtgtcccaggagaccagccagcccccagatggccaggaggtgatcagcaagccccagacccccctggccgcccggcccaggagcatcagcgagagcagcgccagcagcgccaaggaggatgagaaggagagcagtgatgaggccgacaagaacagccccaggaacacagcccagaggggcaagctgggagatggcaaggagcacaccaagagcagcggcttcggctggttctcctggttccgcagcaagcccaccaagaatgccagccctgctggagatgaggacagcagtgacagcccagacagcgaggagaccccccgggccagcagcccccaccaggccggcctgggcctgagcctgacccccagccctgagagcccccccctgcctgatgtgtctgccttcagccggggccggggcggcggggagggccggggcagcgccagcagcggcggcgctgctgctggagctggggtgggcggcctgagcggccctgagagcgtgtcctttgagctgtgcagcaaccctggggtgctgctgcccccaccagccctgaagggagctgtgcccctgtacaaccccagccaggtgccccagctgcccacagccaccagcctgaaccggcccaaccggctggcccagaggcgctaccccacccagccctgctag

SEQ ID NO: 37195 - DNA, 2238 bp, Artificial Sequence
  Description of Artificial Sequence: Synthetic coding sequence
atggagctgtgggccccccagaggctgccccagacccggggcaaggccacagcccccagcaaggaccctgaccggggcttcagaagagatggccaccacaggcctgtgccccacagctggcacaacggggagcgcttccaccagtggcaggacaacagaggcagcccccagccccagcaggagcccagggctgaccaccagcagcagccccactacgccagcaggcctggggactggcaccagcctgtgtctggagtggactactatgaaggaggctacagaaaccagctgtacagcaggcctgtgctgagcagcggcacccccaacctgctgaccggggagatcccccccagcgtggagaccccagcccagatcgtggagaagttcacccggctgctgtactacggcaggaagaaggaggccctggagtgggccatgaagaaccacctgtggggccacgccctcttcctgagcagcaagatggacccccagacctacagctgggtgatgagcggcttcaccagcaccctggccctgaatgaccccctgcagaccctcttccagctgatgagcggccgcatcccccaggccgccacctgctgcggggagaagcagtggggagactggaggccccacctggccgtcatcctgagcaaccaggccggggaccctgagctgtaccagagggccatcgtggccatcggggacaccctggccggcaagggcctggtggaggccgcccacttctgctacctgatggcccacgtgcccttcggccactacacagtgaagacagaccacctggtgctgctgggcagcagccacagccaggagttcctgaagtttgccaccacagaggccatccagaggacagagatctttgagtactgccagatgctgggccggcccaagagcttcatccccagcttccaggtgtacaagctgctgtatgccagccggctggccgactatggcctggtgtcccaggccctgcactactgtgaggccatcggggctgctgtgctgagccagggcgagagcagccaccctgtgctgctggtggagctgatcaagctggccgagaagctgaagctgagtgaccccctggtgctggagaggagaagtggggaccgggacctggagccagactggctggcccagctgcggcggcagctggagcagaaggtggccggggacatcggggacccccaccccaccaggagtgacatctctggagctgggggcaccaccacagagaacaccttctaccaggacttcagcggctgccagggctacagcgaggcccctggctaccgcagcgccctgtggctgaccccagagcagacctgcctgctgcagcccagcccccagcagcccttccccctgcagcccggcagctacccagctgggggcggggccggccagacaggcaccccccggcccttctacagcgtgcctgagacccacctgcccggcaccggcagctctgtggccgtgacagaggccactggaggcaccgtgtgggaggagatgctgcagacccacctgggccctggagagaacacagtgtcccaggagaccagccagcccccagatggccaggaggtgatcagcaagccccagacccccctggccgcccggcccaggagcatcagcgagagcagcgccagcagcgccaaggaggatgagaaggagagcagtgatgaggccgacaagaacagccccaggaacacagcccagaggggcaagctgggagatggcaaggagcacaccaagagcagcggcttcggctggttctcctggttccgcagcaagcccaccaagaatgccagccctgctggagatgaggacagcagtgacagcccagacagcgagcaggagaccccccgggccagcagcccccaccaggccggcctgggcctgagcctgacccccagccctgagagcccccccctgcctgatgtgtctgccttcagccggggccggggcggcggggagggccggggcagcgccagcagtggaggagctgctgctggggccggcgtgggcggcctgagcggccctgagagcgtgtcctttgagctgtgcagcaaccctggggtgctgctgcccccaccagccctgaagggagctgtgcccctgtacaaccccagccaggtgccccagctgcccacagccaccagcctgaaccggcccaaccggctggcccagaggcgctaccccacccagccctgctag

SEQ ID NO: 37196 - DNA, 456 bp, Artificial Sequence
  Description of Artificial Sequence: Synthetic coding sequence
atggccgccacagccctgctggaggccggcctggcccgggtgctcttctaccccaccctgctgtacaccctcttccggggcaaggtgcccggccgggcccaccgggactggtaccacagaattgaccccaccgtgctgctgggcgccctgcccctgcggagcctgacccggcaggtgtcccgggccggggagcccggccccctgccccggccccggcgctctgtgcctgtgggccccctgggcagcccccccagcctgctgagccacctgtttgccagcgctgctggcaccggccgggagcgggcccggggggaccaccacgagcggggcgtgagagatgaggtgcctgtgcagctgttcaccggggcccagatggagagcagaggaggctgcaagagccaccggcaggaccccgtcatccacccccaccaggcctggccagctggctgcagctag

SEQ ID NO: 37197 - DNA, 3459 bp, Artificial Sequence
  Description of Artificial Sequence: Synthetic coding sequence
atgatcttcagtgacatgaacacagtgtctggcagccccaaggtgcaccccccaaatggcacccgcttctacaccttccaggagtttgctgccctgaccaaggagctgaatgcctgccgggagcagctgctggagaaggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgtcctctgaggtggaggtgctgaaggccctgaagagcctgtttgagcaccacaaggccctggatgagaagatcgtggccctgcgggagcagaatgtgcacatccagaggaagatggccagcagcgagggcagcacagagagcgagcacctggagggcatggagcccggccagaaggtgcatgagaagaggctgagcaatggcagcattgacagcacagatgagaccagccagatcgtggagctgcaggagctgctggagaagcagaactatgagatggcccagatgaaggagcggctggccgccctgagcagccgggtgggggaggtggagcaggaggccgagacagccaggaaggacctgatcaagacagaggagatgaacaccaagtaccagagggacatccgggaggccatggcccagaaggaggacatggaggagcgcatcaccaccctggagaagcgctacctgagcgcccagcgggagagcaccagcatccatgacatgaatgacaagctggagaatgagctggccaacaaggaggccatcctgcggcagatggaggagaagaaccggcagctgcaggagcggctggagctggccgagcagaagctgcagcagaccatgaggaaggccgagaccctgcctgaggtggaggccgagctggcccagagaattgctgccctgaccaaggccgaggagcggcacggcaacatcgaggagaggatgaggcacctggagggccagctggaggagaagaaccaggagctgcagagggcccggcagcgggagaagatgaatgaggagcacaacaagaggctgagtgacacagtggaccggctgctgacagagagcaatgaaaggctgcagctgcacctgaaggagaggatggccgccctggaggagaagaatgtgctgatccaggagagcgagaccttcaggaagaacctggaggagagcctgcatgacaaggagcggctggccgaggagattgagaagctgcggtctgagctggaccagctgaagatgaggacaggcagcctgattgagcccaccatccccaggacccacctggacaccagcgctgagctgcgctacagcgtgggcagcctggtggacagccagagcgactaccgcaccaccaaggtgatcagaagaccccggcggggccgcatgggcgtgagaagagatgagcccaaggtgaagagcctgggggaccacgagtggaacagaacccagcagattggagtgctgagcagccacccctttgaaagtgacacagagatgtctgacattgatgatgatgaccgggagaccatcttcagctccatggacctgctgagccccagcggccacagtgatgcccagaccctggccatgatgctgcaggagcagctggatgccatcaacaaggagatccgcctcatccaggaggagaaggagagcacagagctgcgggcagaggagattgaaaatagagtggcctctgtgtccctggagggcctgaacctggcccgggtgcaccctggcaccagcatcacagcctctgtgacagccagcagcctggccagcagcagccccccatctggccacagcacccccaagctgacccccaggagccctgcccgggagatggacaggatgggcgtgatgaccctgcccagcgacctgaggaagcacaggaggaagattgctgtggtggaggaggatggaagagaggacaaggccaccatcaagtgtgagaccagccccccacccaccccccgggccctgaggatgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaggccgccgcccaggagagcctgggcctgggcaagctgggcacccaggccgagaaggaccggcggctgaagaagaagcatgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggacccccagcggaaatgtgtgggtgacccatgaggagatggagaacctggccgccccagccaagaccaaggagagcgaggagggctcctgggcccagaccctggcctatggagacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagaggagaagagaggccagccagcacgagatcaaggatgtgctggtgtggagcaatgacagagtcatccgctggatccaggccatcggcctgcgggagtatgccaacaacatcctggagagcggcgtgcacggcagcctcatcgccctggatgagaactttgactacagcagcctggccctgctgctgcagatccccacccagaacacccaggcccggcagatcctggagcgggagtacaacaacctgctggccctgggcacagagcggcggctggatgaaagtgatgacaagaacttcagaagaggcagcacctggaggcggcagtttcctccccgggaggtgcacggcatctccatgatgcctggcagcagcgagaccctgcctgctggcttccggctgaccaccaccagcggccagagcaggaagatgaccacagatgtggccagcagccggctgcagaggctggacaacagcacagtgaggacctacagctgctag

SEQ ID NO: 37198 - DNA, 2352 bp, Artificial Sequence
  Description of Artificial Sequence: Synthetic coding sequence
atgaggcacctggagggccagctggaggagaagaaccaggagctgcagagggcccggcagcgggagaagatgaatgaggagcacaacaagaggctgagtgacacagtggaccggctgctgacagagagcaatgaaaggctgcagctgcacctgaaggagaggatggccgccctggaggagaagaatgtgctgatccaggagagcgagaccttcaggaagaacctggaggagagcctgcatgacaaggagcggctggccgaggagattgagaagctgcggtctgagctggaccagctgaagatgaggacaggcagcctgattgagcccaccatccccaggacccacctggacaccagcgctgagctgcgctacagcgtgggcagcctggtggacagccagagcgactaccgcaccaccaaggtgatcagaagaccccggcggggccgcatgggcgtgagaagagatgagcccaaggtgaagagcctgggggaccacgagtggaacagaacccagcagattggagtgctgagcagccacccctttgaaagtgacacagagatgtctgacattgatgatgatgaccgggagaccatcttcagctccatggacctgctgagccccagcggccacagtgatgcccagaccctggccatgatgctgcaggagcagctggatgccatcaacaaggagatccgcctcatccaggaggagaaggagagcacagagctgcgggcagaggagattgaaaatagagtggcctctgtgtccctggagggcctgaacctggcccgggtgcaccctggcaccagcatcacagcctctgtgacagccagcagcctggccagcagcagccccccatctggccacagcacccccaagctgacccccaggagccctgcccgggagatggacaggatgggcgtgatgaccctgcccagcgacctgaggaagcacaggaggaagattgctgtggtggaggaggatggaagagaggacaaggccaccatcaagtgtgagaccagccccccacccaccccccgggccctgaggatgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaggccgccgcccaggagagcctgggcctgggcaagctgggcacccaggccgagaaggaccggcggctgaagaagaagcatgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggacctgccctgtgttcctgcagaccctggcctacggggacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagcggcggcgggaggccagccagcacgagatcaaggatgtgctggtgtggagcaatgacagagtcatccgctggatccaggccatcggcctgcgggagtatgccaacaacatcctggagagcggcgtgcacggcagcctgattgccctggatgaaaattttgactacagcagcctggccctgctgctgcagatccccacccagaacacccaggcccggcagatcctggagcgggagtacaacaacctgctggccctgggcacagaaagaaggctggatgaaagtgatgacaagaacttccggcggggcagcacctggaggcggcagttccccccccgggaggtgcacggcatctccatgatgcctggcagcagcgagaccctgcctgctggcttccggctgaccaccaccagcggccagagcaggaagatgaccacagatgatggagtcttctctgtgtacagcacctag

SEQ ID NO: 37199 - DNA, 3756 bp, Artificial Sequence
  Description of Artificial Sequence: Synthetic coding sequence
atgatgtgtgaggtgatgcccaccatcaatgaagacacccccatgagccagaggggcagccagagcagcggcagtgacagcgacagccactttgagcagctgatggtgaacatgctggatgagcgggaccggctgctggacaccctgcgggagacccaggagagcctgagcctggcccagcagaggctgcaggatgtgatctatgaccgggacagcctgcagaggcagctgaacagcgccctgccccaggacatcgagagcctgactggaggcctggccggcagcaaaggagctgaccccccagagtttgctgccctgaccaaggagctgaatgcctgccgggagcagctgctggagaaggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgtcctctgaggtggaggtgctgaaggccctgaagagcctgtttgagcaccacaaggccctggatgagaaggtgcgggagcggctgcgggtgtccctggagcgggtgtctgccctggaggaggagctggccgccgccaaccaggagatcgtggccctgcgggagcagaatgtgcacatccagaggaagatggccagcagcgagggcagcacagaaagtgagcacctggagggcatggagcccggccagaaggtgcatgagaagaggctgagcaatggcagcattgacagcacagatgagaccagccagatcgtggagctgcaggagctgctggagaagcagaactatgagatggcccagatgaaggagcggctggccgccctgagcagccgggtgggggaggtggagcaggaggccgagacagccaggaaggacctgatcaagacagaggagatgaacaccaagtaccagagggacatccgggaggccatggcccagaaggaggacatggaggagcgcatcaccaccctggagaagcgctacctgagcgcccagcgggagagcaccagcatccatgacatgaatgacaagctggagaatgagctggccaacaaggaggccatcctgcggcagatggaggagaagaaccggcagctgcaggagcggctggagctggccgagcagaagctgcagcagaccatgaggaaggccgagaccctgcctgaggtggaggccgagctggcccagagaattgctgccctgaccaaggccgaggagagacatggcaacatcgaggagaggatgaggcacctggagggccagctggaggagaagaaccaggagctgcagagggcccggcagcgggagaagatgaatgaggagcacaacaagaggctgagtgacacagtggaccggctgctgacagagagcaatgaaaggctgcagctgcacctgaaggagaggatggccgccctggaggagaagaatgtgctgatccaggagagcgagaccttcaggaagaacctggaggagagcctgcatgacaaggagcggctggccgaggagattgagaagctgcggtctgagctggaccagctgaagatgaggacaggcagcctcatcgagcccaccatccccaggacccacctggacaccagcgctgagctgcgctacagcgtgggcagcctggtggacagccagagcgactaccgcaccaccaaggtgatccggcggccccggcggggccgcatgggcgtgagaagagatgagcccaaggtgaagagcctgggggaccacgagtggaacagaacccagcagatcggcgtgctgagcagccacccctttgaaagtgacacagagatgtctgacattgatgatgatgaccgggagaccatcttcagctccatggacctgctgagccccagcggccacagtgatgcccagaccctggccatgatgctgcaggagcagctggatgccatcaacaaggagatccgcctcatccaggaggagaaggagagcacagagctgcgggcagaggagattgagaacagagtggcctctgtgtccctggagggcctgaacctggcccgggtgcaccctggcaccagcatcacagcctctgtgacagccagcagcctggccagcagcagcccccccagcggccacagcacccccaagctgacccccaggagccctgcccgggagatggacaggatgggcgtgatgaccctgcccagcgacctgaggaagcacaggaggaagattgctgtggtggaggaggatggccgggaggacaaggccaccatcaagtgtgagaccagccccccacccaccccccgggccctgaggatgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaagctgctgcccaggagagcctgggcctgggcaagctgggcacccaggccgagaaggaccggcggctgaagaagaagcatgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggaccccatctggaaatgtgtgggtgacccatgaggagatggagaacctggccgccccagccaagaccaaggagagcgaggagggctcctgggcccagaccctggcctacggggacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagcggcggcgggaggccagccagcacgagatcaaggatgtgctggtgtggagcaatgacagagtcatccgctggatccaggccatcggcctgcgggagtatgccaacaacatcctggagagcggcgtgcacggcagcctgattgccctggatgaaaattttgactacagcagcctggccctgctgctgcagatccccacccagaacacccaggcccggcagatcctggagcgggagtacaacaacctgctggccctgggcacagaaagaaggctggatgaaagtgatgacaagaacttccggcggggcagcacctggaggcggcagttccccccccgggaggtgcacggcatctccatgatgcctggcagcagcgagaccctgcctgctggcttccggctgaccaccaccagcggccagagcaggaagatgaccacagatgtggccagcagccggctgcagaggctggacaacagcacagtgaggacctacagctgctag

SEQ ID NO: 37200 - DNA, 3699 bp, Artificial Sequence
  Description of Artificial Sequence: Synthetic coding sequence
atgatgtgtgaggtgatgcccaccatcaatgaagacacccccatgagccagaggggcagccagagcagcggcagtgacagcgacagccactttgagcagctgatggtgaacatgctggatgagcgggaccggctgctggacaccctgcgggagacccaggagagcctgagcctggcccagcagaggctgcaggatgtgatctatgaccgggacagcctgcagaggcagctgaacagcgccctgccccaggagtttgctgccctgaccaaggagctgaatgcctgccgggagcagctgctggagaaggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgtcctctgaggtggaggtgctgaaggccctgaagagcctgtttgagcaccacaaggccctggatgagaaggtgcgggagcggctgcgggtgtccctggagcgggtgtctgccctggaggaggagctggccgccgccaaccaggagatcgtggccctgcgggagcagaatgtgcacatccagaggaagatggccagcagcgagggcagcacagaaagtgagcacctggagggcatggagcccggccagaaggtgcatgagaagaggctgagcaatggcagcattgacagcacagatgagaccagccagatcgtggagctgcaggagctgctggagaagcagaactatgagatggcccagatgaaggagcggctggccgccctgagcagccgggtgggggaggtggagcaggaggccgagacagccaggaaggacctgatcaagacagaggagatgaacaccaagtaccagagggacatccgggaggccatggcccagaaggaggacatggaggagcgcatcaccaccctggagaagcgctacctgagcgcccagcgggagagcaccagcatccatgacatgaatgacaagctggagaatgagctggccaacaaggaggccatcctgcggcagatggaggagaagaaccggcagctgcaggagcggctggagctggccgagcagaagctgcagcagaccatgaggaaggccgagaccctgcctgaggtggaggccgagctggcccagagaattgctgccctgaccaaggccgaggagagacatggcaacatcgaggagaggatgaggcacctggagggccagctggaggagaagaaccaggagctgcagagggcccggcagcgggagaagatgaatgaggagcacaacaagaggctgagtgacacagtggaccggctgctgacagagagcaatgaaaggctgcagctgcacctgaaggagaggatggccgccctggaggagaagaatgtgctgatccaggagagcgagaccttcaggaagaacctggaggagagcctgcatgacaaggagcggctggccgaggagattgagaagctgcggtctgagctggaccagctgaagatgaggacaggcagcctcatcgagcccaccatccccaggacccacctggacaccagcgctgagctgcgctacagcgtgggcagcctggtggacagccagagcgactaccgcaccaccaaggtgatccggcggccccggcggggccgcatgggcgtgagaagagatgagcccaaggtgaagagcctgggggaccacgagtggaacagaacccagcagatcggcgtgctgagcagccacccctttgaaagtgacacagagatgtctgacattgatgatgatgaccgggagaccatcttcagctccatggacctgctgagccccagcggccacagtgatgcccagaccctggccatgatgctgcaggagcagctggatgccatcaacaaggagatccgcctcatccaggaggagaaggagagcacagagctgcgggcagaggagattgagaacagagtggcctctgtgtccctggagggcctgaacctggcccgggtgcaccctggcaccagcatcacagcctctgtgacagccagcagcctggccagcagcagcccccccagcggccacagcacccccaagctgacccccaggagccctgcccgggagatggacaggatgggcgtgatgaccctgcccagcgacctgaggaagcacaggaggaagattgctgtggtggaggaggatggccgggaggacaaggccaccatcaagtgtgagaccagccccccacccaccccccgggccctgaggatgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaagctgctgcccaggagagcctgggcctgggcaagctgggcacccaggccgagaaggaccggcggctgaagaagaacaccagcggccacgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggacccccagcggaaatgtgtgggtgacccatgaggagatggagaacctggccgccccagccaagaccaaggagagcgaggagggctcctgggcccagtgccctgtgttcctgcagaccctggcctatggagacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagaggagaagagaggccagccagcacgagatcaaggatgtgctggtgtggagcaatgacagagtcatccgctggatccaggccatcggcctgcgggagtatgccaacaacatcctggagagcggcgtgcacggcagcctcatcgccctggatgagaactttgactacagcagcctggccctgctgctgcagatccccacccagaacacccaggcccggcagatcctggagcgggagtacaacaacctgctggccctgggcacagagcggcggctggatgaaagtgatgacaagaacttcagaagaggcagcacctggaggcggcagtttcctccccgggaggtgcacggcatctccatgatgcctggcagcagcgagaccctgcctgctggcttccggctgaccaccaccagcggccagagcaggaagatgaccacagatgatggagtcttctctgtgtacagcacctag

SEQ ID NO: 37201 - DNA, 3633 bp, Artificial Sequence
  Description of Artificial Sequence: Synthetic coding sequence
atgatgtgtgaggtgatgcccaccatcaatgaagacacccccatgagccagaggggcagccagagcagcggcagtgacagcgacagccactttgagcagctgatggtgaacatgctggatgagcgggaccggctgctggacaccctgcgggagacccaggagagcctgagcctggcccagcagaggctgcaggatgtgatctatgaccgggacagcctgcagaggcagctgaacagcgccctgccccaggacatcgagagcctgactggaggcctggccggcagcaaaggagctgaccccccagagtttgctgccctgaccaaggagctgaatgcctgccgggagcagctgctggagaaggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgtcctctgaggtggaggtgctgaaggccctgaagagcctgtttgagcaccacaaggccctggatgagaaggtgcgggagcggctgcgggtgtccctggagcgggtgtctgccctggaggaggagctggccgccgccaaccaggagatcgtggccctgcgggagcagaatgtgcacatccagaggaagatggccagcagcgagggcagcacagaaagtgagcacctggagggcatggagcccggccagaaggtgcatgagaagaggctgagcaatggcagcattgacagcacagatgagaccagccagatcgtggagctgcaggagctgctggagaagcagaactatgagatggcccagatgaaggagcggctggccgccctgagcagccgggtgggggaggtggagcaggaggccgagacagccaggaaggacctgatcaagacagaggagatgaacaccaagtaccagagggacatccgggaggccatggcccagaaggaggacatggaggagcgcatcaccaccctggagaagcgctacctgagcgcccagcgggagagcaccagcatccatgacatgaatgacaagctggagaatgagctggccaacaaggaggccatcctgcggcagatggaggagaagaaccggcagctgcaggagcggctggagctggccgagcagaagctgcagcagaccatgaggaaggccgagaccctgcctgaggtggaggccgagctggcccagagaattgctgccctgaccaaggccgaggagagacatggcaacatcgaggagaggatgaggcacctggagggccagctggaggagaagaaccaggagctgcagagggcccggcagcgggagaagatgaatgaggagcacaacaagaggctgagtgacacagtggaccggctgctgacagagagcaatgaaaggctgcagctgcacctgaaggagaggatggccgccctggaggagaagaatgtgctgatccaggagagcgagaccttcaggaagaacctggaggagagcctgcatgacaaggagcggctggccgaggagattgagaagctgcggtctgagctggaccagctgaagatgaggacaggcagcctcatcgagcccaccatccccaggacccacctggacaccagcgctgagctgcgctacagcgtgggcagcctggtggacagccagagcgactaccgcaccaccaaggtgatccggcggccccggcggggccgcatgggcgtgagaagagatgagcccaaggtgaagagcctgggggaccacgagtggaacagaacccagcagatcggcgtgctgagcagccacccctttgaaagtgacacagagatgtctgacattgatgatgatgaccgggagaccatcttcagctccatggacctgctgagccccagcggccacagtgatgcccagaccctggccatgatgctgcaggagcagctggatgccatcaacaaggagatccgcctcatccaggaggagaaggagagcacagagctgcgggcagaggagattgagaacagagtggcctctgtgtccctggagggcctgaacctggcccgggtgcaccctggcaccagcatcacagcctctgtgacagccagcagcctggccagcagcagcccccccagcggccacagcacccccaagctgacccccaggagccctgcccgggagatggacaggatgggcgtgatgaccctgcccagcgacctgaggaagcacaggaggaagattgctgtggtggaggaggatggccgggaggacaaggccaccatcaagtgtgagaccagccccccacccaccccccgggccctgaggatgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaagctgctgcccaggagagcctgggcctgggcaagctgggcacccaggccgagaaggaccggcggctgaagaagaagcatgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggaccccatctggaaatgtgtgggtgacccatgaggagatggagaacctggccgccccagccaagaccaaggagagcgaggagggctcctgggcccagtgccctgtgttcctgcagaccctggcctacggggacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagcggcggcgggaggccagccagcacgagatcaaggatgtgctggtgtggagcaatgacagagtcatccgctggatccaggccatcggcctgcgggagtatgccaacaacatcctggagagcggcgtgcacggcagcctgattgccctggatgaaaattttgactacagcagcctggccctgctgctgcagatccccacccagaacacccaggccagccgcttcctgaaggagaacaccatcacctcctggccctgggagctgaagggggactggatgaaggtgatgaccaggaccagtgatgtggaccagcccggggagggcagcttcctgctggtgaagtacatggagagcgcctag

SEQ ID NO: 37202 - DNA, 3711 bp, Artificial Sequence
  Description of Artificial Sequence: Synthetic coding sequence
atgatgtgtgaggtgatgcccaccatcaatgaagacacccccatgagccagaggggcagccagagcagcggcagtgacagcgacagccactttgagcagctgatggtgaacatgctggatgagcgggaccggctgctggacaccctgcgggagacccaggagagcctgagcctggcccagcagaggctgcaggatgtgatctatgaccgggacagcctgcagaggcagctgaacagcgccctgccccaggacatcgagagcctgactggaggcctggccggcagcaaaggagctgaccccccagagtttgctgccctgaccaaggagctgaatgcctgccgggagcagctgctggagaaggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgtcctctgaggtggaggtgctgaaggccctgaagagcctgtttgagcaccacaaggccctggatgagaaggtgcgggagcggctgcgggtgtccctggagcgggtgtctgccctggaggaggagctggccgccgccaaccaggagatcgtggccctgcgggagcagaatgtgcacatccagaggaagatggccagcagcgagggcagcacagaaagtgagcacctggagggcatggagcccggccagaaggtgcatgagaagaggctgagcaatggcagcattgacagcacagatgagaccagccagatcgtggagctgcaggagctgctggagaagcagaactatgagatggcccagatgaaggagcggctggccgccctgagcagccgggtgggggaggtggagcaggaggccgagacagccaggaaggacctgatcaagacagaggagatgaacaccaagtaccagagggacatccgggaggccatggcccagaaggaggacatggaggagcgcatcaccaccctggagaagcgctacctgagcgcccagcgggagagcaccagcatccatgacatgaatgacaagctggagaatgagctggccaacaaggaggccatcctgcggcagatggaggagaagaaccggcagctgcaggagcggctggagctggccgagcagaagctgcagcagaccatgaggaaggccgagaccctgcctgaggtggaggccgagctggcccagagaattgctgccctgaccaaggccgaggagagacatggcaacatcgaggagaggatgaggcacctggagggccagctggaggagaagaaccaggagctgcagagggcccggcagcgggagaagatgaatgaggagcacaacaagaggctgagtgacacagtggaccggctgctgacagagagcaatgaaaggctgcagctgcacctgaaggagaggatggccgccctggaggagaagaatgtgctgatccaggagagcgagaccttcaggaagaacctggaggagagcctgcatgacaaggagcggctggccgaggagattgagaagctgcggtctgagctggaccagctgaagatgaggacaggcagcctcatcgagcccaccatccccaggacccacctggacaccagcgctgagctgcgctacagcgtgggcagcctggtggacagccagagcgactaccgcaccaccaaggtgatccggcggccccggcggggccgcatgggcgtgagaagagatgagcccaaggtgaagagcctgggggaccacgagtggaacagaacccagcagatcggcgtgctgagcagccacccctttgaaagtgacacagagatgtctgacattgatgatgatgaccgggagaccatcttcagctccatggacctgctgagccccagcggccacagtgatgcccagaccctggccatgatgctgcaggagcagctggatgccatcaacaaggagatccgcctcatccaggaggagaaggagagcacagagctgcgggcagaggagattgagaacagagtggcctctgtgtccctggagggcctgaacctggcccgggtgcaccctggcaccagcatcacagcctctgtgacagccagcagcctggccagcagcagcccccccagcggccacagcacccccaagctgacccccaggagccctgcccgggagatggacaggatgggcgtgatgaccctgcccagcgacctgaggaagcacaggaggaagattgctgtggtggaggaggatggccgggaggacaaggccaccatcaagtgtgagaccagccccccacccaccccccgggccctgaggatgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaagctgctgcccaggagagcctgggcctgggcaagctgggcacccaggccgagaaggaccggcggctgaagaagaagcatgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggaccaaggagagcgaggagggctcctgggcccagtgccctgtgttcctgcagaccctggcctatggagacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagaggagaagagaggccagccagcacgagatcaaggatgtgctggtgtggagcaatgacagagtcatccgctggatccaggccatcggcctgcgggagtatgccaacaacatcctggagagcggcgtgcacggcagcctcatcgccctggatgagaactttgactacagcagcctggccctgctgctgcagatccccacccagaacacccaggcccggcagatcctggagcgggagtacaacaacctgctggccctgggcacagagcggcggctggatgaaagtgatgacaagaacttcagaagaggcagcacctggaggcggcagtttcctccccgggaggtgcacggcatctccatgatgcctggcagcagcgagaccctgcctgctggcttccggctgaccaccaccagcggccagagcaggaagatgaccacagatgtggccagcagccggctgcagaggctggacaacagcacagtgaggacctacagctgctag

SEQ ID NO: 37203 - DNA, 1638 bp, Artificial Sequence
  Description of Artificial Sequence: Synthetic coding sequence
atgcagagcatcagcaagcagaccctgcagatggatgtgaacaagctgaacatcaccctgctgcgcatcttccggcagggcgtggccgccgccctgggcctgctgccccagcaggtgcacatcaaccggctgattggcaagaagaacagcattgagctgtttgtgagccccatcaacaggaagacaggcatcagtgatgccctgcccagcgaggaggtgctgcggagcctgaacatcaacgtgctgcaccagagcctgagccagtttggcatcacagaggtgtccccagagaagaatgtgctgcagggccagcatgaagctgacaagatctggagcaaggagggcttctatgctgtggtgatcttcctgagcatcttcgtcatcatcgtgacctgcctgatgatcctgtaccgcctgaaggagcgcttccagctgagcctgcggcaggacaaggagaagaaccaggagatccacctgagccccatcaccctgcagcctgccctgtctgaggccaagacagtgcacagcatggtgcagcctgagcaggcccccaaggtgctgaatgtggtggtggacccccagggccgcggggcccctgagatcaaggccaccacagccacctctgtgtgccccagccccttcaagatgaagcccatcggcctgcaggagcggcggggcagcaatgtgtccctgaccctggacatgagcagcctgggcaacatcgagccctttgtgtccatccccaccccccgggagaaggtggccatggagtacctgcagagcgccagccgcatcctgaccaggagccagctgagagatgtggtggccagcagccacctgctgcagagcgagttcatggagatccccatgaactttgtggaccccaaggagattgacatccccaggcatggcaccaagaaccgctacaagaccatcctgcccaaccccctgagccgggtgtgcctgcggcccaagaatgtgacagacagcctgagcacctacatcaatgccaactacatccggggctacagcggcaaggagaaggccttcatcgccacccagggccccatgatcaacacagtggatgacttctggcagatggtgtggcaggaggacagccctgtgattgtgatgatcaccaagctgaaggagaagaatgagaagtgtgtgctgtactggccagagaagaggggcatctacggcaaggtggaggtgctggtgatctctgtgaatgaatgtgacaactacaccatccggaacctggtgctgaagcagggcagccacacccagcacgtgaagcactactggtacacctcctggccagaccacaagaccccagacagcgcccagcccctgctgcagctgatgctggatgtggaggaggaccggctggccagccagggccggggccctgtggtggtgcactgcagcgctggcatcggccgcacaggctgcttcatcgccaccagcatcggctgccagcagctgaaggaggagggcgtggtggatgccctgagcatcgtgtgccagctgaggatggaccggggcggcatggtgcagaccagcgagcagtatgaatttgtgcaccacgccctgtgcctgtatgagagccggctgtctgctgagaccgtgcagtag

SEQ ID NO: 37204 - DNA, 606 bp, Artificial Sequence
  Description of Artificial Sequence: Synthetic coding sequence
atggccgccacagccctgctggaggccggcctggcccgggtgctcttctaccccaccctgctgtacaccctcttccggggcaaggtgcccggccgggcccaccgggactggtaccacagaattgaccccaccgtgctgctgggcgccctgcccctgcggagcctgacccggcagctggtgcaggatgaaaatgtgcggggcgtcatcaccatgaatgaggagtatgagacccgcttcctgtgcaacagcagccaggagtggaagaggctgggcgtggagcagctgcggctgagcacagtggacatgacaggcatccccaccctggacaacctgcagaagggcgtgcagtttgccctgaagtaccagagcctgggccagtgtgtgtatgtgcactgcaaggccggccgcagccgcagcgccaccatggtggccgcctacctgatccaggtgcacaagtggagccctgaggaggccgtgcgggccatcgccaagatccgcagctacatccacatccggcccggccagctggatgtgctgaaggagttccacaagcagatcacagcccgggccaccaaggatggcaccttcgtcatcagcaagacctag

SEQ ID NO: 37205 - DNA, 2280 bp, Artificial Sequence
  Description of Artificial Sequence: Synthetic coding sequence
atggccggcagcaagcagagccaccaggaggccgtgaagaggcacctgtacttcctgcagctgaagatggacatctgtgagggccgcctgacctgccccctgaacagcgctgtggtgctggccagctatgctgtgcagagccactttggagactacaacagcagcatccaccaccctggctacctgagtgacagccacttcatcccagaccagaatgaagacttcctgaccaaggtggagagcctgcacgagcagcacagcggcctgaagcagagcgaggccgagagctgctacatcaacatcgcccggaccctggacttctacggcgtggagctgcacagcggccgggacctgcacaacctggacctgatgattggaattgccagcgctggggtggccgtgtacaggaagtacatctgcaccagcttctacccctgggtgaacatcctgaagatctccttcaagaggaagaagttcttcatccaccagaggcagaagcaggccgagagccgggagcacatcgtggccttcaacatgctgaactaccgcagctgcaagaacctgtggaagagctgtgtggagcaccacaccttcttccaggccaagaagctgctgccccaggagaagaatgtgctgagccagtactggaccatgggcagcaggaacaccaagaagaggagcccccggctgcggcatgagatcaggaagcccaggcacagcagcgctgacaacctggccaatgagatgacctacatcacagaaacagaagatgtgttctacacctacaagggcagcctggccccccaggacagcgacagcgaggtgtcccagaacagaagcccccaccaggagagcctgtctgagaacaacccagcccagagctacctgacccagaagagcagcagctctgtgagccccagcagcaatgcccctggcagctgcagcccagatggagtggaccagcagctgctggatgacttccaccgggtgaccaagggcggcagcacagaagatgccagccagtactactgtgacaagaatgacaatggagacagctacctggtgctgatccgcatcaccccagatgaagatggcaagtttggcttcaacctgaagggcggcgtggaccagaagatgcccctggtggtgagccgcatcaaccctgagagccctgctgacacctgcatccccaagctgaatgaaggagaccagatcgtgctgatcaatggccgggacatcagcgagcacacccatgaccaggtggtgatgttcatcaaggccagccgggagagccacagccgggagctggccctggtgatcagaagaagagctgtgcgcagctttgctgacttcaagtcagaagatgagctgaaccagctgtttcctgaggccatcttccccatgtgcccagagggcggggacaccctggagggctccatggcccagctgaagaagggcctggagagcggcaccgtgctgatccagtttgagcagctgtacaggaagaagccaggcctggccatcacctttgccaagctgccccagaacctggacaagaaccgctacaaggatgtgctgccctatgacaccaccagggtgctgctgcagggcaatgaagactacatcaatgccagctatgtgaacatggagatcccagctgccaacctggtgaacaagtacatcgccacccagggccccctgccccacacctgtgcccagttctggcaggtggtgtgggaccagaagctgagcctcatcgtgatgctgaccaccctgacagagcggggccgcaccaagtgccaccagtactggccagaccccccagatgtgatgaaccacggcggcttccacatccagtgccagagcgaggactgcaccatcgcctacgtgtcccgggagatgctggtgaccaacacccagacaggagaggagcacacagtgacccacctgcagtatgtggcctggccagaccacggcgtgcctgatgacagcagtgacttcctggagtttgtgaactacgtgcgcagcctgcgggtggacagcgagcctgtgctggtgcactgcagcgctggcatcggccgcactggagtgctggtgaccatggagacagccatgtgcctgacagagaggaacctgcccatctaccccctggacatcgtgaggaagatgagggaccagagggccatgatggtgcagaccagcagccagtacaagtttgtgtgtgaggccatcctgcgggtgtatgaggagggcctggtgcagatgctggaccccagctag

SEQ ID NO: 37206 - DNA, 2742 bp, Artificial Sequence
  Description of Artificial Sequence: Synthetic coding sequence
atgaccagccggctgcgggccctgggcggccgcatcaacaacatccgcaccagcgagctgcccaaggagaagaccaggtctgaggtgatctgcagcatccacttcctggatggagtggtgcagaccttcaaggtgaccaagcaggacaccggccaggtgctgctggacatggtgcacaaccacctgggcgtgacagagaaggagtacttcggcctgcagcatgatgatgacagcgtggacagcccccgctggctggaggccagcaaggccatcaggaagcagctgaagggcggcttcccctgcaccctgcacttccgggtgcgcttcttcatcccagaccccaacaccctgcagcaggagcagaccaggcacctgtacttcctgcagctgaagatggacatctgtgagggccgcctgacctgccccctgaacagcgctgtggtgctggccagctatgctgtgcagagccactttggagactacaacagcagcatccaccaccctggctacctgagtgacagccacttcatcccagaccagaatgaagacttcctgaccaaggtggagagcctgcacgagcagcacagcggcctgaagcagagcgaggccgagagctgctacatcaacatcgcccggaccctggacttctatggagtggagctgcacagcggccgggacctgcacaacctggacctgatgattggcatcgccagcgctggggtggccgtgtacaggaagtacatctgcaccagcttctacccctgggtgaacatcctgaagatctccttcaagaggaagaagttcttcatccaccagaggcagaagcaggccgagagccgggagcacatcgtggccttcaacatgctgaactaccgcagctgcaagaacctgtggaagagctgtgtggagcaccacaccttcttccaggccaagaagctgctgccccaggagaagaatgtgctgagccagtactggaccatgggcagcaggaacaccaagaagtctgtgaacaaccagtactgcaagaaggtgattggaggcatggtgtggaacccagccatgagaagaagcctgtctgtggagcacctggagaccaagagcctgcccagccgcagcccccccatcacccccaactggaggagcccccggctgcggcatgagatcaggaagcccaggcacagcagcgctgacaacctggccaatgagatgacctacatcacagaaacagaagatgtgttctacacctacaagggcagcctggccccccaggacagcgacagcgaggtgtcccagaacagaagcccccaccaggagagcctgtctgagaacaacccagcccagagctacctgacccagaagagcagcagctctgtgagccccagcagcaatgcccctggcagctgcagcccagatggagtggaccagcagctgctggatgacttccaccgggtgaccaagggcggcagcacagaagatgccagccagtactactgtgacaagaatgacaatggagacagctacctggtgctgatccgcatcaccccagatgaagatggcaagtttggcttcaacctgaagggcggcgtggaccagaagatgcccctggtggtgagccgcatcaaccctgagagccctgctgacacctgcatccccaagctgaatgaaggagaccagatcgtgctgatcaatggccgggacatcagcgagcacacccatgaccaggtggtgatgttcatcaaggccagccgggagagccacagccgggagctggccctggtgatcagaagaagagctgtgcgcagctttgctgacttcaagtcagaagatgagctgaaccagctgtttcctgaggccatcttccccatgtgcccagagggcggggacaccctggagggctccatggcccagctgaagaagggcctggagagcggcaccgtgctgatccagtttgagcagctgtacaggaagaagccaggcctggccatcacctttgccaagctgccccagaacctggacaagaaccgctacaaggatgtgctgccctatgacaccaccagggtgctgctgcagggcaatgaagactacatcaatgccagctatgtgaacatggagatcccagctgccaacctggtgaacaagtacatcgccacccagggccccctgccccacacctgtgcccagttctggcaggtggtgtgggaccagaagctgagcctcatcgtgatgctgaccaccctgacagagcggggccgcaccaagtgccaccagtactggccagaccccccagatgtgatgaaccacggcggcttccacatccagtgccagagcgaggactgcaccatcgcctacgtgtcccgggagatgctggtgaccaacacccagacaggagaggagcacacagtgacccacctgcagtatgtggcctggccagaccacggcgtgcctgatgacagcagtgacttcctggagtttgtgaactacgtgcgcagcctgcgggtggacagcgagcctgtgctggtgcactgcagcgctggcatcggccgcactggagtgctggtgaccatggagacagccatgtgcctgacagagaggaacctgcccatctaccccctggacatcgtgaggaagatgagggaccagagggccatgatggtgcagaccagcagccagtacaagtttgtgtgtgaggccatcctgcgggtgtatgaggagggcctggtgcagatgctggaccccagctag

SEQ ID NO: 37207 - DNA, 1146 bp, Artificial Sequence
  Description of Artificial Sequence: Synthetic coding sequence
atgcccctggtggtgagccgcatcaaccctgagagccctgctgacacctgcatccccaagctgaatgaaggagaccagatcgtgctgatcaatggccgggacatcagcgagcacacccatgaccaggtggtgatgttcatcaaggccagccgggagagccacagccgggagctggccctggtgatcagaagaagagctgtgcgcagctttgctgacttcaagtcagaagatgagctgaaccagctgtttcctgaggccatcttccccatgtgcccagagggcggggacaccctggagggctccatggcccagctgaagaagggcctggagagcggcaccgtgctgatccagtttgagcagctgtacaggaagaagccaggcctggccatcacctttgccaagctgccccagaacctggacaagaaccgctacaaggatgtgctgccctatgacaccaccagggtgctgctgcagggcaatgaagactacatcaatgccagctatgtgaacatggagatcccagctgccaacctggtgaacaagtacatcgccacccagggccccctgccccacacctgtgcccagttctggcaggtggtgtgggaccagaagctgagcctcatcgtgatgctgaccaccctgacagagcggggccgcaccaagtgccaccagtactggccagaccccccagatgtgatgaaccacggcggcttccacatccagtgccagagcgaggactgcaccatcgcctacgtgtcccgggagatgctggtgaccaacacccagacaggagaggagcacacagtgacccacctgcagtatgtggcctggccagaccacggcgtgcctgatgacagcagtgacttcctggagtttgtgaactacgtgcgcagcctgcgggtggacagcgagcctgtgctggtgcactgcagcgctggcatcggccgcactggagtgctggtgaccatggagacagccatgtgcctgacagagaggaacctgcccatctaccccctggacatcgtgaggaagatgagggaccagagggccatgatggtgcagaccagcagccagtacaagtttgtgtgtgaggccatcctgcgggtgtatgaggagggcctggtgcagatgctggaccccagctag

SEQ ID NO: 37208 - DNA, 2742 bp, Artificial Sequence; identical to SEQ ID NO: 37206
  Description of Artificial Sequence: Synthetic coding sequence

SEQ ID NO: 37209 - DNA, 2349 bp, Artificial Sequence
  Description of Artificial Sequence: Synthetic coding sequence
atggacatctgtgagggccgcctgacctgccccctgaacagcgctgtggtgctggccagctatgctgtgcagagccactttggagactacaacagcagcatccaccaccctggctacctgagtgacagccacttcatcccagaccagaatgaagacttcctgaccaaggtggagagcctgcacgagcagcacagcggcctgaagcagagcgaggccgagagctgctacatcaacatcgcccggaccctggacttctacggcgtggagctgcacagcggccgggacctgcacaacctggacctgatgattggaattgccagcgctggggtggccgtgtacaggaagtacatctgcaccagcttctacccctgggtgaacatcctgaagatctccttcaagaggaagaagttcttcatccaccagaggcagaagcaggccgagagccgggagcacatcgtggccttcaacatgctgaactaccgcagctgcaagaacctgtggaagagctgtgtggagcaccacaccttcttccaggccaagaagctgctgccccaggagaagaatgtgctgagccagtactggaccatgggcagcaggaacaccaagaagtctgtgaacaaccagtactgcaagaaggtgattggaggcatggtgtggaacccagccatgaggaggagcctgtctgtggagcacctggagaccaagagcctgcccagccgcagcccccccatcacccccaactggaggagcccccggctgcggcatgagatcaggaagcccaggcacagcagcgctgacaacctggccaatgagatgacctacatcacagaaacagaagatgtgttctacacctacaagggcagcctggccccccaggacagcgacagcgaggtgtcccagaacagaagcccccaccaggagagcctgtctgagaacaacccagcccagagctacctgacccagaagagcagcagctctgtgagccccagcagcaatgcccctggcagctgcagcccagatggagtggaccagcagctgctggatgacttccaccgggtgaccaagggcggcagcacagaagatgccagccagtactactgtgacaagaatgacaacggggacagctacctggtgctgatccgcatcaccccagatgaagatggcaagtttggcttcaacctgaagggcggcgtggaccagaagatgcccctggtggtgagccgcatcaaccctgagagccctgctgacacctgcatccccaagctgaatgaaggagaccagatcgtgctgatcaatggccgggacatcagcgagcacacccatgaccaggtggtgatgttcatcaaggccagccgggagagccacagccgggagctggccctggtgatcagaagaagagctgtgcgcagctttgctgacttcaagtcagaagatgagctgaaccagctgtttcctgaggccatcttccccatgtgcccagagggcggggacaccctggagggctccatggcccagctgaagaagggcctggagagcggcaccgtgctgatccagtttgagcagctgtacaggaagaagccaggcctggccatcacctttgccaagctgccccagaacctggacaagaaccgctacaaggatgtgctgccctatgacaccaccagggtgctgctgcagggcaatgaagactacatcaatgccagctatgtgaacatggagatcccagctgccaacctggtgaacaagtacatcgccacccagggccccctgccccacacctgtgcccagttctggcaggtggtgtgggaccagaagctgagcctgattgtgatgctgaccaccctgacagagcggggccgcaccaagtgccaccagtactggccagaccccccagatgtgatgaaccacggcggcttccacatccagtgccagagcgaggactgcaccatcgcctacgtgtcccgggagatgctggtgaccaacacccagacaggagaggagcacacagtgacccacctgcagtatgtggcctggccagaccatggagtgcctgatgacagcagtgacttcctggagtttgtgaactacgtgcgcagcctgcgggtggacagcgagcctgtgctggtgcactgcagcgctggcattggaagaactggagtgctggtgaccatggagacagccatgtgcctgacagaaagaaacctgcccatctaccccctggacatcgtgaggaagatgagggaccagagggccatgatggtgcagaccagcagccagtacaagtttgtgtgtgaggccatcctgcgggtgtatgaggagggcctggtgcagatgctggaccccagctag

SEQ ID NO: 37210 - DNA, 2214 bp, Artificial Sequence
  Description of Artificial Sequence: Synthetic coding sequence
atggacatctgtgagggccgcctgacctgccccctgaacagcgctgtggtgctggccagctatgctgtgcagagccactttggagactacaacagcagcatccaccaccctggctacctgagtgacagccacttcatcccagaccagaatgaagacttcctgaccaaggtggagagcctgcacgagcagcacagcggcctgaagcagagcgaggccgagagctgctacatcaacatcgcccggaccctggacttctacggcgtggagctgcacagcggccgggacctgcacaacctggacctgatgattggaattgccagcgctggggtggccgtgtacaggaagtacatctgcaccagcttctacccctgggtgaacatcctgaagatctccttcaagaggaagaagttcttcatccaccagaggcagaagcaggccgagagccgggagcacatcgtggccttcaacatgctgaactaccgcagctgcaagaacctgtggaagagctgtgtggagcaccacaccttcttccaggccaagaagctgctgccccaggagaagaatgtgctgagccagtactggaccatgggcagcaggaacaccaagaagaggagcccccggctgcggcatgagatcaggaagcccaggcacagcagcgctgacaacctggccaatgagatgacctacatcacagaaacagaagatgtgttctacacctacaagggcagcctggccccccaggacagcgacagcgaggtgtcccagaacagaagcccccaccaggagagcctgtctgagaacaacccagcccagagctacctgacccagaagagcagcagctctgtgagccccagcagcaatgcccctggcagctgcagcccagatggagtggaccagcagctgctggatgacttccaccgggtgaccaagggcggcagcacagaagatgccagccagtactactgtgacaagaatgacaatggagacagctacctggtgctgatccgcatcaccccagatgaagatggcaagtttggcttcaacctgaagggcggcgtggaccagaagatgcccctggtggtgagccgcatcaaccctgagagccctgctgacacctgcatccccaagctgaatgaaggagaccagatcgtgctgatcaatggccgggacatcagcgagcacacccatgaccaggtggtgatgttcatcaaggccagccgggagagccacagccgggagctggccctggtgatcagaagaagagctgtgcgcagctttgctgacttcaagtcagaagatgagctgaaccagctgtttcctgaggccatcttccccatgtgcccagagggcggggacaccctggagggctccatggcccagctgaagaagggcctggagagcggcaccgtgctgatccagtttgagcagctgtacaggaagaagccaggcctggccatcacctttgccaagctgccccagaacctggacaagaaccgctacaaggatgtgctgccctatgacaccaccagggtgctgctgcagggcaatgaagactacatcaatgccagctatgtgaacatggagatcccagctgccaacctggtgaacaagtacatcgccacccagggccccctgccccacacctgtgcccagttctggcaggtggtgtgggaccagaagctgagcctcatcgtgatgctgaccaccctgacagagcggggccgcaccaagtgccaccagtactggccagaccccccagatgtgatgaaccacggcggcttccacatccagtgccagagcgaggactgcaccatcgcctacgtgtcccgggagatgctggtgaccaacacccagacaggagaggagcacacagtgacccacctgcagtatgtggcctggccagaccacggcgtgcctgatgacagcagtgacttcctggagtttgtgaactacgtgcgcagcctgcgggtggacagcgagcctgtgctggtgcactgcagcgctggcatcggccgcactggagtgctggtgaccatggagacagccatgtgcctgacagagaggaacctgcccatctaccccctggacatcgtgaggaagatgagggaccagagggccatgatggtgcagaccagcagccagtacaagtttgtgtgtgaggccatcctgcgggtgtatgaggagggcctggtgcagatgctggaccccagctag

SEQ ID NO: 37211 - DNA, 2781 bp, Artificial Sequence
  Description of Artificial Sequence: Synthetic coding sequence
atgaccagccgcttccggctgcctgctggccgcacctacaacgtgcgggccagcgagctggcccgggaccggcagcacacagaggtggtgtgcaacatcctgctgctggacaacacagtgcaggccttcaaggtgaacaagcatgaccagggccaggtgctgctggatgtggtgttcaagcacctggacctgacagagcaggactacttcggcctgcagctggctgatgacagcacagacaacccccgctggctggaccccaacaagcccatcaggaagcagctgaagaggggcagcccctacagcctgaacttccgggtgaagttctttgtgtctgaccccaacaagctgcaggaggagtacacccgctaccagtacttcctgcagatcaagcaggacatcctgaccggccgcctgccctgccccagcaacacagctgccctgctggccagctttgctgtgcagagcgagctgggggactatgaccagagcgagaacctgagcggctacctgagtgactacagcttcatccccaaccagccccaggactttgagaaggagatcgccaagctgcaccagcagcacatcggcctgagccctgctgaggccgagttcaactacctgaacacagcccggaccctggagctgtatggagtggagttccactacgcccgggaccagagcaacaatgagatcatgattggagtgatgtctgggggcatcctgatctacaagaacagagtgaggatgaacaccttcccctggctgaagatcgtgaagatctccttcaagtgcaagcagttcttcatccagctgaggaaggagctgcacgagagccgggagaccctgctgggcttcaacatggtgaactaccgggcctgcaagaacctgtggaaggcctgtgtggagcaccacaccttcttccggctggaccggcccctgcccccccagaagaacttctttgcccactacttcaccctgggcagcaagttccgctactgcggccgcacagaggtgcagagcgtgcagtatggcaaggagaaggccaacaaggacagagtgtttgcccggagccccagcaagcccctggccaggaagctgatggactgggaggtggtgtccagaaattccatcagtgatgaccggctggagacccagagcctgcccagccgcagccccccaggcacccccaaccacaggaacagcaccttcacccaggagggcacccggctgcggcccagctctgtgggccacctggtggaccacatggtgcacaccagccccagcgaggtgtttgtgaaccagaggagccccagcagcacccaggccaacagcatcgtgctggagagcagccccagccaggagaccccaggagatggcaagcccccagccctgccccccaagcagagcaagaagaacagctggaaccagatccactacagccacagccagcaggacctggagagccacatcaatgagacctttgacatccccagcagccctgagaagcccaccccaaatggaggcatcccccatgacaacctggtgctgatccgcatgaagccagatgaaaatggccgcttcggcttcaacgtgaagggcggctatgaccagaagatgcctgtgattgtgtcccgggtggcccctggcaccccagctgacctgtgtgtgccccggctgaatgaaggagaccaggtggtgctgatcaatggccgggacattgctgagcacacccatgaccaggtggtgctcttcatcaaggccagctgtgagcggcacagcggggagctgatgctgctggtgcggcccaatgctgtgtatgatgtggtggaggagaagctggagaatgaaccagacttccagtacatccctgagaaggcccccctggacagcgtgcaccaggatgaccacagcctgcgggagagcatgatccagctggccgagggcctcatcaccggcaccgtgctgacccagtttgaccagctgtacaggaagaagccaggcatgaccatgagctgtgccaagctgccccagaacatcagcaagaaccgctacagagacatcagcccctatgatgccaccagggtcatcctgaagggaaatgaagactacatcaatgccaactacatcaacatggagatccccagcagcagcatcatcaaccagtacatcgcctgccagggccccctgccccacacctgcacagacttctggcagatgacctgggagcagggcagctccatggtggtgatgctgaccacccaggtggagcggggccgggtgaagtgccaccagtactggccagagcccaccggcagcagcagctatggctgctaccaggtgacctgccacagcgaggagggcaacacagcctacatcttcaggaagatgaccctcttcaaccaggagaagaatgaaagccggcccctgacccagatccagtacatcgcctggccagaccatggagtgcctgatgacagcagtgacttcctggactttgtgtgccacgtgaggaacaagagagctgggaaggaggagcctgtggtggtgcactgcagcgctggcatcggccgcactggagtgctgatcaccatggagacagccatgtgcctgattgagtgcaaccagcctgtgtaccccctggacatcgtgaggaccatgagggaccagagggccatgatgatccagacccccagccagtacagatttgtgtgtgaggccatcctgaaggtgtatgaggagggctttgtgaagcccctgaccaccagcaccaacaagtag

SEQ ID NO: 37212 - DNA, 228 bp, Artificial Sequence
  Description of Artificial Sequence: Synthetic coding sequence
atgaccagccgcttccggctgcctgctggccgcacctacaacgtgcgggccagcgagctggcccgggaccggcagcacacagaggtggtgtgcaacatcctgctgctggacaacacagtgcaggccttcaaggtgaacaagcatgaccagggccaggtgctgctggatgtggtgttcaagcacctggacctgacagagcaggactacttcggcctgcagctggcctag

SEQ ID NO: 37213 - DNA, 486 bp, Artificial Sequence
  Description of Artificial Sequence: Synthetic coding sequence
atgaccagccgcttccggctgcctgctggccgcacctacaacgtgcgggccagcgagctggcccgggaccggcagcacacagaggtggtgtgcaacatcctgctgctggacaacacagtgcaggccttcaaggtgaacaagcatgaccagggccaggtgctgctggatgtggtgttcaagcacctggacctgacagagcaggactacttcggcctgcagctggctgatgacagcacagacaacccccgctggctggaccccaacaagcccatcaggaagcagctgaagaagctgctgctgctgatcctgggcggcagcccctacagcctgaacttccgggtgaagttctttgtgtctgaccccaacaagctgcaggaggagtacacccgctaccagtacttcctgcagatcaagcaggacatcctgaccggccgcctgccctgccccagcaacacagctgccctgctggccagctttgctgtgtag

SEQ ID NO: 37214 - DNA, 1680 bp, Artificial Sequence
  Description of Artificial Sequence: Synthetic coding sequence
atggactgggaggtggtgtccaggaacagcatcagtgatgaccggctggagacccagagcctgcccagccgcagccccccaggcacccccaaccacaggaacagcaccttcacccaggagggcacccggctgcggcccagctctgtgggccacctggtggaccacatggtgcacaccagccccagcgaggtgtttgtgaaccagaggagccccagcagcacccaggccaacagcatcgtgctggagagcagccccagccaggagaccccaggagatggcaagcccccagccctgccccccaagcagagcaagaagaacagctggaaccagatccactacagccacagccagcaggacctggagagccacatcaatgagacctttgacatccccagcagccctgagaagcccacccccaacggcggcatcccccatgacaacctggtgctgatccgcatgaagccagatgaaaatggccgcttcggcttcaacgtgaagggcggctatgaccagaagatgcctgtgattgtgtcccgggtggcccctggcaccccagctgacctgtgtgtgccccggctgaatgaaggagaccaggtggtgctgatcaatggccgggacattgctgagcacacccatgaccaggtggtgctcttcatcaaggccagctgtgagcggcacagcggggagctgatgctgctggtgcggcccaatgctgtgtatgatgtggtggaggagaagctggagaatgaaccagacttccagtacatccctgagaaggcccccctggacagcgtgcaccaggatgaccacagcctgcgggagagcatgatccagctggccgagggcctcatcactggaacagtgctgacccagtttgaccagctgtacaggaagaagccaggcatgaccatgagctgtgccaagctgccccagaacatcagcaagaaccgctacagagacatcagcccctatgatgccaccagggtcatcctgaagggaaatgaagactacatcaatgccaactacatcaacatggagatccccagcagcagcatcatcaaccagtacatcgcctgccagggccccctgccccacacctgcacagacttctggcagatgacctgggagcagggcagctccatggtggtgatgctgaccacccaggtggagcggggccgggtgaagtgccaccagtactggccagagcccaccggcagcagcagctatggctgctaccaggtgacctgccacagcgaggagggcaacacagcctacatcttcaggaagatgaccctcttcaaccaggagaagaatgaaagccggcccctgacccagatccagtacatcgcctggccagaccacggcgtgcctgatgacagcagtgacttcctggactttgtgtgccacgtgaggaacaagagagctgggaaggaggagcctgtggtggtgcactgcagcgctggcattggaagaactggagtgctgatcaccatggagacagccatgtgcctgattgagtgcaaccagcctgtgtaccccctggacatcgtgaggaccatgagggaccagagggccatgatgatccagacccccagccagtacagatttgtgtgtgaggccatcctgaaggtgtatgaggagggctttgtgaagcccctgaccaccagcaccaacaagtag

SEQ ID NO: 37215 - DNA, 3708 bp, Artificial Sequence
  Description of Artificial Sequence: Synthetic coding sequence
atgatgtgtgaggtgatgcccaccatcaatgaagacacccccatgagccagaggggcagccagagcagcggcagtgacagcgacagccactttgagcagctgatggtgaacatgctggatgagcgggaccggctgctggacaccctgcgggagacccaggagagcctgagcctggcccagcagaggctgcaggatgtgatctatgaccgggacagcctgcagaggcagctgaacagcgccctgccccaggagtttgctgccctgaccaaggagctgaatgcctgccgggagcagctgctggagaaggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgtcctctgaggtggaggtgctgaaggccctgaagagcctgtttgagcaccacaaggccctggatgagaaggtgcgggagcggctgcgggtgtccctggagcgggtgtctgccctggaggaggagctggccgccgccaaccaggagatcgtggccctgcgggagcagaatgtgcacatccagaggaagatggccagcagcgagggcagcacagaaagtgagcacctggagggcatggagcccggccagaaggtgcatgagaagaggctgagcaatggcagcattgacagcacagatgagaccagccagatcgtggagctgcaggagctgctggagaagcagaactatgagatggcccagatgaaggagcggctggccgccctgagcagccgggtgggggaggtggagcaggaggccgagacagccaggaaggacctgatcaagacagaggagatgaacaccaagtaccagagggacatccgggaggccatggcccagaaggaggacatggaggagcgcatcaccaccctggagaagcgctacctgagcgcccagcgggagagcaccagcatccatgacatgaatgacaagctggagaatgagctggccaacaaggaggccatcctgcggcagatggaggagaagaaccggcagctgcaggagcggctggagctggccgagcagaagctgcagcagaccatgaggaaggccgagaccctgcctgaggtggaggccgagctggcccagagaattgctgccctgaccaaggccgaggagagacatggcaacatcgaggagaggatgaggcacctggagggccagctggaggagaagaaccaggagctgcagagggcccggcagcgggagaagatgaatgaggagcacaacaagaggctgagtgacacagtggaccggctgctgacagagagcaatgaaaggctgcagctgcacctgaaggagaggatggccgccctggaggagaagaatgtgctgatccaggagagcgagaccttcaggaagaacctggaggagagcctgcatgacaaggagcggctggccgaggagattgagaagctgcggtctgagctggaccagctgaagatgaggacaggcagcctcatcgagcccaccatccccaggacccacctggacaccagcgctgagctgcgctacagcgtgggcagcctggtggacagccagagcgactaccgcaccaccaaggtgatccggcggccccggcggggccgcatgggcgtgagaagagatgagcccaaggtgaagagcctgggggaccacgagtggaacagaacccagcagatcggcgtgctgagcagccacccctttgaaagtgacacagagatgtctgacattgatgatgatgaccgggagaccatcttcagctccatggacctgctgagccccagcggccacagtgatgcccagaccctggccatgatgctgcaggagcagctggatgccatcaacaaggagatccgcctcatccaggaggagaaggagagcacagagctgcgggcagaggagattgagaacagagtggcctctgtgtccctggagggcctgaacctggcccgggtgcaccctggcaccagcatcacagcctctgtgacagccagcagcctggccagcagcagcccccccagcggccacagcacccccaagctgacccccaggagccctgcccgggagatggacaggatgggcgtgatgaccctgcccagcgacctgaggaagcacaggaggaagattgctgtggtggaggaggatggccgggaggacaaggccaccatcaagtgtgagaccagccccccacccaccccccgggccctgaggatgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaagctgctgcccaggagagcctgggcctgggcaagctgggcacccaggccgagaaggaccggcggctgaagaagaaggtgatcagacatgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggacccccagcggaaatgtgtgggtgacccatgaggagatggagaacctggccgccccagccaagaccaaggagagcgaggagggctcctgggcccagtgccctgtgttcctgcagaccctggcctatggagacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaagaagaggaccagcctgcagtatggcatcatgtgcctgaagaggctgaactatgacaggaaggagctggagcggcggcgggaggccagccagcacgagatcaaggatgtgctggtgtggagcaatgacagagtcatccgctggatccaggccatcggcctgcgggagtatgccaacaacatcctggagagcggcgtgcacggcagcctgattgccctggatgaaaattttgactacagcagcctggccctgctgctgcagatccccacccagaacacccaggcccggcagatcctggagcgggagtacaacaacctgctggccctgggcacagaaagaaggctggatgaaagtgatgacaagaacttccggcggggcagcacctggaggcggcagttccccccccgggaggtgcacggcatctccatgatgcctggcagcagcgagaccctgcctgctggcttccggctgaccaccaccagcggccagagcaggaagatgaccacagatgatggagtcttctctgtgtacagcacctag

SEQ ID NO: 37216 - DNA, 3471 bp, Artificial Sequence
  Description of Artificial Sequence: Synthetic coding sequence
atgatcttcagtgacatgaacacagtgtctggcagccccaaggtgcaccccccaaatggcacccgcttctacaccttccaggagtttgctgccctgaccaaggagctgaatgcctgccgggagcagctgctggagaaggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgtcctctgaggtggaggtgctgaaggccctgaagagcctgtttgagcaccacaaggccctggatgagaaggtgcgggagcggctgcgggtgtccctggagcgggtgtctgccctggaggaggagctggccgccgccaaccaggagatcgtggccctgcgggagcagaatgtgcacatccagaggaagatggccagcagcgagggcagcacagaaagtgagcacctggagggcatggagcccggccagaaggtgcatgagaagaggctgagcaatggcagcattgacagcacagatgagaccagccagatcgtggagctgcaggagctgctggagaagcagaactatgagatggcccagatgaaggagcggctggccgccctgagcagccgggtgggggaggtggagcaggaggccgagacagccaggaaggacctgatcaagacagaggagatgaacaccaagtaccagagggacatccgggaggccatggcccagaaggaggacatggaggagcgcatcaccaccctggagaagcgctacctgagcgcccagcgggagagcaccagcatccatgacatgaatgacaagctggagaatgagctggccaacaaggaggccatcctgcggcagatggaggagaagaaccggcagctgcaggagcggctggagctggccgagcagaagctgcagcagaccatgaggaaggccgagaccctgcctgaggtggaggccgagctggcccagagaattgctgccctgaccaaggccgaggagagacatggcaacatcgaggagaggatgaggcacctggagggccagctggaggagaagaaccaggagctgcagagggcccggcagcgggagaagatgaatgaggagcacaacaagaggctgagtgacacagtggaccggctgctgacagagagcaatgaaaggctgcagctgcacctgaaggagaggatggccgccctggaggagaagaatgtgctgatccaggagagcgagaccttcaggaagaacctggaggagagcctgcatgacaaggagcggctggccgaggagattgagaagctgcggtctgagctggaccagctgaagatgaggacaggcagcctcatcgagcccaccatccccaggacccacctggacaccagcgctgagctgcgctacagcgtgggcagcctggtggacagccagagcgactaccgcaccaccaaggtgatccggcggccccggcggggccgcatgggcgtgagaagagatgagcccaaggtgaagagcctgggggaccacgagtggaacagaacccagcagatcggcgtgctgagcagccacccctttgaaagtgacacagagatgtctgacattgatgatgatgaccgggagaccatcttcagctccatggacctgctgagccccagcggccacagtgatgcccagaccctggccatgatgctgcaggagcagctggatgccatcaacaaggagatccgcctcatccaggaggagaaggagagcacagagctgcgggcagaggagattgagaacagagtggcctctgtgtccctggagggcctgaacctggcccgggtgcaccctggcaccagcatcacagcctctgtgacagccagcagcctggccagcagcagcccccccagcggccacagcacccccaagctgacccccaggagccctgcccgggagatggacaggatgggcgtgatgaccctgcccagcgacctgaggaagcacaggaggaagattgctgtggtggaggaggatggccgggaggacaaggccaccatcaagtgtgagaccagccccccacccaccccccgggccctgaggatgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaagctgctgcccaggagagcctgggcctgggcaagctgggcacccaggccgagaaggaccggcggctgaagaagaagcatgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggaccaaggagagcgaggagggctcctgggcccagaccctggcctatggagacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagaggagaagagaggccagccagcacgagatcaaggatgtgctggtgtggagcaatgacagagtcatccgctggatccaggccatcggcctgcgggagtatgccaacaacatcctggagagcggcgtgcacggcagcctcatcgccctggatgagaactttgactacagcagcctggccctgctgctgcagatccccacccagaacacccaggcccggcagatcctggagcgggagtacaacaacctgctggccctgggcacagagcggcggctggatgaaagtgatgacaagaacttcagaagaggcagcacctggaggcggcagtttcctccccgggaggtgcacggcatctccatgatgcctggcagcagcgagaccctgcctgctggcttccggctgaccaccaccagcggccagagcaggaagatgaccacagatgtggccagcagccggctgcagaggctggacaacagcacagtgaggacctacagctgctag

SEQ ID NO: 37217 - DNA, 1332 bp, Artificial Sequence
  Description of Artificial Sequence: Synthetic coding sequence
atgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaggccgccgcccaggagagcctgggcctgggcaagctgggcacccaggccgagaaggaccggcggctgaagaagaagcatgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggacctgccctgtgttcctgcagaccctggcctacggggacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagcggcggcgggaggccagccagcacgagatcaaggatgtgctggtgtggagcaatgacagagtcatccgctggatccaggccatcggcctgcgggagtatgccaacaacatcctggagagcggcgtgcacggcagcctgattgccctggatgaaaattttgactacagcagcctggccctgctgctgcagatccccacccagaacacccaggcccggcagatcctggagcgggagtacaacaacctgctggccctgggcacagaaagaaggctggatgaaagtgatgacaagaacttccggcggggcagcacctggaggcggcagttccccccccgggaggtgcacggcatctccatgatgcctggcagcagcgagaccctgcctgctggcttccggctgaccaccaccagcggccagagcaggaagatgaccacagatgtggccagcagccggctgcagaggctggacaacagcacagtgaggacctacagctgctag

SEQ ID NO: 37218 - DNA, 3783 bp, Artificial Sequence
  Description of Artificial Sequence: Synthetic coding sequence
cgcagcaaggaccccaagagccagaccctggccatgatgtgtgaggtgatgcccaccatcaatgaagacacccccatgagccagaggggcagccagagcagcggcagtgacagcgacagccactttgagcagctgatggtgaacatgctggatgagcgggaccggctgctggacaccctgcgggagacccaggagagcctgagcctggcccagcagaggctgcaggacgtcatctatgaccgggacagcctgcagaggcagctgaacagcgccctgccccaggacatcgagagcctgaccggcggcctggccggcagcaaaggagctgaccccccagagtttgctgccctgaccaaggagctgaatgcctgccgggagcagctgctggagaaggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgagcagcgaggtggaggtgctgaaggccctgaagagcctgtttgagcaccacaaggccctggatgagaaggtgcgggagcggctgcgggtgtccctggagcgggtgtctgccctggaggaggagctggccgccgccaaccaggagatcgtggccctgcgggagcagaatgtgcacatccagaggaagatggccagcagcgagggcagcacagagagcgagcacctggagggcatggagcccggccagaaggtgcatgagaagaggctgagcaatggcagcattgacagcacagatgagaccagccagatcgtggagctgcaggagctgctggagaagcagaactatgagatggcccagatgaaggagcggctggccgccctgagcagccgggtgggggaggtggagcaggaggccgagacagccaggaaggacctgatcaagacagaggagatgaacaccaagtaccagagggacatccgggaggccatggcccagaaggaggacatggaggagcgcatcaccaccctggagaagcgctacctgagcgcccagcgggagagcaccagcatccatgacatgaatgacaagctggagaatgagctggccaacaaggaggccatcctgcggcagatggaggagaagaaccggcagctgcaggagcggctggagctggccgagcagaagctgcagcagaccatgaggaaggccgagaccctgcctgaggtggaggccgagctggcccagagaattgctgccctgaccaaggccgaggagcggcacggcaacatcgaggagaggatgaggcacctggagggccagctggaggagaagaaccaggagctgcagagggcccggcagcgggagaagatgaatgaggagcacaacaagaggctgagtgacacagtggaccggctgctgacagagagcaatgaaaggctgcagctgcacctgaaggagaggatggccgccctggaggagaagaatgtgctgatccaggagagcgagaccttcaggaagaacctggaggagagcctgcatgacaaggagcggctggccgaggagattgagaagctgcggtctgagctggaccagctgaagatgaggacaggcagcctgattgagcccaccatccccaggacccacctggacaccagcgctgagctgcgctacagcgtgggcagcctggtggacagccagagcgactaccgcaccaccaaggtgatcagaagaccccggcggggccgcatgggcgtgagaagagatgagcccaaggtgaagagcctgggggaccacgagtggaacagaacccagcagattggagtgctgagcagccacccctttgaaagtgacacagagatgtctgacattgatgatgatgaccgggagaccatcttcagctccatggacctgctgagccccagcggccacagtgatgcccagaccctggccatgatgctgcaggagcagctggatgccatcaacaaggagatccgcctcatccaggaggagaaggagagcacagagctgcgggcagaggagattgaaaatagagtggcctctgtgtccctggagggcctgaacctggcccgggtgcaccctggcaccagcatcacagcctctgtgacagccagcagcctggccagcagcagccccccatctggccacagcacccccaagctgacccccaggagccctgcccgggagatggacaggatgggcgtgatgaccctgcccagcgacctgaggaagcacaggaggaagattgctgtggtggaggaggatggaagagaggacaaggccaccatcaagtgtgagaccagccccccacccaccccccgggccctgaggatgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaggccgccgcccaggagagcctgggcctgggcaagctgggcacccaggccgagaaggaccggcggctgaagaagaagcatgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggacccccagcggaaatgtgtgggtgacccatgaggagatggagaacctggccgccccagccaagaccaaggagagcgaggagggctcctgggcccagtgccctgtgttcctgcagaccctggcctatggagacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagaggagaagagaggccagccagcacgagatcaaggatgtgctggtgtggagcaatgacagagtcatccgctggatccaggccatcggcctgcgggagtatgccaacaacatcctggagagcggcgtgcacggcagcctcatcgccctggatgagaactttgactacagcagcctggccctgctgctgcagatccccacccagaacacccaggccaatgcccggcagatcctggagcgggagtacaacaacctgctggccctgggcacagagcggcggctggatgaaagtgatgacaagaacttcagaagaggcagcacctggaggcggcagtttcctccccgggaggtgcacggcatctccatgatgcctggcagcagcgagaccctgcctgctggcttccggctgaccaccaccagcggccagagcaggaagatgaccacagatgatggagtcttctctgtgtacagcacctag

SEQ ID NO: 37219 - DNA, 366 bp, Artificial Sequence
  Description of Artificial Sequence: Synthetic coding sequence
atgatgtgtgaggtgatgcccaccatcaatgaagacacccccatgagccagaggggcagccagagcagcggcagtgacagcgacagccactttgagcagctgatggtgaacatgctggatgagcgggaccggctgctggacaccctgcgggagacccaggagagcctgagcctggcccagcagaggctgcaggatgtgatctatgaccgggacagcctgcagaggcagctgaacagcgccctgccccaggacatcgagagcctgactggaggcctggccggcagcaaaggagctgaccccccagagtttgctgccctgaccaaggagctgaatgcctgccgggagcagctgctggagaaggagtag

SEQ ID NO: 37220 - DNA, 3774 bp, Artificial Sequence
  Description of Artificial Sequence: Synthetic coding sequence
atgatgtgtgaggtgatgcccaccatcaatgaagacacccccatgagccagaggggcagccagagcagcggcagtgacagcgacagccactttgagcagctgatggtgaacatgctggatgagcgggaccggctgctggacaccctgcgggagacccaggagagcctgagcctggcccagcagaggctgcaggatgtgatctatgaccgggacagcctgcagaggcagctgaacagcgccctgccccaggacatcgagagcctgactggaggcctggccggcagcaaaggagctgaccccccagagtttgctgccctgaccaaggagctgaatgcctgccgggagcagctgctggagaaggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgtcctctgaggtggaggtgctgaaggccctgaagagcctgtttgagcaccacaaggccctggatgagaaggtgcgggagcggctgcgggtgtccctggagcgggtgtctgccctggaggaggagctggccgccgccaaccaggagatcgtggccctgcgggagcagaatgtgcacatccagaggaagatggccagcagcgagggcagcacagaaagtgagcacctggagggcatggagcccggccagaaggtgcatgagaagaggctgagcaatggcagcattgacagcacagatgagaccagccagatcgtggagctgcaggagctgctggagaagcagaactatgagatggcccagatgaaggagcggctggccgccctgagcagccgggtgggggaggtggagcaggaggccgagacagccaggaaggacctgatcaagacagaggagatgaacaccaagtaccagagggacatccgggaggccatggcccagaaggaggacatggaggagcgcatcaccaccctggagaagcgctacctgagcgcccagcgggagagcaccagcatccatgacatgaatgacaagctggagaatgagctggccaacaaggaggccatcctgcggcagatggaggagaagaaccggcagctgcaggagcggctggagctggccgagcagaagctgcagcagaccatgaggaaggccgagaccctgcctgaggtggaggccgagctggcccagagaattgctgccctgaccaaggccgaggagagacatggcaacatcgaggagaggatgaggcacctggagggccagctggaggagaagaaccaggagctgcagagggcccggcagcgggagaagatgaatgaggagcacaacaagaggctgagtgacacagtggaccggctgctgacagagagcaatgaaaggctgcagctgcacctgaaggagaggatggccgccctggaggagaagaatgtgctgatccaggagagcgagaccttcaggaagaacctggaggagagcctgcatgacaaggagcggctggccgaggagattgagaagctgcggtctgagctggaccagctgaagatgaggacaggcagcctcatcgagcccaccatccccaggacccacctggacaccagcgctgagctgcgctacagcgtgggcagcctggtggacagccagagcgactaccgcaccaccaaggtgatccggcggccccggcggggccgcatgggcgtgagaagagatgagcccaaggtgaagagcctgggggaccacgagtggaacagaacccagcagatcggcgtgctgagcagccacccctttgaaagtgacacagagatgtctgacattgatgatgatgaccgggagaccatcttcagctccatggacctgctgagccccagcggccacagtgatgcccagaccctggccatgatgctgcaggagcagctggatgccatcaacaaggagatccgcctcatccaggaggagaaggagagcacagagctgcgggcagaggagattgagaacagagtggcctctgtgtccctggagggcctgaacctggcccgggtgcaccctggcaccagcatcacagcctctgtgacagccagcagcctggccagcagcagcccccccagcggccacagcacccccaagctgacccccaggagccctgcccgggagatggacaggatgggcgtgatgaccctgcccagcgacctgaggaagcacaggaggaagattgctgtggtggaggaggatggccgggaggacaaggccaccatcaagtgtgagaccagccccccacccaccccccgggccctgaggatgacccacaccctgcccagcagctaccacaatgatgcccggagcagcctgtctgtgtccctggagcctgagagcctgggcctgggcagcgccaacagcagccaggacagcctgcacaaggcccccaagaagaagggcatcaagagcagcatcggccgcctgtttgggaagaaggagaaggcccggctgggccagctgcggggcttcatggagacagaagctgctgcccaggagagcctgggcctgggcaagctgggcacccaggccgagaaggaccggcggctgaagaagaagcatgagctgctggaggaggcccggaggaagggcctgccctttgcccagtgggatggccccaccgtggtggcctggctggagctgtggctgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatggtgtccctgaccagccccagcgccccacccaccagcaggaccccatctggaaatgtgtgggtgacccatgaggagatggagaacctggccgccccagccaagaccaaggagagcgaggagggctcctgggcccagtgccctgtgttcctgcagaccctggcctacggggacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagcggcggcgggaggccagccagcacgagatcaaggatgtgctggtgtggagcaatgacagagtcatccgctggatccaggccatcggcctgcgggagtatgccaacaacatcctggagagcggcgtgcacggcagcctgattgccctggatgaaaattttgactacagcagcctggccctgctgctgcagatccccacccagaacacccaggcccggcagatcctggagcgggagtacaacaacctgctggccctgggcacagaaagaaggctggatgaaagtgatgacaagaacttccggcggggcagcacctggaggcggcagttccccccccgggaggtgcacggcatctccatgatgcctggcagcagcgagaccctgcctgctggcttccggctgaccaccaccagcggccagagcaggaagatgaccacagatgtggccagcagccggctgcagaggctggacaacagcacagtgaggacctacagctgctag

SEQ ID NO: 37221 - DNA, 1974 bp, Artificial Sequence
  Description of Artificial Sequence: Synthetic coding sequence
atgagaagagctgtgtgcttccctgccctgtgcctgctgctgaacctgcacgccgccggctgcttcagcggcaacaatgaccacttcctggccatcaaccagaagaagagcggcaagcctgtgttcatctacaagcacagccaggacatcgagaagagcctggacatcgccccccagaagatctaccgccacagctaccacagcagcagcgaggcccaggtgtccaagaggcaccagatcgtgaacagcgccttccccaggcctgcctatgaccccagcctgaacctgctggccatggatggccaggacctggaggtggagaacctgcccatcccagctgccaacgtgattgtggtgaccctgcagatggatgtgaacaagctgaacatcaccctgctgcgcatcttccggcagggcgtggccgccgccctgggcctgctgccccagcaggtgcacatcaaccggctgattggcaagaagaacagcattgagctgtttgtgagccccatcaacaggaagacaggcatcagtgatgccctgcccagcgaggaggtgctgcggagcctgaacatcaacgtgctgcaccagagcctgagccagtttggcatcacagaggtgtccccagagaagaatgtgctgcagggccagcatgaagctgacaagatctggagcaaggagggcttctatgctgtggtgatcttcctgagcatcttcgtcatcatcgtgacctgcctgatgatcctgtaccgcctgaaggagcgcttccagctgagcctgcggcaggacaaggagaagaaccaggagatccacctgagccccatcaccctgcagcctgccctgtctgaggccaagacagtgcacagcatggtgcagcctgagcaggcccccaaggtgctgaatgtggtggtggacccccagggccgcggggcccctgagatcaaggccaccacagccacctctgtgtgccccagccccttcaagatgaagcccatcggcctgcaggagcggcggggcagcaatgtgtccctgaccctggacatgagcagcctgggcaacatcgagccctttgtgtccatccccaccccccgggagaaggtggccatggagtacctgcagagcgccagccgcatcctgaccaggagccagctgagagatgtggtggccagcagccacctgctgcagagcgagttcatggagatccccatgaactttgtggaccccaaggagattgacatccccaggcatggcaccaagaaccgctacaagaccatcctgcccaaccccctgagccgggtgtgcctgcggcccaagaatgtgacagacagcctgagcacctacatcaatgccaactacatccggggctacagcggcaaggagaaggccttcatcgccacccagggccccatgatcaacacagtggatgacttctggcagatggtgtggcaggaggacagccctgtgattgtgatgatcaccaagctgaaggagaagaatgagaagtgtgtgctgtactggccagagaagaggggcatctacggcaaggtggaggtgctggtgatctctgtgaatgaatgtgacaactacaccatccggaacctggtgctgaagcagggcagccacacccagcacgtgaagcactactggtacacctcctggccagaccacaagaccccagacagcgcccagcccctgctgcagctgatgctggatgtggaggaggaccggctggccagccagggccggggccctgtggtggtgcactgcagcgctggcatcggccgcacaggctgcttcatcgccaccagcatcggctgccagcagctgaaggaggagggcgtggtggatgccctgagcatcgtgtgccagctgaggatggaccggggcggcatggtgcagaccagcgagcagtatgaatttgtgcaccacgccctgtgcctgtatgagagccggctgtctgctgagaccgtgcagtag

SEQ ID NO: 37222 - DNA, 1356 bp, Artificial Sequence
  Description of Artificial Sequence: Synthetic coding sequence
atgaaccagaagaatgtgctgcagggccagcatgaagctgacaagatctggagcaaggagggcttctatgctgtggtgatcttcctgagcatcttcgtcatcatcgtgacctgcctgatgatcctgtaccgcctgaaggagcgcttccagctgagcctgcggcaggacaaggagaagaaccaggagatccacctgagccccatcaccctgcagcctgccctgtctgaggccaagacagtgcacagcatggtgcagcctgagcaggcccccaaggtgctgaatgtggtggtggacccccagggccgcggggcccctgagatcaaggccaccacagccacctctgtgtgccccagccccttcaagatgaagcccatcggcctgcaggagcggcggggcagcaatgtgtccctgaccctggacatgagcagcctgggcaacatcgagccctttgtgtccatccccaccccccgggagaaggtggccatggagtacctgcagagcgccagccgcatcctgaccaggagccagctgagagatgtggtggccagcagccacctgctgcagagcgagttcatggagatccccatgaactttgtggaccccaaggagattgacatccccaggcatggcaccaagaaccgctacaagaccatcctgcccaaccccctgagccgggtgtgcctgcggcccaagaatgtgacagacagcctgagcacctacatcaatgccaactacatccggggctacagcggcaaggagaaggccttcatcgccacccagggccccatgatcaacacagtggatgacttctggcagatggtgtggcaggaggacagccctgtgattgtgatgatcaccaagctgaaggagaagaatgagaagtgtgtgctgtactggccagagaagaggggcatctacggcaaggtggaggtgctggtgatctctgtgaatgaatgtgacaactacaccatccggaacctggtgctgaagcagggcagccacacccagcacgtgaagcactactggtacacctcctggccagaccacaagaccccagacagcgcccagcccctgctgcagctgatgctggatgtggaggaggaccggctggccagccagggccggggccctgtggtggtgcactgcagcgctggcatcggccgcacaggctgcttcatcgccaccagcatcggctgccagcagctgaaggaggagggcgtggtggatgccctgagcatcgtgtgccagctgaggatggaccggggcggcatggtgcagaccagcgagcagtatgaatttgtgcaccacgccctgtgcctgtatgagagccggctgtctgctgagaccgtgcagtag

SEQ ID NO: 37223 - DNA, 1239 bp, Artificial Sequence
  Description of Artificial Sequence: Synthetic coding sequence
atgatcctgtaccgcctgaaggagcgcttccagctgagcctgcggcaggacaaggagaagaaccaggagatccacctgagccccatcaccctgcagcctgccctgtctgaggccaagacagtgcacagcatggtgcagcctgagcaggcccccaaggtgctgaatgtggtggtggacccccagggccgcggggcccctgagatcaaggccaccacagccacctctgtgtgccccagccccttcaagatgaagcccatcggcctgcaggagcggcggggcagcaatgtgtccctgaccctggacatgagcagcctgggcaacatcgagccctttgtgtccatccccaccccccgggagaaggtggccatggagtacctgcagagcgccagccgcatcctgaccaggagccagctgagagatgtggtggccagcagccacctgctgcagagcgagttcatggagatccccatgaactttgtggaccccaaggagattgacatccccaggcatggcaccaagaaccgctacaagaccatcctgcccaaccccctgagccgggtgtgcctgcggcccaagaatgtgacagacagcctgagcacctacatcaatgccaactacatccggggctacagcggcaaggagaaggccttcatcgccacccagggccccatgatcaacacagtggatgacttctggcagatggtgtggcaggaggacagccctgtgattgtgatgatcaccaagctgaaggagaagaatgaaaaatgtgtgctgtactggccagagaagaggggcatctacggcaaggtggaggtgctggtgatctctgtgaatgaatgtgacaactacaccatccggaacctggtgctgaagcagggcagccacacccagcacgtgaagcactactggtacacctcctggccagaccacaagaccccagattctgcccagcccctgctgcagctgatgctggatgtggaggaggaccggctggccagccagggccggggccctgtggtggtgcactgcagcgctggcattggaagaacaggctgcttcatcgccaccagcatcggctgccagcagctgaaggaggagggcgtggtggatgccctgagcatcgtgtgccagctgaggatggacagaggaggcatggtgcagaccagcgagcagtatgaatttgtgcaccacgccctgtgcctgtatgagagccggctgtctgctgagaccgtgcagtag

SEQ ID NO: 37224 - DNA, 1239 bp, Artificial Sequence; identical to SEQ ID NO: 37223
  Description of Artificial Sequence: Synthetic coding sequence

SEQ ID NO: 37225 - DNA, 597 bp, Artificial Sequence
  Description of Artificial Sequence: Synthetic coding sequence
atgatcctgtaccgcctgaaggagcgcttccagctgagcctgcggcaggacaaggagaagaaccaggagatccacctgagccccatcaccctgcagcctgccctgtctgaggccaagacagtgcacagcatggtgcagcctgagcaggcccccaaggtgctgaatgtggtggtggacccccagggccgcggggcccctgagatcaaggccaccacagccacctctgtgtgccccagccccttcaagatgaagcccatcggcctgcaggagcggcggggcagcaatgtgtccctgaccctggacatgagcagcctgggcaacatcgagccctttgtgtccatccccaccccccgggagaaggtggccatggagtacctgcagagcgccagccgcatcctgaccaggagccagctgagagatgtggtggccagcagccacctgctgcagagcgagttcatggagatccccatgaactttgtggaccccaaggagattgacatccccaggcatggcaccaagaaccgctacaagaccatcctgcccaaccccctgagccgggtgtgcctgcggcccaagaatgtgacagacagcctgtag

SEQ ID NO: 37226 - DNA, 4353 bp, Artificial Sequence
  Description of Artificial Sequence: Synthetic coding sequence
atggccagcctggccgccctggccctgagcctgctgctgcggctgcagctgccccccctgcccggggcccgggcccagagcgctgctgggggctgcagctttgatgagcactacagcaactgtggctacagcgtggccctgggcaccaacggcttcacctgggagcagatcaacacctgggagaagcccatgctggaccaggccgtgcccaccggcagcttcatgatggtgaacagcagcggccgggccagcggccagaaggcccacctgctgctgcccaccctgaaggaaaatgacacccactgcatcgacttccactactacttcagcagccgggacaggagcagccctggggccctgaatgtgtatgtgaaggtgaatggaggcccccagggcaaccctgtgtggaatgtgtctggagtggtgacagagggctgggtgaaggccgagctggccatcagcaccttctggccccacttctaccaggtgatctttgaatctgtgtccctgaagggccaccctggctacatcgctgtggatgaggtgcgggtgctggcccacccctgcaggaaggccccccacttcctgcggctgcagaatgtggaggtgaatgtgggccagaatgccaccttccagtgcatcgccggcggcaagtggagccagcacgacaagctgtggctgcagcagtggaatggccgggacacagccctgatggtgaccagggtggtgaaccaccggcgcttcagcgccaccgtgtctgtggccgacacagcccagaggtctgtgtccaagtaccgctgtgtgatccgcagtgatggcggcagcggcgtgagcaactatgcagagctgattgtgaaggagccccccacccccatcgcccctcctgagctgctggccgtgggcgccacctacctgtggatcaagcccaatgccaacagcatcattggagatggccccatcatcctgaaggaggtggagtaccgcaccaccaccggcacctgggccgagacccacatcgtggacagccccaactacaagctgtggcacctggaccctgatgtggagtatgagatccgggtgctgctgaccaggcctggagagggcggcaccggccccccaggcccccccctgaccaccaggaccaagtgtgccgaccctgtgcacggcccccagaatgtggagatcgtggacatccgggcccggcagctgaccctgcagtgggagcccttcggctatgctgtgacccgctgccacagctacaacctgactgtgcagtaccagtatgtgttcaaccagcagcagtatgaagctgaggaggtgatccagaccagcagccactacaccctgcggggcctgcggcccttcatgaccatccggctgcggctgctgctgagcaaccctgagggccgcatggagagcgaggagctggtggtgcagacagaggaggatgtgcctggagctgtgcccctggagagcatccagggcggcccctttgaggagaagatctacatccagtggaagcccccaaatgagaccaatggagtcatcaccctgtatgagatcaactacaaggctgtgggcagcctggaccccagcgctgacctgagcagccagaggggcaaggtgttcaagctgagaaatgagacccaccacctgtttgtgggcctgtacccaggcaccacctacagcttcaccatcaaggccagcacagccaagggcttcggcccccctgtgaccacccgcatcgccaccaagatcagcgcccccagcatgccagaatatgacacagacacccccctgaatgaaacagacaccaccatcaccgtgatgctgaagccagcccagagcagaggagcccctgtgtctgtgtaccagctggtggtgaaggaggagcggctgcagaagagcagaagagctgctgacatcatcgagtgcttctctgtgcctgtgtcctacagaaatgccagcagcctggacagcctgcactactttgctgctgagctgaagccagccaacctgcctgtgacccagcccttcaccgtgggggacaacaagacctacaacggctactggaacccccccctgagccccctgaagagctacagcatctacttccaggccctgagcaaggccaacggggagaccaagatcaactgtgtgcggctggccaccaaggcccccatgggcagcgcccaggtgaccccaggcacccccctgtgcctgctgaccaccggggccagcacccagaacagcaacacagtggagcctgagaagcaggtggacaacacagtgaagatggccggcgtgattgctggcctgctgatgttcatcatcatcctgctgggcgtgatgctgaccatcaagaggaggaagctggccaagaagcagaaggagacccagagcggggcccagcgggagatgggccctgtggccagcgctgacaagcccaccaccaagctgagcgccagcagaaatgatgagggcttcagcagcagcagccaggatgtgaatggcttcacagatggcagcagaggagagctgagccagcccaccctgaccatccagacccacccctaccgcacctgtgaccctgtggagatgagctacccccgggaccagttccagcctgccatccgggtggccgacctgctgcagcacatcacccagatgaagaggggccagggctacggcttcaaggaggagtatgaggccctgcctgagggccagacagcctcctgggacacagccaaggaggatgagaacagaaacaagaacagatatggcaacatcatctcctatgaccacagccgggtgcggctgctggtgctggatggagacccccacagcgactacatcaatgccaactacattgatggctaccaccggcccaggcactacatcgccacccagggccccatgcaggagaccgtgaaggacttctggaggatgatctggcaggagaacagcgccagcatcgtgatggtgaccaacctggtggaggtgggccgggtgaagtgtgtgcgctactggccagatgacacagaggtgtatggagacatcaaggtgaccctgattgaaacagagcccctggccgagtatgtgatccgcaccttcaccgtgcagaagaagggctaccacgagatccgggagctgcggctcttccacttcacctcctggccagaccacggcgtgccctgctacgccaccggcctgctgggctttgtgcggcaggtgaagttcctgaaccccccagaggccggccccatcgtggtgcactgcagcgctggagctggccgcacaggctgcttcatcgccatcgacaccatgctggacatggccgagaatgaaggagtggtggacatcttcaactgtgtgcgggagctgcgggcccagagggtgaacctggtgcagacagaggagcagtatgtgtttgtgcatgatgccatcctggaggcctgcctgtgtggcaacacagccatccctgtgtgtgagttccgcagcctgtactacaacatcagccggctggacccccagaccaacagcagccagatcaaggatgagttccagaccctgaacatcgtgaccccccgggtgcggcctgaggactgcagcatcggcctgctgcccaggaaccacgacaagaacagatccatggatgtgctgcccctggaccgctgcctgcccttcctgatctctgtggatggagagagcagcaactacatcaatgctgccctgatggacagccacaagcagcctgctgcctttgtggtgacccagcaccccctgcccaacacagtggccgacttctggaggctggtgtttgactacaactgcagctctgtggtgatgctgaatgagatggacacagcccagttctgcatgcagtactggccagagaagaccagcggctgctacggccccatccaggtggagtttgtgtctgctgacattgatgaggacatcatccaccgcatcttccgcatctgcaacatggcccggccccaggacggctaccgcatcgtgcagcacctgcagtacatcggctggccagcctacagagacaccccacccagcaagaggagcctgctgaaggtggtgcggcggctggagaagtggcaggagcagtatgatggccgggagggccgcacagtggtgcactgcctgaatggaggcggccgcagcggcaccttctgtgccatctgcagcgtgtgtgagatgatccagcagcagaacatcattgatgtgttccacatcgtgaagaccctgaggaacaacaagagcaacatggtggagaccctggagcagtacaagtttgtgtatgaggtggccctggagtacctgagcagcttctag

SEQ ID NO: 37227 - DNA, 4356 bp, Artificial Sequence
  Description of Artificial Sequence: Synthetic coding sequence
atggccagcctggccgccctggccctgagcctgctgctgcggctgcagctgccccccctgcccggggcccgggcccagagcgctgctgggggctgcagctttgatgagcactacagcaactgtggctacagcgtggccctgggcaccaacggcttcacctgggagcagatcaacacctgggagaagcccatgctggaccaggccgtgcccaccggcagcttcatgatggtgaacagcagcggccgggccagcggccagaaggcccacctgctgctgcccaccctgaaggaaaatgacacccactgcatcgacttccactactacttcagcagccgggacaggagcagccctggggccctgaatgtgtatgtgaaggtgaatggaggcccccagggcaaccctgtgtggaatgtgtctggagtggtgacagagggctgggtgaaggccgagctggccatcagcaccttctggccccacttctaccaggtgatctttgaatctgtgtccctgaagggccaccctggctacatcgctgtggatgaggtgcgggtgctggcccacccctgcaggaaggccccccacttcctgcggctgcagaatgtggaggtgaatgtgggccagaatgccaccttccagtgcatcgccggcggcaagtggagccagcacgacaagctgtggctgcagcagtggaatggccgggacacagccctgatggtgaccagggtggtgaaccaccggcgcttcagcgccaccgtgtctgtggccgacacagcccagaggtctgtgtccaagtaccgctgtgtgatccgcagtgatggcggcagcggcgtgagcaactatgcagagctgattgtgaaggagccccccacccccatcgcccctcctgagctgctggccgtgggcgccacctacctgtggatcaagcccaatgccaacagcatcattggagatggccccatcatcctgaaggaggtggagtaccgcaccaccaccggcacctgggccgagacccacatcgtggacagccccaactacaagctgtggcacctggaccctgatgtggagtatgagatccgggtgctgctgaccaggcctggagagggcggcaccggccccccaggcccccccctgaccaccaggaccaagtgtgccgaccctgtgcacggcccccagaatgtggagatcgtggacatccgggcccggcagctgaccctgcagtgggagcccttcggctatgctgtgacccgctgccacagctacaacctgactgtgcagtaccagtatgtgttcaaccagcagcagtatgaagctgaggaggtgatccagaccagcagccactacaccctgcggggcctgcggcccttcatgaccatccggctgcggctgctgctgagcaaccctgagggccgcatggagagcgaggagctggtggtgcagacagaggaggatgtgcctggagctgtgcccctggagagcatccagggcggcccctttgaggagaagatctacatccagtggaagcccccaaatgagaccaatggagtcatcaccctgtatgagatcaactacaaggctgtgggcagcctggaccccagcgctgacctgagcagccagaggggcaaggtgttcaagctgagaaatgagacccaccacctgtttgtgggcctgtacccaggcaccacctacagcttcaccatcaaggccagcacagccaagggcttcggcccccctgtgaccacccgcatcgccaccaagatcagcgcccccagcatgccagaatatgacacagacacccccctgaatgaaacagacaccaccatcaccgtgatgctgaagccagcccagagcagaggagcccctgtgtctgtgtaccagctggtggtgaaggaggagcggctgcagaagagcagaagagctgctgacatcatcgagtgcttctctgtgcctgtgtcctacagaaatgccagcagcctggacagcctgcactactttgctgctgagctgaagccagccaacctgcctgtgacccagcccttcaccgtgggggacaacaagacctacaacggctactggaacccccccctgagccccctgaagagctacagcatctacttccaggccctgagcaaggccaacggggagaccaagatcaactgtgtgcggctggccaccaagggggccagcacccagaacagcaacacagtggagcctgagaagcaggtggacaacacagtgaagatggccggcgtgattgctggcctgctgatgttcatcatcatcctgctgggcgtgatgctgaccatcaagaggaggaagctggccaagaagcagaaggagacccagagcggggcccagcgggagatgggccctgtggccagcgctgacaagcccaccaccaagctgagcgccagcagaaatgatgagggcttcagcagcagcagccaggatgtgaatggcttcacagatggcagcagaggagagctgagccagcccaccctgaccatccagacccacccctaccgcacctgtgaccctgtggagatgagctacccccgggaccagttccagcctgccatccgggtggccgacctgctgcagcacatcacccagatgaagaggggccagggctacggcttcaaggaggagtatgaggccctgcctgagggccagacagcctcctgggacacagccaaggaggatgaaaatagaaacaagaacagatatggcaacatcatctcctatgaccacagccgggtgcggctgctggtgctggatggagacccccacagcgactacatcaatgccaactacattgatggctaccaccggcccaggcactacatcgccacccagggccccatgcaggagaccgtgaaggacttctggaggatgatctggcaggagaacagcgccagcatcgtgatggtgaccaacctggtggaggtgggccgccaccctgctgagcacacagtgggcaatgccaccctgggccgggccgccagccctggcatggtgaagtgtgtgcgctactggccagatgacacagaggtgtatggagacatcaaggtgaccctcatcgagacagagcccctggccgagtatgtgatccgcaccttcaccgtgcagaagaagggctaccacgagatccgggagctgcggctcttccacttcacctcctggccagaccatggagtgccctgctacgccaccggcctgctgggctttgtgcggcaggtgaagttcctgaaccccccagaggccggccccatcgtggtgcactgcagcgctggggccggccgcacaggctgcttcatcgccatcgacaccatgctggacatggctgaaaatgaaggagtggtggacatcttcaactgtgtgcgggagctgcgggcccagagggtgaacctggtgcagacagaggagcagtatgtgtttgtgcatgatgccatcctggaggcctgcctgtgtggcaacacagccatccctgtgtgtgagttccgcagcctgtactacaacatcagccggctggacccccagaccaacagcagccagatcaaggatgagttccagaccctgaacatcgtgaccccccgggtgcggcctgaggactgcagcatcggcctgctgcccagaaatcatgacaagaacagatccatggatgtgctgcccctggaccgctgcctgcccttcctgatctctgtggatggagagagcagcaactacatcaatgctgccctgatggacagccacaagcagcctgctgcctttgtggtgacccagcaccccctgcccaacacagtggccgacttctggaggctggtgtttgactacaactgcagctctgtggtgatgctgaatgagatggacacagcccagttctgcatgcagtactggccagagaagaccagcggctgctacggccccatccaggtggagtttgtgtctgctgacattgatgaggacatcatccaccgcatcttccgcatctgcaacatggcccggccccaggacggctacagaattgtgcagcacctgcagtacatcggctggccagcctacagagacaccccacccagcaagaggagcctgctgaaggtggtgcggcggctggagaagtggcaggagcagtatgatggccgggagggccgcacagtggtgcactgcctgaatggaggcggccgcagcggcaccttctgtgccatctgcagcgtgtgtgagatgatccagcagcagaacatcattgatgtgttccacatcgtgaagaccctgaggaacaacaagagcaacatggtggagaccctggagcagtacaagtttgtgtatgaggtggccctggagtacctgagcagcttctag

SEQ ID NO: 37228 - DNA, 4326 bp, Artificial Sequence
  Description of Artificial Sequence: Synthetic coding sequence
atggccagcctggccgccctggccctgagcctgctgctgcggctgcagctgccccccctgcccggggcccgggcccagagcgctgctgggggctgcagctttgatgagcactacagcaactgtggctacagcgtggccctgggcaccaacggcttcacctgggagcagatcaacacctgggagaagcccatgctggaccaggccgtgcccaccggcagcttcatgatggtgaacagcagcggccgggccagcggccagaaggcccacctgctgctgcccaccctgaaggaaaatgacacccactgcatcgacttccactactacttcagcagccgggacaggagcagccctggggccctgaatgtgtatgtgaaggtgaatggaggcccccagggcaaccctgtgtggaatgtgtctggagtggtgacagagggctgggtgaaggccgagctggccatcagcaccttctggccccacttctaccaggtgatctttgaatctgtgtccctgaagggccaccctggctacatcgctgtggatgaggtgcgggtgctggcccacccctgcaggaaggccccccacttcctgcggctgcagaatgtggaggtgaatgtgggccagaatgccaccttccagtgcatcgccggcggcaagtggagccagcacgacaagctgtggctgcagcagtggaatggccgggacacagccctgatggtgaccagggtggtgaaccaccggcgcttcagcgccaccgtgtctgtggccgacacagcccagaggtctgtgtccaagtaccgctgtgtgatccgcagtgatggcggcagcggcgtgagcaactatgcagagctgattgtgaaggagccccccacccccatcgcccctcctgagctgctggccgtgggcgccacctacctgtggatcaagcccaatgccaacagcatcattggagatggccccatcatcctgaaggaggtggagtaccgcaccaccaccggcacctgggccgagacccacatcgtggacagccccaactacaagctgtggcacctggaccctgatgtggagtatgagatccgggtgctgctgaccaggcctggagagggcggcaccggccccccaggcccccccctgaccaccaggaccaagtgtgccgaccctgtgcacggcccccagaatgtggagatcgtggacatccgggcccggcagctgaccctgcagtgggagcccttcggctatgctgtgacccgctgccacagctacaacctgactgtgcagtaccagtatgtgttcaaccagcagcagtatgaagctgaggaggtgatccagaccagcagccactacaccctgcggggcctgcggcccttcatgaccatccggctgcggctgctgctgagcaaccctgagggccgcatggagagcgaggagctggtggtgcagacagaggaggatgtgcctggagctgtgcccctggagagcatccagggcggcccctttgaggagaagatctacatccagtggaagcccccaaatgagaccaatggagtcatcaccctgtatgagatcaactacaaggctgtgggcagcctggaccccagcgctgacctgagcagccagaggggcaaggtgttcaagctgagaaatgagacccaccacctgtttgtgggcctgtacccaggcaccacctacagcttcaccatcaaggccagcacagccaagggcttcggcccccctgtgaccacccgcatcgccaccaagatcagcgcccccagcatgccagaatatgacacagacacccccctgaatgaaacagacaccaccatcaccgtgatgctgaagccagcccagagcagaggagcccctgtgtctgtgtaccagctggtggtgaaggaggagcggctgcagaagagcagaagagctgctgacatcatcgagtgcttctctgtgcctgtgtcctacagaaatgccagcagcctggacagcctgcactactttgctgctgagctgaagccagccaacctgcctgtgacccagcccttcaccgtgggggacaacaagacctacaacggctactggaacccccccctgagccccctgaagagctacagcatctacttccaggccctgagcaaggccaacggggagaccaagatcaactgtgtgcggctggccaccaagggggccagcacccagaacagcaacacagtggagcctgagaagcaggtggacaacacagtgaagatggccggcgtgattgctggcctgctgatgttcatcatcatcctgctgggcgtgatgctgaccatcaagagaagaagaaatgcctacagctacagctactacctgaagctggccaagaagcagaaggagacccagagcggggcccagcgggagatgggccctgtggccagcgctgacaagcccaccaccaagctgagcgccagcagaaatgatgagggcttcagcagcagcagccaggatgtgaatggcttcacagatggcagcagaggagagctgagccagcccaccctgaccatccagacccacccctaccgcacctgtgaccctgtggagatgagctacccccgggaccagttccagcctgccatccgggtggccgacctgctgcagcacatcacccagatgaagaggggccagggctacggcttcaaggaggagtatgaggccctgcctgagggccagacagcctcctgggacacagccaaggaggatgaaaatagaaacaagaacagatatggcaacatcatctcctatgaccacagccgggtgcggctgctggtgctggatggagacccccacagcgactacatcaatgccaactacattgatggctaccaccggcccaggcactacatcgccacccagggccccatgcaggagaccgtgaaggacttctggaggatgatctggcaggagaacagcgccagcatcgtgatggtgaccaacctggtggaggtgggccgggtgaagtgtgtgcgctactggccagatgacacagaggtgtatggagacatcaaggtgaccctcatcgagacagagcccctggccgagtatgtgatccgcaccttcaccgtgcagaagaagggctaccacgagatccgggagctgcggctcttccacttcacctcctggccagaccatggagtgccctgctacgccaccggcctgctgggctttgtgcggcaggtgaagttcctgaaccccccagaggccggccccatcgtggtgcactgcagcgctggggccggccgcacaggctgcttcatcgccatcgacaccatgctggacatggctgaaaatgaaggagtggtggacatcttcaactgtgtgcgggagctgcgggcccagagggtgaacctggtgcagacagaggagcagtatgtgtttgtgcatgatgccatcctggaggcctgcctgtgtggcaacacagccatccctgtgtgtgagttccgcagcctgtactacaacatcagccggctggacccccagaccaacagcagccagatcaaggatgagttccagaccctgaacatcgtgaccccccgggtgcggcctgaggactgcagcatcggcctgctgcccagaaatcatgacaagaacagatccatggatgtgctgcccctggaccgctgcctgcccttcctgatctctgtggatggagagagcagcaactacatcaatgctgccctgatggacagccacaagcagcctgctgcctttgtggtgacccagcaccccctgcccaacacagtggccgacttctggaggctggtgtttgactacaactgcagctctgtggtgatgctgaatgagatggacacagcccagttctgcatgcagtactggccagagaagaccagcggctgctacggccccatccaggtggagtttgtgtctgctgacattgatgaggacatcatccaccgcatcttccgcatctgcaacatggcccggccccaggacggctacagaattgtgcagcacctgcagtacatcggctggccagcctacagagacaccccacccagcaagaggagcctgctgaaggtggtgcggcggctggagaagtggcaggagcagtatgatggccgggagggccgcacagtggtgcactgcctgaatggaggcggccgcagcggcaccttctgtgccatctgcagcgtgtgtgagatgatccagcagcagaacatcattgatgtgttccacatcgtgaagaccctgaggaacaacaagagcaacatggtggagaccctggagcagtacaagtttgtgtatgaggtggccctggagtacctgagcagcttctag

SEQ ID NO: 37229 - DNA, 4323 bp, Artificial Sequence
  Description of Artificial Sequence: Synthetic coding sequence
atggccagcctggccgccctggccctgagcctgctgctgcggctgcagctgccccccctgcccggggcccgggcccagagcgctgctgggggctgcagctttgatgagcactacagcaactgtggctacagcgtggccctgggcaccaacggcttcacctgggagcagatcaacacctgggagaagcccatgctggaccaggccgtgcccaccggcagcttcatgatggtgaacagcagcggccgggccagcggccagaaggcccacctgctgctgcccaccctgaaggaaaatgacacccactgcatcgacttccactactacttcagcagccgggacaggagcagccctggggccctgaatgtgtatgtgaaggtgaatggaggcccccagggcaaccctgtgtggaatgtgtctggagtggtgacagagggctgggtgaaggccgagctggccatcagcaccttctggccccacttctaccaggtgatctttgaatctgtgtccctgaagggccaccctggctacatcgctgtggatgaggtgcgggtgctggcccacccctgcaggaaggccccccacttcctgcggctgcagaatgtggaggtgaatgtgggccagaatgccaccttccagtgcatcgccggcggcaagtggagccagcacgacaagctgtggctgcagcagtggaatggccgggacacagccctgatggtgaccagggtggtgaaccaccggcgcttcagcgccaccgtgtctgtggccgacacagcccagaggtctgtgtccaagtaccgctgtgtgatccgcagtgatggcggcagcggcgtgagcaactatgcagagctgattgtgaaggagccccccacccccatcgcccctcctgagctgctggccgtgggcgccacctacctgtggatcaagcccaatgccaacagcatcattggagatggccccatcatcctgaaggaggtggagtaccgcaccaccaccggcacctgggccgagacccacatcgtggacagccccaactacaagctgtggcacctggaccctgatgtggagtatgagatccgggtgctgctgaccaggcctggagagggcggcaccggccccccaggcccccccctgaccaccaggaccaagtgtgccgaccctgtgcacggcccccagaatgtggagatcgtggacatccgggcccggcagctgaccctgcagtgggagcccttcggctatgctgtgacccgctgccacagctacaacctgactgtgcagtaccagtatgtgttcaaccagcagcagtatgaagctgaggaggtgatccagaccagcagccactacaccctgcggggcctgcggcccttcatgaccatccggctgcggctgctgctgagcaaccctgagggccgcatggagagcgaggagctggtggtgcagacagaggaggatgtgcctggagctgtgcccctggagagcatccagggcggcccctttgaggagaagatctacatccagtggaagcccccaaatgagaccaatggagtcatcaccctgtatgagatcaactacaaggctgtgggcagcctggaccccagcgctgacctgagcagccagaggggcaaggtgttcaagctgagaaatgagacccaccacctgtttgtgggcctgtacccaggcaccacctacagcttcaccatcaaggccagcacagccaagggcttcggcccccctgtgaccacccgcatcgccaccaagatcagcgcccccagcatgccagaatatgacacagacacccccctgaatgaaacagacaccaccatcaccgtgatgctgaagccagcccagagcagaggagcccctgtgtctgtgtaccagctggtggtgaaggaggagcggctgcagaagagcagaagagctgctgacatcatcgagtgcttctctgtgcctgtgtcctacagaaatgccagcagcctggacagcctgcactactttgctgctgagctgaagccagccaacctgcctgtgacccagcccttcaccgtgggggacaacaagacctacaacggctactggaacccccccctgagccccctgaagagctacagcatctacttccaggccctgagcaaggccaacggggagaccaagatcaactgtgtgcggctggccaccaagggggccagcacccagaacagcaacacagtggagcctgagaagcaggtggacaacacagtgaagatggccggcgtgattgctggcctgctgatgttcatcatcatcctgctgggcgtgatgctgaccatcaagagaagaagaaatgcctacagctacagctactacctgaagctggccaagaagcagaaggagacccagagcggggcccagcgggagatgggccctgtggccagcgctgacaagcccaccaccaagctgagcgccagcagaaatgatgagggcttcagcagcagcagccaggatgtgaatggcttcaacggcagcagaggagagctgagccagcccaccctgaccatccagacccacccctaccgcacctgtgaccctgtggagatgagctacccccgggaccagttccagcctgccatccgggtggccgacctgctgcagcacatcacccagatgaagaggggccagggctacggcttcaaggaggagtatgaggccctgcctgagggccagacagcctcctgggacacagccaaggaggatgagaacagaaacaagaacagatatggcaacatcatctcctatgaccacagccgggtgcggctgctggtgctggatggagacccccacagcgactacatcaatgccaactacattgatggctaccaccggcccaggcactacatcgccacccagggccccatgcaggagaccgtgaaggacttctggaggatgatctggcaggagaacagcgccagcatcgtgatggtgaccaacctggtggaggtgggccgggtgaagtgtgtgcgctactggccagatgacacagaggtgtatggagacatcaaggtgaccctgattgaaacagagcccctggccgagtatgtgatccgcaccttcaccgtgcagaagaagggctaccacgagatccgggagctgcggctcttccacttcacctcctggccagaccacggcgtgccctgctacgccaccggcctgctgggctttgtgcggcaggtgaagttcctgaaccccccagaggccggccccatcgtggtgcactgcagcgctggagctggccgcacaggctgcttcatcgccatcgacaccatgctggacatggccgagaatgaaggagtggtggacatcttcaactgtgtgcgggagctgcgggcccagagggtgaacctggtgcagacagaggagcagtatgtgtttgtgcatgatgccatcctggaggcctgcctgtgtggcaacacagccatccctgtgtgtgagttccgcagcctgtactacaacatcagccggctggacccccagaccaacagcagccagatcaaggatgagttccagaccctgaacatcgtgaccccccgggtgcggcctgaggactgcagcatcggcctgctgcccaggaaccacgacaagaacagatccatggatgtgctgcccctggaccgctgcctgcccttcctgatctctgtggatggagagagcagcaactacatcaatgctgccctgatggacagccacaagcagcctgctgcctttgtggtgacccagcaccccctgcccaacacagtggccgacttctggaggctggtgtttgactacaactgcagctctgtggtgatgctgaatgagatggacacagcccagttctgcatgcagtactggccagagaagaccagcggctgctacggccccatccaggtggagtttgtgtctgctgacattgatgaggacatcatccaccgcatcttccgcatctgcaacatggcccggccccaggacggctaccgcatcgtgcagcacctgcagtacatcggctggccagcctacagagacaccccacccagcaagaggagcctgctgaaggtggtgcggcggctggagaagtggcaggagcagtatgatggccgggagggccgcacagtggtgcactgcctgaatggaggcggccgcagcggcaccttctgtgccatctgcagcgtgtgtgagatgatccagcagcagaacatcattgatgtgttccacatcgtgaagaccctgaggaacaacaagagcaacatggtggagaccctggagcagtacaagtttgtgtatgaggtggccctggagtacctgagcagcttctag

SEQ ID NO: 37230 - DNA, 4335 bp, Artificial Sequence
  Description of Artificial Sequence: Synthetic coding sequence
atggccagcctggccgccctggccctgagcctgctgctgcggctgcagctgccccccctgcccggggcccgggcccagagcgctgctgggggctgcagctttgatgagcactacagcaactgtggctacagcgtggccctgggcaccaacggcttcacctgggagcagatcaacacctgggagaagcccatgctggaccaggccgtgcccaccggcagcttcatgatggtgaacagcagcggccgggccagcggccagaaggcccacctgctgctgcccaccctgaaggaaaatgacacccactgcatcgacttccactactacttcagcagccgggacaggagcagccctggggccctgaatgtgtatgtgaaggtgaatggaggcccccagggcaaccctgtgtggaatgtgtctggagtggtgacagagggctgggtgaaggccgagctggccatcagcaccttctggccccacttctaccaggtgatctttgaatctgtgtccctgaagggccaccctggctacatcgctgtggatgaggtgcgggtgctggcccacccctgcaggaaggccccccacttcctgcggctgcagaatgtggaggtgaatgtgggccagaatgccaccttccagtgcatcgccggcggcaagtggagccagcacgacaagctgtggctgcagcagtggaatggccgggacacagccctgatggtgaccagggtggtgaaccaccggcgcttcagcgccaccgtgtctgtggccgacacagcccagaggtctgtgtccaagtaccgctgtgtgatccgcagtgatggcggcagcggcgtgagcaactatgcagagctgattgtgaaggagccccccacccccatcgcccctcctgagctgctggccgtgggcgccacctacctgtggatcaagcccaatgccaacagcatcattggagatggccccatcatcctgaaggaggtggagtaccgcaccaccaccggcacctgggccgagacccacatcgtggacagccccaactacaagctgtggcacctggaccctgatgtggagtatgagatccgggtgctgctgaccaggcctggagagggcggcaccggccccccaggcccccccctgaccaccaggaccaagtgtgccgaccctgtgcacggcccccagaatgtggagatcgtggacatccgggcccggcagctgaccctgcagtgggagcccttcggctatgctgtgacccgctgccacagctacaacctgactgtgcagtaccagtatgtgttcaaccagcagcagtatgaagctgaggaggtgatccagaccagcagccactacaccctgcggggcctgcggcccttcatgaccatccggctgcggctgctgctgagcaaccctgagggccgcatggagagcgaggagctggtggtgcagacagaggaggatgtgcctggagctgtgcccctggagagcatccagggcggcccctttgaggagaagatctacatccagtggaagcccccaaatgagaccaatggagtcatcaccctgtatgagatcaactacaaggctgtgggcagcctggaccccagcgctgacctgagcagccagaggggcaaggtgttcaagctgagaaatgagacccaccacctgtttgtgggcctgtacccaggcaccacctacagcttcaccatcaaggccagcacagccaagggcttcggcccccctgtgaccacccgcatcgccaccaagatcagcgcccccagcatgccagaatatgacacagacacccccctgaatgaaacagacaccaccatcaccgtgatgctgaagccagcccagagcagaggagcccctgtgtctgtgtaccagctggtggtgaaggaggagcggctgcagaagagcagaagagctgctgacatcatcgagtgcttctctgtgcctgtgtcctacagaaatgccagcagcctggacagcctgcactactttgctgctgagctgaagccagccaacctgcctgtgacccagcccttcaccgtgggggacaacaagacctacaacggctactggaacccccccctgagccccctgaagagctacagcatctacttccaggccctgagcaaggccaacggggagaccaagatcaactgtgtgcggctggccaccaagggggccagcacccagaacagcaacacagtggagcctgagaagcaggtggacaacacagtgaagatggccggcgtgattgctggcctgctgatgttcatcatcatcctgctgggcgtgatgctgaccatcaagagaagaagaaatgcctacagctacagctactacctgagccagaggaagctggccaagaagcagaaggagacccagagcggggcccagcgggagatgggccctgtggccagcgctgacaagcccaccaccaagctgagcgccagcagaaatgatgagggcttcagcagcagcagccaggatgtgaatggcttcacagatggcagcagaggagagctgagccagcccaccctgaccatccagacccacccctaccgcacctgtgaccctgtggagatgagctacccccgggaccagttccagcctgccatccgggtggccgacctgctgcagcacatcacccagatgaagaggggccagggctacggcttcaaggaggagtatgaggccctgcctgagggccagacagcctcctgggacacagccaaggaggatgagaacagaaacaagaacagatatggcaacatcatctcctatgaccacagccgggtgcggctgctggtgctggatggagacccccacagcgactacatcaatgccaactacattgatggctaccaccggcccaggcactacatcgccacccagggccccatgcaggagaccgtgaaggacttctggaggatgatctggcaggagaacagcgccagcatcgtgatggtgaccaacctggtggaggtgggccgggtgaagtgtgtgcgctactggccagatgacacagaggtgtatggagacatcaaggtgaccctgattgaaacagagcccctggccgagtatgtgatccgcaccttcaccgtgcagaagaagggctaccacgagatccgggagctgcggctcttccacttcacctcctggccagaccacggcgtgccctgctacgccaccggcctgctgggctttgtgcggcaggtgaagttcctgaaccccccagaggccggccccatcgtggtgcactgcagcgctggagctggccgcacaggctgcttcatcgccatcgacaccatgctggacatggccgagaatgaaggagtggtggacatcttcaactgtgtgcgggagctgcgggcccagagggtgaacctggtgcagacagaggagcagtatgtgtttgtgcatgatgccatcctggaggcctgcctgtgtggcaacacagccatccctgtgtgtgagttccgcagcctgtactacaacatcagccggctggacccccagaccaacagcagccagatcaaggatgagttccagaccctgaacatcgtgaccccccgggtgcggcctgaggactgcagcatcggcctgctgcccaggaaccacgacaagaacagatccatggatgtgctgcccctggaccgctgcctgcccttcctgatctctgtggatggagagagcagcaactacatcaatgctgccctgatggacagccacaagcagcctgctgcctttgtggtgacccagcaccccctgcccaacacagtggccgacttctggaggctggtgtttgactacaactgcagctctgtggtgatgctgaatgagatggacacagcccagttctgcatgcagtactggccagagaagaccagcggctgctacggccccatccaggtggagtttgtgtctgctgacattgatgaggacatcatccaccgcatcttccgcatctgcaacatggcccggccccaggacggctaccgcatcgtgcagcacctgcagtacatcggctggccagcctacagagacaccccacccagcaagaggagcctgctgaaggtggtgcggcggctggagaagtggcaggagcagtatgatggccgggagggccgcacagtggtgcactgcctgaatggaggcggccgcagcggcaccttctgtgccatctgcagcgtgtgtgagatgatccagcagcagaacatcattgatgtgttccacatcgtgaagaccctgaggaacaacaagagcaacatggtggagaccctggagcagtacaagtttgtgtatgaggtggccctggagtacctgagcagcttctag

SEQ ID NO: 37231 - DNA, 4392 bp, Artificial Sequence
  Description of Artificial Sequence: Synthetic coding sequence
atggccagcctggccgccctggccctgagcctgctgctgcggctgcagctgccccccctgcccggggcccgggcccagagcgctgctgggggctgcagctttgatgagcactacagcaactgtggctacagcgtggccctgggcaccaacggcttcacctgggagcagatcaacacctgggagaagcccatgctggaccaggccgtgcccaccggcagcttcatgatggtgaacagcagcggccgggccagcggccagaaggcccacctgctgctgcccaccctgaaggaaaatgacacccactgcatcgacttccactactacttcagcagccgggacaggagcagccctggggccctgaatgtgtatgtgaaggtgaatggaggcccccagggcaaccctgtgtggaatgtgtctggagtggtgacagagggctgggtgaaggccgagctggccatcagcaccttctggccccacttctaccaggtgatctttgaatctgtgtccctgaagggccaccctggctacatcgctgtggatgaggtgcgggtgctggcccacccctgcaggaaggccccccacttcctgcggctgcagaatgtggaggtgaatgtgggccagaatgccaccttccagtgcatcgccggcggcaagtggagccagcacgacaagctgtggctgcagcagtggaatggccgggacacagccctgatggtgaccagggtggtgaaccaccggcgcttcagcgccaccgtgtctgtggccgacacagcccagaggtctgtgtccaagtaccgctgtgtgatccgcagtgatggcggcagcggcgtgagcaactatgcagagctgattgtgaaggagccccccacccccatcgcccctcctgagctgctggccgtgggcgccacctacctgtggatcaagcccaatgccaacagcatcattggagatggccccatcatcctgaaggaggtggagtaccgcaccaccaccggcacctgggccgagacccacatcgtggacagccccaactacaagctgtggcacctggaccctgatgtggagtatgagatccgggtgctgctgaccaggcctggagagggcggcaccggccccccaggcccccccctgaccaccaggaccaagtgtgccgaccctgtgcacggcccccagaatgtggagatcgtggacatccgggcccggcagctgaccctgcagtgggagcccttcggctatgctgtgacccgctgccacagctacaacctgactgtgcagtaccagtatgtgttcaaccagcagcagtatgaagctgaggaggtgatccagaccagcagccactacaccctgcggggcctgcggcccttcatgaccatccggctgcggctgctgctgagcaaccctgagggccgcatggagagcgaggagctggtggtgcagacagaggaggatgtgcctggagctgtgcccctggagagcatccagggcggcccctttgaggagaagatctacatccagtggaagcccccaaatgagaccaatggagtcatcaccctgtatgagatcaactacaaggctgtgggcagcctggaccccagcgctgacctgagcagccagaggggcaaggtgttcaagctgagaaatgagacccaccacctgtttgtgggcctgtacccaggcaccacctacagcttcaccatcaaggccagcacagccaagggcttcggcccccctgtgaccacccgcatcgccaccaagatcagcgcccccagcatgccagaatatgacacagacacccccctgaatgaaacagacaccaccatcaccgtgatgctgaagccagcccagagcagaggagcccctgtgtctgtgtaccagctggtggtgaaggaggagcggctgcagaagagcagaagagctgctgacatcatcgagtgcttctctgtgcctgtgtcctacagaaatgccagcagcctggacagcctgcactactttgctgctgagctgaagccagccaacctgcctgtgacccagcccttcaccgtgggggacaacaagacctacaacggctactggaacccccccctgagccccctgaagagctacagcatctacttccaggccctgagcaaggccaacggggagaccaagatcaactgtgtgcggctggccaccaaggcccccatgggcagcgcccaggtgaccccaggcacccccctgtgcctgctgaccaccggggccagcacccagaacagcaacacagtggagcctgagaagcaggtggacaacacagtgaagatggccggcgtgattgctggcctgctgatgttcatcatcatcctgctgggcgtgatgctgaccatcaagagaagaagaaatgcctacagctacagctactacctgagccagaggaagctggccaagaagcagaaggagacccagagcggggcccagcgggagatgggccctgtggccagcgctgacaagcccaccaccaagctgagcgccagcagaaatgatgagggcttcagcagcagcagccaggatgtgaatggcttcacagatggcagcagaggagagctgagccagcccaccctgaccatccagacccacccctaccgcacctgtgaccctgtggagatgagctacccccgggaccagttccagcctgccatccgggtggccgacctgctgcagcacatcacccagatgaagaggggccagggctacggcttcaaggaggagtatgaggccctgcctgagggccagacagcctcctgggacacagccaaggaggatgaaaatagaaacaagaacagatatggcaacatcatctcctatgaccacagccgggtgcggctgctggtgctggatggagacccccacagcgactacatcaatgccaactacattgatggctaccaccggcccaggcactacatcgccacccagggccccatgcaggagaccgtgaaggacttctggaggatgatctggcaggagaacagcgccagcatcgtgatggtgaccaacctggtggaggtgggccgggtgaagtgtgtgcgctactggccagatgacacagaggtgtatggagacatcaaggtgaccctcatcgagacagagcccctggccgagtatgtgatccgcaccttcaccgtgcagaagaagggctaccacgagatccgggagctgcggctcttccacttcacctcctggccagaccatggagtgccctgctacgccaccggcctgctgggctttgtgcggcaggtgaagttcctgaaccccccagaggccggccccatcgtggtgcactgcagcgctggggccggccgcacaggctgcttcatcgccatcgacaccatgctggacatggctgaaaatgaaggagtggtggacatcttcaactgtgtgcgggagctgcgggcccagagggtgaacctggtgcagacagaggagcagtatgtgtttgtgcatgatgccatcctggaggcctgcctgtgtggcaacacagccatccctgtgtgtgagttccgcagcctgtactacaacatcagccggctggacccccagaccaacagcagccagatcaaggatgagttccagaccctgaacatcgtgaccccccgggtgcggcctgaggactgcagcatcggcctgctgcccagaaatcatgacaagaacagatccatggatgtgctgcccctggaccgctgcctgcccttcctgatctctgtggatggagagagcagcaactacatcaatgctgccctgatggacagccacaagcagcctgctgcctttgtggtgacccagcaccccctgcccaacacagtggccgacttctggaggctggtgtttgactacaactgcagctctgtggtgatgctgaatgagatggacacagcccagttctgcatgcagtactggccagagaagaccagcggctgctacggccccatccaggtggagtttgtgtctgctgacattgatgaggacatcatccaccgcatcttccgcatctgcaacatggcccggccccaggacggctacagaattgtgcagcacctgcagtacatcggctggccagcctacagagacaccccacccagcaagaggagcctgctgaaggtggtgcggcggctggagaagtggcaggagcagtatgatggccgggagggccgcacagtggtgcactgcctgaatggaggcggccgcagcggcaccttctgtgccatctgcagcgtgtgtgagatgatccagcagcagaacatcattgatgtgttccacatcgtgaagaccctgaggaacaacaagagcaacatggtggagaccctggagcagtacaagtttgtgtatgaggtggccctggagtacctgagcagcttctag

SEQ ID NO: 37232 - DNA, 4296 bp, Artificial Sequence
  Description of Artificial Sequence: Synthetic coding sequence
atggccagcctggccgccctggccctgagcctgctgctgcggctgcagctgccccccctgcccggggcccgggcccagagcgctgctgggggctgcagctttgatgagcactacagcaactgtggctacagcgtggccctgggcaccaacggcttcacctgggagcagatcaacacctgggagaagcccatgctggaccaggccgtgcccaccggcagcttcatgatggtgaacagcagcggccgggccagcggccagaaggcccacctgctgctgcccaccctgaaggaaaatgacacccactgcatcgacttccactactacttcagcagccgggacaggagcagccctggggccctgaatgtgtatgtgaaggtgaatggaggcccccagggcaaccctgtgtggaatgtgtctggagtggtgacagagggctgggtgaaggccgagctggccatcagcaccttctggccccacttctaccaggtgatctttgaatctgtgtccctgaagggccaccctggctacatcgctgtggatgaggtgcgggtgctggcccacccctgcaggaaggccccccacttcctgcggctgcagaatgtggaggtgaatgtgggccagaatgccaccttccagtgcatcgccggcggcaagtggagccagcacgacaagctgtggctgcagcagtggaatggccgggacacagccctgatggtgaccagggtggtgaaccaccggcgcttcagcgccaccgtgtctgtggccgacacagcccagaggtctgtgtccaagtaccgctgtgtgatccgcagtgatggcggcagcggcgtgagcaactatgcagagctgattgtgaaggagccccccacccccatcgcccctcctgagctgctggccgtgggcgccacctacctgtggatcaagcccaatgccaacagcatcattggagatggccccatcatcctgaaggaggtggagtaccgcaccaccaccggcacctgggccgagacccacatcgtggacagccccaactacaagctgtggcacctggaccctgatgtggagtatgagatccgggtgctgctgaccaggcctggagagggcggcaccggccccccaggcccccccctgaccaccaggaccaagtgtgccgaccctgtgcacggcccccagaatgtggagatcgtggacatccgggcccggcagctgaccctgcagtgggagcccttcggctatgctgtgacccgctgccacagctacaacctgactgtgcagtaccagtatgtgttcaaccagcagcagtatgaagctgaggaggtgatccagaccagcagccactacaccctgcggggcctgcggcccttcatgaccatccggctgcggctgctgctgagcaaccctgagggccgcatggagagcgaggagctggtggtgcagacagaggaggatgtgcctggagctgtgcccctggagagcatccagggcggcccctttgaggagaagatctacatccagtggaagcccccaaatgagaccaatggagtcatcaccctgtatgagatcaactacaaggctgtgggcagcctggaccccagcgctgacctgagcagccagaggggcaaggtgttcaagctgagaaatgagacccaccacctgtttgtgggcctgtacccaggcaccacctacagcttcaccatcaaggccagcacagccaagggcttcggcccccctgtgaccacccgcatcgccaccaagatcagcgcccccagcatgccagaatatgacacagacacccccctgaatgaaacagacaccaccatcaccgtgatgctgaagccagcccagagcagaggagcccctgtgtctgtgtaccagctggtggtgaaggaggagcggctgcagaagagcagaagagctgctgacatcatcgagtgcttctctgtgcctgtgtcctacagaaatgccagcagcctggacagcctgcactactttgctgctgagctgaagccagccaacctgcctgtgacccagcccttcaccgtgggggacaacaagacctacaacggctactggaacccccccctgagccccctgaagagctacagcatctacttccaggccctgagcaaggccaacggggagaccaagatcaactgtgtgcggctggccaccaagggggccagcacccagaacagcaacacagtggagcctgagaagcaggtggacaacacagtgaagatggccggcgtgattgctggcctgctgatgttcatcatcatcctgctgggcgtgatgctgaccatcaagaggaggaagctggccaagaagcagaaggagacccagagcggggcccagcgggagatgggccctgtggccagcgctgacaagcccaccaccaagctgagcgccagcagaaatgatgagggcttcagcagcagcagccaggatgtgaatggcttcacagatggcagcagaggagagctgagccagcccaccctgaccatccagacccacccctaccgcacctgtgaccctgtggagatgagctacccccgggaccagttccagcctgccatccgggtggccgacctgctgcagcacatcacccagatgaagaggggccagggctacggcttcaaggaggagtatgaggccctgcctgagggccagacagcctcctgggacacagccaaggaggatgaaaatagaaacaagaacagatatggcaacatcatctcctatgaccacagccgggtgcggctgctggtgctggatggagacccccacagcgactacatcaatgccaactacattgatggctaccaccggcccaggcactacatcgccacccagggccccatgcaggagaccgtgaaggacttctggaggatgatctggcaggagaacagcgccagcatcgtgatggtgaccaacctggtggaggtgggccgggtgaagtgtgtgcgctactggccagatgacacagaggtgtatggagacatcaaggtgaccctcatcgagacagagcccctggccgagtatgtgatccgcaccttcaccgtgcagaagaagggctaccacgagatccgggagctgcggctcttccacttcacctcctggccagaccatggagtgccctgctacgccaccggcctgctgggctttgtgcggcaggtgaagttcctgaaccccccagaggccggccccatcgtggtgcactgcagcgctggggccggccgcacaggctgcttcatcgccatcgacaccatgctggacatggctgaaaatgaaggagtggtggacatcttcaactgtgtgcgggagctgcgggcccagagggtgaacctggtgcagacagaggagcagtatgtgtttgtgcatgatgccatcctggaggcctgcctgtgtggcaacacagccatccctgtgtgtgagttccgcagcctgtactacaacatcagccggctggacccccagaccaacagcagccagatcaaggatgagttccagaccctgaacatcgtgaccccccgggtgcggcctgaggactgcagcatcggcctgctgcccagaaatcatgacaagaacagatccatggatgtgctgcccctggaccgctgcctgcccttcctgatctctgtggatggagagagcagcaactacatcaatgctgccctgatggacagccacaagcagcctgctgcctttgtggtgacccagcaccccctgcccaacacagtggccgacttctggaggctggtgtttgactacaactgcagctctgtggtgatgctgaatgagatggacacagcccagttctgcatgcagtactggccagagaagaccagcggctgctacggccccatccaggtggagtttgtgtctgctgacattgatgaggacatcatccaccgcatcttccgcatctgcaacatggcccggccccaggacggctacagaattgtgcagcacctgcagtacatcggctggccagcctacagagacaccccacccagcaagaggagcctgctgaaggtggtgcggcggctggagaagtggcaggagcagtatgatggccgggagggccgcacagtggtgcactgcctgaatggaggcggccgcagcggcaccttctgtgccatctgcagcgtgtgtgagatgatccagcagcagaacatcattgatgtgttccacatcgtgaagaccctgaggaacaacaagagcaacatggtggagaccctggagcagtacaagtttgtgtatgaggtggccctggagtacctgagcagcttctag

SEQ ID NO: 37233 - DNA, 765 bp, Artificial Sequence
  Description of Artificial Sequence: Synthetic coding sequence
atggctgctgtggccgccacagctgctgccaagggaaatggaggcggcggcggccgggccggggctggagatgccagcggcaccaggaagaagaagggccctggccccctggccacagcctacctggtgatctacaacgtggtgatgacagctggctggctggtgattgctgtgggcctggtgcgggcctacctggccaagggcagctaccacagcctgtactacagcattgagaagcccctgaagttcttccagacaggagccctgctggagatcctgcactgtgccatcggcatcgtgcccagctctgtggtgctgaccagcttccaggtgatgagcagggtcttcctgatctgggccgtgacccacagcgtgaaggaggtgcagagtgaagattctgtgctgctgtttgtgattgcctggaccatcacagagatcatccgctacagcttctacaccttcagcctgctgaaccacctgccctacctgatcaagtgggcccgctacaccctcttcatcgtgctgtaccccatgggcgtgtctggagagctgctgaccatctatgctgccctgccctttgtgcggcaggccggcctgtacagcatcagcctgcccaacaagtacaacttctcctttgactactatgccttcctgatcctgatcatgatctcctacatccccatcttcccccagctgtacttccacatgatccaccagaggaggaagatcctgagccacacagaggagcacaagaagtttgaatag

SEQ ID NO: 37234 - DNA, 1089 bp, Artificial Sequence
  Description of Artificial Sequence: Synthetic coding sequence
atggagaaccaggtgctgacccctcatgtgtactgggcccagaggcaccgggagctgtacctgcgggtggagctgagtgatgtgcagaacccagccatcagcatcacagaaaatgtgctgcacttcaaggcccagggccatggagccaagggggacaacgtgtatgagttccacctggagttcctggacctggtgaagccagagcctgtgtacaagctgacccagaggcaggtgaacatcaccgtgcagaagaaggtgtcccagtggtgggagcggctgaccaagcaggagaagaggcccctcttcctggccccagactttgaccgctggctggatgaaagtgatgctgagatggagctgcgggccaaggaggaggagcggctgaacaagctgcggctggagagcgagggcagccctgagaccctgaccaacctgaggaagggctacctgttcatgtacaacctggtgcagttcctgggcttctcctggatctttgtgaacctgactgtgcgcttctgcatcctgggcaaggagagcttctatgacaccttccacacagtggccgacatgatgtacttctgccagatgctggccgtggtggagaccatcaatgctgccatcggcgtgaccaccagccctgtgctgcccagcctcatccagctgctgggcaggaacttcatcctcttcatcatcttcggcaccatggaggagatgcagaacaaggctgtggtgttctttgtgttctacctgtggagcgccatcgagatcttccgctacagcttctacatgctgacctgcatcgacatggactggaaggtgctgacctggctgcgctacaccctgtggatccccctgtaccccctgggctgcctggccgaggccgtgtctgtcatccagagcatccccatcttcaatgaaacaggccgcttctccttcaccctgccctaccctgtgaagatcaaggtgcgcttctccttcttcctgcagatctacctgatcatgatcttcctgggcctgtacatcaacttccgccacctgtacaagcagaggagaagaagatatggccagaagaagaagaagatccactag

SEQ ID NO: 37235 - DNA, 699 bp, Artificial Sequence
  Description of Artificial Sequence: Synthetic coding sequence
atgggccccctggccctgcctgcctggctgcagccccgctacaggaagaatgcctacctgttcatctactacctgatccagttctgtggccacagctggatcttcaccaacatgacagtgcgcttcttctcctttgggaaggacagcatggtggacaccttctacgccatcggcctggtgatgaggctgtgccagagcgtgtccctgctggagctgctgcacatctacgtgggcatcgagagcaaccacctgctgccccgcttcctgcagctgacagagcgcatcatcatcctgtttgtggtgatcaccagccaggaggaggtgcaggagaagtatgtggtgtgtgtgctgtttgtgttctggaacctgctggacatggtgcgctacacctacagcatgctgtctgtgattggcatctcctatgctgtgctgacctggctgagccagaccctgtggatgcccatctaccccctgtgtgtgctggccgaggcctttgccatctaccagagcctgccctactttgagagctttggcacctacagcaccaagctgccctttgacctgagcatctacttcccctacgtgctgaagatctacctgatgatgctgttcatcggcatgtacttcacctacagccacctgtacagcgagcggcgggacatcctgggcatcttccccatcaagaagaagaagatgtag

SEQ ID NO: 37236 - DNA, 699 bp, Artificial Sequence; identical to SEQ ID NO: 37235
  Description of Artificial Sequence: Synthetic coding sequence

SEQ ID NO: 37237 - DNA, 2397 bp, Artificial Sequence
  Description of Artificial Sequence: Synthetic coding sequence
atggagttctcctggggcagcggccaggagagccggcggctgctgctgctgctgctgctgctggccgcctgggaggccggaaatggccagctgcactacagcgtgtctgaggaggccaagcacggcacctttgtgggccgcatcgcccaggacctgggcctggagctggccgagctggtgcccaggctcttccgggtggccagcaagggccggggcggcctgctggaggtgaacctgcagaatggcatcctgtttgtgaacagcagaattgaccgggaggagctgtgcagaagatctgcagaatgttccatccacctggaggtgattgtggaccggcccctgcaggtgttccacgtggatgtggaggtgcgggacatcaatgacaacccccctgtgtttcctgccacccagaagaacctgagcattgctgagagccggcccctggacagccgcttccccctggagggcgccagtgatgctgacatcggggagaatgccctgctgacctaccgcctgagccccaatgagtacttcagcctggagaagcccccagatgatgagctggtgaagggcctgggcctcatcctgaggaagagcctggaccgggaggaggcccctgagatcttcctggtgctgacagccacagatggcggcaagccagagctgactggaacagtgcagctgctgatcaccgtgctggatgccaatgacaatgccccagcctttgacaggaccatctacaaggtgcggctgctggagaatgtgcccaacggcaccctggtgatcaagctgaatgccagtgacctggatgagggcctgaatggagacatcgtgtacagcttcagcaatgacatcagccccaacgtgaagagcaagttccacatcgaccccatcaccggccagatcatcgtgaagggctacatcgactttgaggagagcaagagctatgagatcatcgtggagggcatcgacaagggccagctgcccctgagcggccactgccgggtgattgtggaggtggaggacaacaatgacaacgtgcctgacctggagttcaagagcctgagcctgcccatcagagaagatgcccccctgggcaccgtgattgccctgatctctgtgtctgacaaggacatgggcgtgaatggcctggtgacctgcagcctgaccagccacgtgcccttcaagctggtgtccaccttcaagaactactacagcctggtgctggacagcgccctggaccgggagagcgtgtctgcctatgagctggtggtgacagccagagatggcggcagccccagcctgtgggccacagcctctgtgtctgtggaggtggctgatgtgaatgacaatgccccagcctttgcccagcctgagtacacagtgtttgtgaaggagaacaaccccccaggctgccacatcttcaccgtgtctgcctgggatgctgatgcccaggagaatgccctggtgtcctacagcctggtggagaggagagtgggggagcgggccctgagcagctatgtgtctgtgcacgccgagagcggcaaggtgtatgccctgcagcccctggaccacgaggagctggagctgctgcagttccaggtgacagccagagatgctggggtgccccccctgggcagcaatgtgaccctgcaggtgtttgtgctggatgaaaatgacaatgccccagccctgctggccccccgggccggcggcactggaggagctgtgtctgagctggtgccctggagcgtgggcgtgggccacgtggtggccaaggtgcgggctgtggatgctgacagcggctacaatgcctggctgtcctatgagctgcagcccggcactggaggagcccgcatccccttccgggtgggcctgtacaccggggagatcagcaccacccgggccctggatgaaacagatgcccccaggcaccggctgctggtgctggtgaaggaccacggggagcccgccctgacagccacagccaccgtgctggtgtccctggtggagagcggccaggcccccaaggccagcagccgggccctggtgggcgctgtgggcccagatgctgccctggtggatgtgaatgtgtacctgatcatcgccatctgtgctgtgagcagcctgctggtgctgaccctgctgctgtacacagccctgcgctgcagcgccctgcccacagagggcgcctgtgcccctgggaagcccaccctggtgtgcagcagcgctgtgggctcctggagctacagccagcagaggcggccccgggtgtgcagcggggagggcccccccaagacagacctgatggccttcagccccagcctgcctgacagccgggaccgggaggaccagctgcagaccacagaggagagctttgccaaggtgtctgtgtag

SEQ ID NO: 37238 - DNA, 2706 bp, Artificial Sequence
  Description of Artificial Sequence: Synthetic coding sequence
atggagttctcctggggcagcggccaggagagccggcggctgctgctgctgctgctgctgctggccgcctgggaggccggaaatggccagctgcactacagcgtgtctgaggaggccaagcacggcacctttgtgggccgcatcgcccaggacctgggcctggagctggccgagctggtgcccaggctcttccgggtggccagcaagggccggggcggcctgctggaggtgaacctgcagaatggcatcctgtttgtgaacagcagaattgaccgggaggagctgtgcagaagatctgcagaatgttccatccacctggaggtgattgtggaccggcccctgcaggtgttccacgtggatgtggaggtgcgggacatcaatgacaacccccctgtgtttcctgccacccagaagaacctgagcattgctgagagccggcccctggacagccgcttccccctggagggcgccagtgatgctgacatcggggagaatgccctgctgacctaccgcctgagccccaatgagtacttcagcctggagaagcccccagatgatgagctggtgaagggcctgggcctcatcctgaggaagagcctggaccgggaggaggcccctgagatcttcctggtgctgacagccacagatggcggcaagccagagctgactggaacagtgcagctgctgatcaccgtgctggatgccaatgacaatgccccagcctttgacaggaccatctacaaggtgcggctgctggagaatgtgcccaacggcaccctggtgatcaagctgaatgccagtgacctggatgagggcctgaatggagacatcgtgtacagcttcagcaatgacatcagccccaacgtgaagagcaagttccacatcgaccccatcaccggccagatcatcgtgaagggctacatcgactttgaggagagcaagagctatgagatcatcgtggagggcatcgacaagggccagctgcccctgagcggccactgccgggtgattgtggaggtggaggacaacaatgacaacgtgcctgacctggagttcaagagcctgagcctgcccatcagagaagatgcccccctgggcaccgtgattgccctgatctctgtgtctgacaaggacatgggcgtgaatggcctggtgacctgcagcctgaccagccacgtgcccttcaagctggtgtccaccttcaagaactactacagcctggtgctggacagcgccctggaccgggagagcgtgtctgcctatgagctggtggtgacagccagagatggcggcagccccagcctgtgggccacagcctctgtgtctgtggaggtggctgatgtgaatgacaatgccccagcctttgcccagcctgagtacacagtgtttgtgaaggagaacaaccccccaggctgccacatcttcaccgtgtctgcctgggatgctgatgcccaggagaatgccctggtgtcctacagcctggtggagaggagagtgggggagcgggccctgagcagctatgtgtctgtgcacgccgagagcggcaaggtgtatgccctgcagcccctggaccacgaggagctggagctgctgcagttccaggtgacagccagagatgctggggtgccccccctgggcagcaatgtgaccctgcaggtgtttgtgctggatgaaaatgacaatgccccagccctgctggccccccgggccggcggcactggaggagctgtgtctgagctggtgccctggagcgtgggcgtgggccacgtggtggccaaggtgcgggctgtggatgctgacagcggctacaatgcctggctgtcctatgagctgcagcccggcactggaggagcccgcatccccttccgggtgggcctgtacaccggggagatcagcaccacccgggccctggatgaaacagatgcccccaggcaccggctgctggtgctggtgaaggaccacggggagcccgccctgacagccacagccaccgtgctggtgtccctggtggagagcggccaggcccccaaggccagcagccgggccctggtgggcgctgtgggcccagatgctgccctggtggatgtgaatgtgtacctgatcatcgccatctgtgctgtgagcagcctgctggtgctgaccctgctgctgtacacagccctgcgctgcagcgccctgcccacagagggcgcctgtgcccctgggaagcccaccctggtgtgcagcagcgctgtgggctcctggagctacagccagcagaggcggccccgggtgtgcagcggggagggcccccccaagacagacctgatggccttcagccccagcctgcctgacagccgggaccgggaggaccagctgcagaccacagaggagagctttgccaagccccggcagcccaacccagactggagatacagcgccagcctgcgggccggcatgcacagctctgtgcacctggaggaggccggcatcctgcgggccggccctgggggccctgaccagcagtggcccaccgtgtcctctgccaccccagagcctgaggccggggaggtgtccccacctgtgggcgccggcgtgaacagcaacagctggaccttcaagtatggccctggcaaccccaagcagagcggccctgagcccaagaagcagacccaggtgtccttcctgctgcggaggaaaggagaggccagccagccccggcagtag

SEQ ID NO: 37239 - DNA, 2844 bp, Artificial Sequence
  Description of Artificial Sequence: Synthetic coding sequence
atggagttctcctggggcagcggccaggagagccggcggctgctgctgctgctgctgctgctggccgcctgggaggccggaaatggccagctgcactacagcgtgtctgaggaggccaagcacggcacctttgtgggccgcatcgcccaggacctgggcctggagctggccgagctggtgcccaggctcttccgggtggccagcaagggccggggcggcctgctggaggtgaacctgcagaatggcatcctgtttgtgaacagcagaattgaccgggaggagctgtgcagaagatctgcagaatgttccatccacctggaggtgattgtggaccggcccctgcaggtgttccacgtggatgtggaggtgcgggacatcaatgacaacccccctgtgtttcctgccacccagaagaacctgagcattgctgagagccggcccctggacagccgcttccccctggagggcgccagtgatgctgacatcggggagaatgccctgctgacctaccgcctgagccccaatgagtacttcagcctggagaagcccccagatgatgagctggtgaagggcctgggcctcatcctgaggaagagcctggaccgggaggaggcccctgagatcttcctggtgctgacagccacagatggcggcaagccagagctgactggaacagtgcagctgctgatcaccgtgctggatgccaatgacaatgccccagcctttgacaggaccatctacaaggtgcggctgctggagaatgtgcccaacggcaccctggtgatcaagctgaatgccagtgacctggatgagggcctgaatggagacatcgtgtacagcttcagcaatgacatcagccccaacgtgaagagcaagttccacatcgaccccatcaccggccagatcatcgtgaagggctacatcgactttgaggagagcaagagctatgagatcatcgtggagggcatcgacaagggccagctgcccctgagcggccactgccgggtgattgtggaggtggaggacaacaatgacaacgtgcctgacctggagttcaagagcctgagcctgcccatcagagaagatgcccccctgggcaccgtgattgccctgatctctgtgtctgacaaggacatgggcgtgaatggcctggtgacctgcagcctgaccagccacgtgcccttcaagctggtgtccaccttcaagaactactacagcctggtgctggacagcgccctggaccgggagagcgtgtctgcctatgagctggtggtgacagccagagatggcggcagccccagcctgtgggccacagcctctgtgtctgtggaggtggctgatgtgaatgacaatgccccagcctttgcccagcctgagtacacagtgtttgtgaaggagaacaaccccccaggctgccacatcttcaccgtgtctgcctgggatgctgatgcccaggagaatgccctggtgtcctacagcctggtggagaggagagtgggggagcgggccctgagcagctatgtgtctgtgcacgccgagagcggcaaggtgtatgccctgcagcccctggaccacgaggagctggagctgctgcagttccaggtgacagccagagatgctggggtgccccccctgggcagcaatgtgaccctgcaggtgtttgtgctggatgaaaatgacaatgccccagccctgctggccccccgggccggcggcactggaggagctgtgtctgagctggtgccctggagcgtgggcgtgggccacgtggtggccaaggtgcgggctgtggatgctgacagcggctacaatgcctggctgtcctatgagctgcagcccggcactggaggagcccgcatccccttccgggtgggcctgtacaccggggagatcagcaccacccgggccctggatgaaacagatgcccccaggcaccggctgctggtgctggtgaaggaccacggggagcccgccctgacagccacagccaccgtgctggtgtccctggtggagagcggccaggcccccaaggccagcagccgggccctggtgggcgctgtgggcccagatgctgccctggtggatgtgaatgtgtacctgatcatcgccatctgtgctgtgagcagcctgctggtgctgaccctgctgctgtacacagccctgcgctgcagcgccctgcccacagagggcgcctgtgcccctgggaagcccaccctggtgtgcagcagcgctgtgggctcctggagctacagccagcagaggcggccccgggtgtgcagcggggagggcccccccaagacagacctgatggccttcagccccagcctgcctgacagccgggaccgggaggaccagctgcagaccacagaggagagctttgccaagccccggcagcccaacccagactggagatacagcgccagcctgcgggccggcatgcacagctctgtgcacctggaggaggccggcatcctgcgggccggccctgggggccctgaccagcagtggcccaccgtgtcctctgccaccccagagcctgaggccggggaggtgtccccacctgtgggcgccggcgtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 37240 - DNA, 2403 bp, Artificial Sequence
  Description of Artificial Sequence: Synthetic coding sequence
atggctgtgcgggagctgtgcttcccccggcagaggcaggtgctcttcctgttcctgttctggggcgtgtccctggccggcagcggcttcggccgctacagcgtgacagaggagacagagaagggcagctttgtggtgaacctggccaaggacctgggcctggccgagggggagctggccgcccggggcaccagggtggtgtctgatgacaacaagcagtacctgctgctggacagccacactggaaacctgctgaccaatgagaagctggaccgggagaagctgtgtggccccaaggagccctgcatgctgtacttccagatcctgatggatgaccccttccagatctacagagctgagctgcgggtgcgggacatcaatgaccacgcccctgtgttccaggacaaggagaccgtgctgaagatcagcgagaacacagctgagggcacagccttccggctggagcgggcccaggaccctgatggcggcctgaatggcatccagaactacaccatcagccccaacagcttcttccacatcaacatctctggaggagatgagggcatgatctacccagagctggtgctggacaaggccctggaccgggaggagcagggcgagctgagcctgaccctgacagccctggatggcggcagccccagccgcagcggcaccagcacagtgcgcatcgtggtgctggatgtgaatgacaatgccccccagtttgcccaggccctgtatgagacccaggcccctgagaacagccccatcggcttcctgattgtgaaggtgtgggccgaggatgtggacagcggcgtgaatgctgaggtgtcctacagcttctttgatgccagcgagaacatccgcaccaccttccagatcaaccccttcagcggggagatcttcctgcgggagctgctggactatgagctggtgaacagctacaagatcaacatccaggccatggatggcggcggcctgagcgcccgctgccgggtgctggtggaggtgctggacaccaatgacaaccccccagagctgattgtgtcctccttcagcaacagcgtggccgagaacagccctgagacccccctggccgtgttcaagatcaatgaccgggacagcggagaaaatggcaagatggtgtgctacatccaggagaacctgcccttcctgctgaagcccagcgtggagaacttctacatcctgatcacagaaggagccctggaccgggagatccgggcagagtacaacatcaccatcaccgtgacagacctgggcaccccccggctgaagacagagcacaacatcaccgtgctggtgtctgatgtgaatgacaatgccccagccttcacccagaccagctacaccctgtttgtgcgggagaacaacagccctgccctgcacatcggctctgtgtctgccacagaccgggacagcggcaccaatgcccaggtgacctacagcctgctgcccccccaggacccccacctgcccctggccagcctggtgtccatcaatgctgacaatggccacctgtttgccctgcggagcctggactatgaggccctgcaggcctttgagttccgggtgggcgccacagaccggggcagccctgccctgagccgggaggccctggtgcgggtgctggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaatggagaggtgaggacagcccggctgctgtctgaaagagatgctgccaagcaccggctggtggtgctggtgaaggacaatggagagccccccaggtctgccacagccaccctgcacctgctgctggtggatggcttcagccagccctacctgcccctgcctgaggccgccccagcccaggcccaggccgaggccgacctgctgactgtgtacctggtggtggccctggcctctgtgagcagcctcttcctgctgtctgtgctgctgtttgtggccgtgcggctgtgcagaagaagcagagctgcctctgtgggccgctgcagcgtgcctgagggccccttccctggccacctggtggatgtgagaggagctgagaccctgagccagagctaccagtatgaggtgtgcctgaccggcggccctggcaccagcgagttcaagttcctgaagcctgtgatcagtgacatccaggcccagggccctggcaggaagggggaggagaacagcaccttcaggaacagctttggcttcaacatccagtag

SEQ ID NO: 37241 - DNA, 1764 bp, Artificial Sequence
  Description of Artificial Sequence: Synthetic coding sequence
atgatggagacccccctgcccaaggcccctgagaagaggcaggtgacagccatcatcttcctgctgctgctgtgggaggccggcagcgccaccatcaagtacagcgtgctggaggagcgggacagcggcagctttgtggccaacctggccaaggacctgggcctgggcgtgggggagctggccgcccggggggcccgcatcctgagcaagggcaacaagcagtacctgcagctggagaggaagagcggcaacctgctgctgaaggagaagctggaccgggaggagctgtgtggggacatcgacccctgcatcctgcacttccagatgctgctgaagaaccctgtgcagttcatccagggcgagctgcagctgcaggatgtgaatgaccacgcccctgagttcctggagaatgagatcctgctgaagatcagcgagggcagccaccctggcaccagcttccccctgaagatcgcccaggacctggatgtgggcagcaacacagtgcagaactacagcatcagcaccaacagctacttccacctgttcaccaggaaccacagtgatggcaagaagtacccagagctggtgctggaccaggccctggaccgggaggagcagccccagctgcggctgaccctgacagccctggatggcggcagcccccccaggacaggcaccagccaggtgctgattgtgattgtggacatcaatgacaacgtgcctgagtttgcccagaggagatatgaggtgcaggtgcctgagaacacccccatcggcagcctggtgatcaccgtgtctgcccgggacctggatgctggcacccatggagagctgagctacagcttcttccagtacagcaaccagatcatccaggcctttgagatcaacagcatcactggagagatccgcttcaagaaggccctggactttgaggagatccagagctaccacatggaggtggaggccagtgatggcggcggcctgtctggaaaatgtactgtggccatcgaggtgatggacatcaatgacaatgcccctgagctgaccatgagcctgctgatcagtgacatcctggagaacagccctgagaccgtggtggccgtgtttggcatcagtgaccctgacagcggcaacaacgggaagatgatgtgcagcatccaggaccacctgcccttcctgctgaagcccaccctggagaacttctacaccctgctgacagagggcgccctggaccgggagagcagagctgagtacaacatcaccatcaccgtgacagacctgggcaccccccggctgaagacagagtacaacatcaccctgcgggtgtctgatgtgaatgacaatgccccagccttcacccagaccagctacaccctgtttgtgcgggagaacaacagccctgccctgcacatcggctctgtgtctgccacagaccgggacagcggcaccaatgcccaggtgacctacagcctgctgcccccccagaacccccacctgcccctggccagcctggtgtccatcaacacagacaatggccacctgtttgccctgcggagcctggactatgaggccctgcaggagtttgagttccgggtgggcgccagtgaccggggcagccctgccctgagcagcgaggccctggtgcgggtgctggtgtgctggacccccaccaccacccggcccagctgctgcacccgctgcaggacagcccccaggcctgcccccagctggtgccccggccggcccagccgggccacctggtag

SEQ ID NO: 37242 - DNA, 726 bp, Artificial Sequence
  Description of Artificial Sequence: Synthetic coding sequence
atggaggactacctgcagggctgccgggccgccctgcaggagaggaccatcatcctggactgtgtgaacatggacctgaagattggcaaggccacccccaaggacagcaaatatgtggagaagctggaggccctcttcccagacctgcccaagagaaatgacatctttgacagcctgcagaaggccaagtttgatgtgtctggcctgaccacagagcagatgctgaggaaggaccagaagaccatctaccggcagggcgtgaaggtggccatcagcgccatctacatggacctggagatctgtgaggtgctggagaggagccacagcccccccctgaagctgaccccagccagcagcacccaccccaacctgcacgcctacctgcagggcaacacccaggtgtccaggaagaagctgctgcccctgctgcaggaggccctgagcgcctactttgacagcatgaagatccccagcggccagcctgagacagcagatgtgtcccgggagcaggtggacaaggagctggaccgggccagcaacagcctcatcagcggcctgagccaggatgaagaagatcctcccctgccccccacccccatgaacagcctggtggatgagtgccccctggaccagggcctgcccaagctgtctgctgaggccgtgtttgagaagtgcagccagatcagcctgagccagagcaccacagccagcctgagcaagaagtag

SEQ ID NO: 37243 - DNA, 1362 bp, Artificial Sequence
  Description of Artificial Sequence: Synthetic coding sequence
atggaggactacctgcagggctgccgggccgccctgcaggagagccggcccctgcacgtggtgctgggcaatgaggcctgtgacctggacagcacagtgtctgccctggccctggccttctacctggccaagaccacagaggccgaggaggtgtttgtgcctgtgctgaacatcaagaggtctgagctgcccctgcggggggacatcgtgttcttcctgcagaaggtgcacatccctgagagcatcctgatcttcagagatgaaattgacctgcacgccctgtaccaggccggccagctgaccctcatcctggtggaccaccacatcctgagcaagagtgacacagccctggaggaggccgtggccgaggtgctggaccaccggcccatcgagcccaagcactgccccccctgccacgtgtctgtggagctggtgggcagctgtgccaccctggtgacagagcgcatcctgcagggcgcccctgagatcctggaccggcagacagctgccctgctgcacggcaccatcatcctggactgtgtgaacatggacctgaagattggcaaggccacccccaaggacagcaaatatgtggagaagctggaggccctcttcccagacctgcccaagagaaatgacatctttgacagcctgcagaaggccaagtttgatgtgtctggcctgaccacagagcagatgctgaggaaggaccagaagaccatctaccggcagggcgtgaaggtggccatcagcgccatctacatggacctggaggccttcctgcagaggagcaacctgctggccgacctgcacgccttctgccaggcccacagctatgatgtgctggtggccatgaccatcttcttcaacacccacaatgaacctgtgcggcagctggccatcttctgcccccacgtggccctgcagaccaccatctgtgaggtgctggagaggagccacagcccccccctgaagctgaccccagccagcagcacccaccccaacctgcacgcctacctgcagggcaacacccaggtgtccaggaagaagctgctgcccctgctgcaggaggccctgagcgcctactttgacagcatgaagatccccagcggccagcctgagacagcagatgtgtcccgggagcaggtggacaaggagctggaccgggccagcaacagcctcatcagcggcctgagccaggatgaagaagatcctcccctgccccccacccccatgaacagcctggtggatgagtgccccctggaccagggcctgcccaagctgtctgctgaggccgtgtttgagaagtgcagccagatcagcctgagccagagcaccacagccagcctgagcaagaagtag

SEQ ID NO: 37244 - DNA, 1161 bp, Artificial Sequence
  Description of Artificial Sequence: Synthetic coding sequence
atggaggactacctgcagggctgccgggccgccctgcaggagagccggcccctgcacgtggtgctgggcaatgaggcctgtgacctggacagcacagtgtctgccctggccctggccttctacctggccaagagaagtgacacagccctggaggaggccgtggccgaggtgctggaccaccggcccatcgagcccaagcactgccccccctgccacgtgtctgtggagctggtgggcagctgtgccaccctggtgacagagcgcatcctgcagggcgcccctgagatcctggaccggcagacagctgccctgctgcacggcaccatcatcctggactgtgtgaacatggacctgaagattggcaaggccacccccaaggacagcaaatatgtggagaagctggaggccctcttcccagacctgcccaagagaaatgacatctttgacagcctgcagaaggccaagtttgatgtgtctggcctgaccacagagcagatgctgaggaaggaccagaagaccatctaccggcagggcgtgaaggtggccatcagcgccatctacatggacctggaggccttcctgcagaggagcaacctgctggccgacctgcacgccttctgccaggcccacagctatgatgtgctggtggccatgaccatcttcttcaacacccacaatgaacctgtgcggcagctggccatcttctgcccccacgtggccctgcagaccaccatctgtgaggtgctggagaggagccacagcccccccctgaagctgaccccagccagcagcacccaccccaacctgcacgcctacctgcagggcaacacccaggtgtccaggaagaagctgctgcccctgctgcaggaggccctgagcgcctactttgacagcatgaagatccccagcggccagcctgagacagcagatgtgtcccgggagcaggtggacaaggagctggaccgggccagcaacagcctcatcagcggcctgagccaggatgaggaggacccccccctgccccccacccccatgaacagcctggtggatgaatgtcccctggaccagggcctgcccaagctgtctgctgaggccgtgtttgagaagtgcagccagatcagcctgagccagagcaccacagccagcctgagcaagaagtag

SEQ ID NO: 37245 - DNA, 657 bp, Artificial Sequence
  Description of Artificial Sequence: Synthetic coding sequence
atggacctgaagattggcaaggccacccccaaggacagcaaatatgtggagaagctggaggccctcttcccagacctgcccaagagaaatgacatctttgacagcctgcagaaggccaagtttgatgtgtctggcctgaccacagagcagatgctgaggaaggaccagaagaccatctaccggcagggcgtgaaggtggccatcagcgccatctacatggacctggagatctgtgaggtgctggagaggagccacagcccccccctgaagctgaccccagccagcagcacccaccccaacctgcacgcctacctgcagggcaacacccaggtgtccaggaagaagctgctgcccctgctgcaggaggccctgagcgcctactttgacagcatgaagatccccagcggccagcctgagacagcagatgtgtcccgggagcaggtggacaaggagctggaccgggccagcaacagcctcatcagcggcctgagccaggatgaggaggacccccccctgccccccacccccatgaacagcctggtggatgaatgtcccctggaccagggcctgcccaagctgtctgctgaggccgtgtttgagaagtgcagccagatcagcctgagccagagcaccacagccagcctgagcaagaagtag

SEQ ID NO: 37246 - DNA, 507 bp, Artificial Sequence
  Description of Artificial Sequence: Synthetic coding sequence
atgctgaggaaggaccagaagaccatctaccggcagggcgtgaaggtggccatcagcgccatctacatggacctggagatctgtgaggtgctggagaggagccacagcccccccctgaagctgaccccagccagcagcacccaccccaacctgcacgcctacctgcagggcaacacccaggtgtccaggaagaagctgctgcccctgctgcaggaggccctgagcgcctactttgacagcatgaagatccccagcggccagcctgagacagcagatgtgtcccgggagcaggtggacaaggagctggaccgggccagcaacagcctcatcagcggcctgagccaggatgaggaggacccccccctgccccccacccccatgaacagcctggtggatgaatgtcccctggaccagggcctgcccaagctgtctgctgaggccgtgtttgagaagtgcagccagatcagcctgagccagagcaccacagccagcctgagcaagaagtag

SEQ ID NO: 37247 - DNA, 816 bp, Artificial Sequence
  Description of Artificial Sequence: Synthetic coding sequence
atggacctgaagattggcaaggccacccccaaggacagcaaatatgtggagaagctggaggccctcttcccagacctgcccaagagaaatgacatctttgacagcctgcagaaggccaagtttgatgtgtctggcctgaccacagagcagatgctgaggaaggaccagaagaccatctaccggcagggcgtgaaggtggccatcagcgccatctacatggacctggaggccttcctgcagaggagcaacctgctggccgacctgcacgccttctgccaggcccacagctatgatgtgctggtggccatgaccatcttcttcaacacccacaatgaacctgtgcggcagctggccatcttctgcccccacgtggccctgcagaccaccatctgtgaggtgctggagaggagccacagcccccccctgaagctgaccccagccagcagcacccaccccaacctgcacgcctacctgcagggcaacacccaggtgtccaggaagaagctgctgcccctgctgcaggaggccctgagcgcctactttgacagcatgaagatccccagcggccagcctgagacagcagatgtgtcccgggagcaggtggacaaggagctggaccgggccagcaacagcctcatcagcggcctgagccaggatgaagaagatcctcccctgccccccacccccatgaacagcctggtggatgagtgccccctggaccagggcctgcccaagctgtctgctgaggccgtgtttgagaagtgcagccagatcagcctgagccagagcaccacagccagcctgagcaagaagtag

SEQ ID NO: 37248 - DNA, 657 bp, Artificial Sequence; identical to SEQ ID NO: 37245
  Description of Artificial Sequence: Synthetic coding sequence

SEQ ID NO: 37249 - DNA, 537 bp, Artificial Sequence
  Description of Artificial Sequence: Synthetic coding sequence
atggacctgaagattggcaaggccacccccaaggacagcaaatatgtggagaagctggaggccctcttcccagacctgcccaagagaaatgacatctttgacagcctgcagaaggccaagtttgatgtgtctggcctgaccacagagcagatgctgaggaaggaccagaagaccatctaccggcagggcgtgaaggtggccatcagcgccatctacatggacctggagatctgtgaggtgctggagaggagccacagcccccccctgaagctgaccccagccagcagcacccaccccaacctgcacgcctacctgcagggcaacacccaggtgtccaggaagaagctgctgcccctgctgcaggaggccctgagcgcctactttgacagcatgaagatccccagcggccagcctgagacagcagatgtgtcccgggagcaggtggacaaggagctggaccgggccagcaacagcctcatcagcggcctgagccaggatgaggaggacccccccctgccccccacccccatgaactag

SEQ ID NO: 37250 - DNA, 423 bp, Artificial Sequence
  Description of Artificial Sequence: Synthetic coding sequence
atggacctgaagattggcaaggccacccccaaggacagcaaatatgtggagaagctggaggccctcttcccagacctgcccaagagaaatgacatctttgacagcctgcagaaggccaagtttgatgtgtctggcctgaccacagagcagatgctgaggaaggaccagaagaccatctaccggcagggcgtgaaggtggccatcagcgccatctacatggacctggaggccttcctgcagaggagcaacctgctggccgacctgcacgccttctgccaggcccacagctatgatgtgctggtggccatgaccatcttcttcaacacccacaatgaacctgtgcggcagctggccatcttctgcccccacgtggccctgcagaccaccatctgtgaggtgctggagaggagccacagcccctag

SEQ ID NO: 37251 - DNA, 5241 bp, Artificial Sequence
  Description of Artificial Sequence: Synthetic coding sequence
atgtctgcctgcaacaccttcacagagcacgtgtggaagccaggagagtgcaagaactgcttcaagcccaagagcctgcaccagctgcccccagaccctgagaaggcccccatcacccacggcaatgtgaagaccaatgccaaccacagcaacaaccaccgcatccggaacacaggcaacttccggccccctgtggccaagaagcccaccatcgctgtgaagcccaccatgattgtggctgatggccagagcatctgtggggagctgagcatccaggagcactgtgagaacaagcctgtgatcatcggctggaacagaaacagagctgccctgagccagaagcccctgaacaacaacaatgaagatgatgagggcatcagccacgtgcccaagccctacggcaacaatgacagcgccaagaagatgtctgacaacaacaacggcctgacagaggtgctgaaggagattgctggcctggacacagccccccagatcagaggaaatgagaccaacagccgggagaccttcctgggccgcatcaatgactgctacaagaggagcctggagaggaagctgccccccagctgcatgattggaggcatcaaggagacccagggcaagcacgtgatcctgagcggcagcacagaggtgatcagcaatgaaggaggccgcttctgctacccagagttcagcagcggggaggagagcgaggaggatgtgctcttcagcaacatggaggaggagcacgagagctgggatgaaagtgatgaggagctgctggccatggagatccgcatgaggggccagcccaggtttgccaacttccgggccaacaccctgagccctgtgcgcttctttgtggacaagaagtggaacaccatccccctgaggaacaagagcctgcagaggatctgtgctgtggactatgatgacagctatgatgagatcctgaatggctatgaggagaacagcgtggtgtcctatggccagggcagcatccagagcatggtgtccagtgacagcaccagcccagacagcagcctgacagaggagagccgctcagaaacagccagcagcctgagccagaagatctgcaatggaggcctgagccctggcaaccctggggacagcaaggacatgaaggagattgagcccaactatgagagccccagcagcaacaaccaggacaaggacagcagccaggccagcaagagcagcatcaaggtgcctgagacccacaaggctgtgctggccctgcggctggaggagaaggatggcaagattgctgtgcagacagagaaggaggagagcaaggccagcacagatgtggccggccaggccgtgaccatcaacctggtgcccacagaggagcaggccaagccctacagagtggtgaacctggagcagcccctgtgcaagccctacacagtggtggatgtgtctgctgccatggccagcgagcacctggagggccctgtgaacagccccaagaccaagagcagcagcagcacccccaacagccctgtgaccagcagcagcctgaccccaggccagatcagcgcccacttccagaagagcagcgccatccgctaccaggaggtgtggaccagcagcaccagcccccggcagaagatccccaaggtggagctgatcaccagcggcaccggccccaacgtgccccccaggaagaactgccacaagagcgcccccaccagccccacagccaccaacatcagcagcaagaccatccctgtgaagagccccaacctgtctgagatcaagttcaacagctacaacaatgccggcatgccacccttccccatcatcatccatgatgagcccacctacgcccggagcagcaagaatgccatcaaggtgcccatcgtcatcaaccccaatgcctatgacaacctggccatctacaagagcttcctgggcaccagcggggagctgtctgtgaaggagaagaccaccagcgtcatcagccacacctatgaggagattgaaacagagagcaaggtgcctgacaacaccaccagcaagaccacagactgcctgcagaccaagggcttcagcaacagcacagagcacaagaggggctctgtggcccagaaggtgcaggagttcaacaactgcctgaacagaggccagagcagcccccagaggagctacagcagcagccacagcagccctgccaagatccagagggccacccaggagcctgtggccaagattgagggcacccaggagagccagatggtgggcagcagcagcacccgggagaaggccagcacagtgctgagccagatcgtggccagcatccagcccccccagagccccccagagaccccccagagcggccccaaggcctgcagcgtggaggagctgtatgccatccccccagatgctgatgtggccaagagcacccccaagagcacccctgtgcggcccaagagcctcttcaccagccagcccagcggggaggccgaggccccccagaccacagacagccccaccaccaaggtgcagaaggaccccagcatcaagcctgtgacccccagccccagcaagctggtgaccagcccccagagcgagcccccagcccccttccccccacccaggagcaccagcagcccctaccacgccggcaacctgctgcagaggcacttcaccaactggaccaagcccaccagccccaccaggagcacagaagctgagagcgtgctgcacagcgagggcagcagaagagctgctgatgccaagcccaagcgctggatctccttcaagagcttcttcagaagaaggaagacagatgaggaggatgacaaggagaaggagcgggagaagggcaagctggtgggcctggatggcaccgtcatccacatgctgcccccacctcctgtgcagaggcaccactggttcacagaggccaagggggagagcagcgagaagccagccatcgtgttcatgtaccgctgtgaccctgcccagggccagctgtctgtggaccagagcaaggccaggacagaccaggccgctgtgatggagaagggccgggcagaaaatgccctgctgcaggacagcgagaagaagaggagccacagcagccccagccagatccccaagaagatcctgagccacatgacccatgaggtgacagaggacttcagcccccgggaccccaggacagtggtgggcaagcaggacggccggggctgcacctctgtgaccacagccctgagcctgcctgagctggagcgggaggatggcaaggaggacatcagtgaccccatggaccccaacccctgcagcgccacctacagcaacctgggccagagcagagctgccatgatcccccccaagcagccccggcagcccaagggagctgtggatgatgccatcgccttcggcggcaagacagaccaggaggccccaaatgccagccagcccaccccaccacccctgcccaagaagatgatcatccgggccaacacagagcccatcagcaaggacctgcagaagtccatggagagcagcctgtgtgtgatggccaaccccacctatgacatcgaccccaactgggatgccagcagcgctggcagcagcatctcctatgagctgaagggcctggacatcgagagctatgacagcctggagcggcccctgaggaaggagaggcctgtgcccagcgctgccaacagcatcagcagcctgaccaccctgagcatcaaggaccgcttcagcaacagcatggagagcctgagcagcagaagaggccccagctgccggcagggccggggcatccagaagccccagaggcaggccctgtaccggggcctggagaaccgggaggaggtggtgggcaagatccgcagcctgcacacagatgccctgaagaagctggccgtgaagtgtgaggacctcttcatggccggccagaaggaccagctgcgctttggagtggacagctggagcgacttccggctgaccagtgacaagccctgctgtgaggccggagatgctgtgtactacacagccagctatgccaaggaccccctgaacaactatgctgtgaagatctgcaagagcaaggccaaggagagccagcagtactaccacagcctggccgtgcggcagagcctggccgtgcacttcaacatccagcaggactgtggccacttcctggccgaggtgcccaaccggctgctgccctgggaggaccctgatgatcctgagaaggatgaagatgacatggaggagacagaagaagatgccaagggggagacagatggcaagaaccccaagccctgcagcgaggccgccagcagccagaaggagaaccagggcgtgatgagcaagaagcagaggagccacgtggtggtgatcacccgggaggtgccctgcctgactgtggccgactttgtgcgggacagcctggcccagcacggcaagagcccagacctgtatgagcggcaggtgtgcctgctgctgctgcagctgtgcagcggcctggagcacctgaagccctaccacgtgacccactgtgacctgcggctggagaacctgctgctggtgcactaccagcccggcggcacagcccagggcttcggccctgctgagcccagccccaccagcagctaccccaccaggctcatcgtgagcaacttcagccaggccaagcagaagagccacctggtggaccctgagatcctgcgggaccagagccggctggcccctgagatcatcacagccacccagtacaagaagtgtgatgagttccagacaggcatcctgatctatgagatgctgcacctgcccaacccctttgatgaaaatcctgagctgaaggagcgggagtacaccagggctgacctgccccgcatccccttccgcagcccctacagccggggcctgcagcagctggccagctgcctgctgaaccccaaccccagcgagcgcatcctgatcagtgatgccaagggcatcctgcagtgcctgctgtggggcccccgggaggacctcttccagaccttcaccgcctgccccagcctggtgcagaggaacaccctgctgcagaactggctggacatcaagaggaccctgctgatgatcaagtttgctgagaagagcctggaccgggagggcggcatcagcctggaggactggctgtgtgcccagtacctggcctttgccaccacagacagcctgagctgcatcgtgaagatcctgcagcacaggtag

SEQ ID NO: 37252 - DNA, 5241 bp, Artificial Sequence; identical to SEQ ID NO: 37251
  Description of Artificial Sequence: Synthetic coding sequence

SEQ ID NO: 37253 - DNA, 3402 bp, Artificial Sequence
  Description of Artificial Sequence: Synthetic coding sequence
atggatgtgctggccgaggagtttggaaacctgaccccagagcagctggccgcccccatccccaccgtggaggagaagtggaggctgctgcctgccttcctgaaggtgaagggcctggtgaagcagcacatcgacagcttcaactacttcatcaacgtggagatcaagaagatcatgaaggccaatgagaaggtgaccagtgatgctgaccccatgtggtacctgaagtacctgaacatctacgtgggcctgcctgatgtggaggagagcttcaacgtgaccaggcctgtgagcccccatgaatgtcggctgcgggacatgacctacagcgcccccatcaccgtggacatcgagtacacccggggcagccagaggatcatcagaaatgccctgcccatcggccgcatgcccatcatgctgcggagcagcaactgtgtgctgaccgggaagaccccagctgagtttgccaagctgaatgaatgtcccctggaccccggcggctacttcatcgtgaagggcgtggagaaggtgatcctgatccaggagcagctgagcaagaaccgcatcatcgtggaggccgacagaaaaggagctgtgggcgcctctgtgaccagcagcacccatgagaagaagagcaggaccaacatggctgtgaagcagggccgcttctacctgcggcacaacaccctgtctgaggacatccccatcgtcatcatcttcaaggccatgggcgtggagagtgaccaggagatcgtgcagatgattggaacagaggagcacgtgatggccgccttcggccccagcctggaggagtgccagaaggcccagatcttcacccagatgcaggccctgaagtacatcggcaacaaggtgcggcggcagaggatgtggggcggcggccccaagaagaccaagattgaggaggcccgggagctgctggccagcaccatcctgacccacgtgcctgtgaaggagttcaacttccgggccaagtgcatctacacagctgtgatggtgcggcgggtcatcctggcccagggcgacaacaaggtggatgaccgggactactacggcaacaagaggctggagctggccggccagctgctgagcctgctgtttgaggacctcttcaagaagttcaacagcgagatgaagaagattgctgaccaggtgatccccaagcagagagctgcccagtttgatgtggtgaagcacatgaggcaggaccagatcaccaacggcatggtgaatgccatcagcactggaaactggagcctgaagcgcttcaagatggaccggcagggcgtgacccaggtgctgagccggctgagctacatcagcgccctgggcatgatgacccgcatcagcagccagtttgagaagaccaggaaggtgtctggccccaggagcctgcagcccagccagtggggcatgctgtgccccagcgacaccccagagggggaggcctgtggcctggtgaagaacctggccctgatgacccacatcaccacagacatggaggatggccccatcgtgaagctggccagcaacctgggcgtggaggatgtgaacctgctgtgtggggaggagctgagctacccaaatgtgttcctggtgttcctgaatggaaacatcctgggcgtcatccgggaccacaagaagctggtgaacaccttccggctgatgagaagagctggctacatcaatgaatttgtgtccatcagcaccaacctgacagacagatgtgtgtacatcagcagtgatggcggccgcctgtgccggccctacatcatcgtgaagaagcagaagccagctgtgaccaacaagcacatggaggagctggcccagggctacagaaactttgaggacttcctgcacgagagcctggtggagtacctggatgtgaatgaggagaatgactgcaacatcgccctgtatgagcacaccatcaacaaggacaccacccacctggagattgagcccttcaccctgctgggcgtgtgtgccggcctcatcccctacccccaccacaaccagagccccaggaacacctaccagtgtgccatgggcaagcaggccatgggcaccatcggctacaaccagaggaacagaattgacaccctgatgtacctgctggcctacccccagaagcccatggtgaagaccaagaccatcgagctgattgaatttgagaagctgcctgctggccagaatgccaccgtggccgtgatgagctacagcggctatgacattgaagatgccctggtgctgaacaaggccagcctggaccggggcttcggccgctgcctggtgtacaagaatgccaagtgcaccctgaagcgctacaccaaccagacctttgacaaggtgatgggccccatgctggatgctgccaccaggaagcccatctggaggcatgagatcctggatgctgatggcatctgcagccctggagagaaggtggagaacaagcaggtgctggtgaacaagtccatgcccaccgtgacccagatccccctggagggcagcaatgtgccccagcagccccagtacaaggatgtgcccatcacctacaagggggccacagacagctacatcgagaaggtgatgatcagcagcaatgcagaagatgccttcctgatcaagatgctgctgcggcagaccaggaggcctgagattggagacaagttcagcagcagacatggccagaagggcgtgtgtggcctcatcgtgccccaggaggacatgcccttctgtgacagcggcatctgcccagacatcatcatgaacccccacggcttccccagcaggatgacagtgggcaagctgattgagctgctggccggcaaggccggcgtgctggatggccgcttccactacggcacagccttcggcggcagcaaggtgaaggatgtgtgtgaggacctggtgagacatggctacaactacctgggcaaggactatgtgaccagcggcatcaccggggagcccctggaggcctacatctacttcggccctgtgtactaccagaagctgaagcacatggtgctggacaagatgcacgcccgggcccggggccccagggctgtgctgacccggcagcccacagagggccgcagcagagatggcggcctgcggctgggggagatggagcgggactgcctgattggctacggggcctccatgctgctgctggagcggctgatgatcagcagtgatgcctttgaggtggatgtgtgtggccagtgtggcctgctgggctacagcggctggtgccactactgcaagagcagctgccacgtgagcagcctgcgcatcccctatgcctgcaagctgctcttccaggagctgcagagcatgaacatcatcccccggctgaagctgagcaagtacaatgaatag

SEQ ID NO: 37254 - DNA, 3036 bp, Artificial Sequence
  Description of Artificial Sequence: Synthetic coding sequence
atgatgtctgatgccagtgacatgctggccgccgccctggagcagatggatggcatcatcgccggcagcaaggccctggagtacagcaatggcatctttgactgccagagccccaccagccccttcatgggcagcctgcgggccctgcacctggtggaggacctgcggggcctgctggagatgatggagacagatgagaaggagggcctgcgctgccagatcccagacagcacagctgagaccctggtggagtggctgcagagccagatgaccaacggccacctgcctggaaatggagatgtgtaccaggagcggctggcccggctggagaatgacaaggagagcctggtgctgcaggtgtctgtgctgacagaccaggtggaggcccagggcgagaagatccgggacctggagttctgcctggaggagcaccgggagaaggtgaatgccacagaggagatgctgcagcaggagctgctgagcaggaccagcctggagacccagaagctggacctgatggccgagatcagcaacctgaagctgaagctgacagctgtggagaaggaccggctggactatgaggacaagttccgggacacagagggcctcatccaggagatcaatgacctgcggctgaaggtgtctgagatggattctgagcggctgcagtatgagaagaagctgaagagcaccaagagcctgatggccaagctgagctccatgaagatcaaggtgggccagatgcagtatgagaagcagaggatggagcagaagtgggagagcctgaaggatgagctggccagcctgaaggagcagctggaggagaaggagagcgaggtgaagaggctgcaggagaagctggtgtgcaagatgaagggggagggcgtggagatcgtggaccgggacatcgaggtgcagaagatgaagaaggctgtggagagcctgatggccgccaatgaggagaaggacaggaagattgaggacctgcggcagtgcctgaaccgctacaagaagatgcaggacacagtggtgctggcccagggcaaggatggagaatatgaggagctgctgaacagcagcagcatcagcagcctgctggatgcccagggcttcagtgacctggagaagagccccagccccacccctgtgatgggcagccccagctgtgaccccttcaacacctctgtgcctgaggagttccacaccaccatcctgcaggtgtccatccccagcctgctgcctgccaccgtgtccatggagaccagcgagaagagcaagctgacccccaagccagagaccagctttgaagaaaatgatggcaacatcatcctgggcgccaccgtggacacccagctgtgtgacaagctgctgaccagcagcctgcagaagagcagcagcctgggcaacctgaagaaggagaccagtgatggagagaaggagaccatccagaagaccagtgaagatcgggccccagctgagagccggcccttcggcaccctgcccccccggcccccaggccaggacacctccatggatgacaaccccttcggcaccaggaaggtgcgcagcagctttggccggggcttcttcaagatcaagagcaacaagaggacagccagcgcccccaacctggccgagacagagaaggagacagctgagcacctggacctggccggggccagcagccggcccaaggacagccagaggaacagccccttccagatccccccacccagcccagacagcaagaagaagagccggggcatcatgaagctgtttgggaagctgcggcgcagccagagcaccaccttcaacccagatgacatgtctgagcctgagttcaagagaggaggcacccgggccacagctggcccccggctgggctggagccgggacctgggccagagcaacagcgacctggacatgccctttgccaagtggaccaaggagcaggtgtgcaactggctgatggagcagggcctgggcagctacctgaacagcggcaagcactggatcgccagcggccagaccctgctgcaggccagccagcaggacctggagaaggagctgggcatcaagcacagcctgcacaggaagaagctgcagctggccctgcaggccctgggcagcgaggaggagaccaaccacggcaagctggacttcaactgggtgacccgctggctggatgacatcggcctgccccagtacaagacccagtttgatgagggccgggtggatggccgcatgctgcactacatgacagtggatgacctgctgagcctgaaggtggtgtctgtgctgcaccacctgagcatcaagagggccatccaggtgctgcgcatcaacaactttgagcccaactgcctgcggcggcggcccagtgatgagaacaccatcgcccccagcgaggtgcagaagtggaccaaccaccgggtgatggagtggctgcggtctgtggacctggccgagtatgcccccaacctgcggggcagcggcgtgcacggcggcctgatggtgctggagccccgcttcaacgtggagaccatggcccagctgctgaacatcccccccaacaagaccctgctgcggcggcacctggccacccacttcaacctgctgattggagctgaggcccagcaccagaagagagatgccatggagctgcctgactatgtgctgctgacagccacagccaaggtgaagcccaagaagctggccttcagcaactttggaaacctgaggaagaagaagcaggaggatggagaggagtatgtgtgccccatggagctgggccaggccagcggcagcgccagcaagaagggcttcaagccaggcctggacatgaggctgtatgaagaagatgacctggaccggctggagcagatggaggacagcgagggcaccgtgcggcagatcggggccttcagcgagggcatcaacaacctgacccacatgctgaaggaggatgacatgttcaaggactttgctgcccggagccccagcgccagcatcacagatgaggacagcaatgtgtag

SEQ ID NO: 37255 - DNA, 513 bp, Artificial Sequence
  Description of Artificial Sequence: Synthetic coding sequence
atgatgtctgatgccagtgacatgctggccgccgccctggagcagatggatggcatcatcgccggcagcaaggccctggagtacagcaatggcatctttgactgccagagccccaccagccccttcatgggcagcctgcgggccctgcacctggtggaggacctgcggggcctgctggagatgatggagacagatgagaaggagggcctgcgctgccagatcccagacagcacagctgagaccctggtggagtggctgcagagccagatgaccaacggccacctgcctggaaatggagatgtgtaccaggagcggctggcccggctggagaatgacaaggagagcctggtgctgcaggtgtctgtgctgacagaccaggtggaggcccagggcgagaagatccgggacctggagttctgcctggaggagcaccgggagaaggtgaatgccacagaggagatgctgcagcaggtgtgtgccgaggcccggaccaagatgggcttcccctgctag

SEQ ID NO: 37256 - DNA, 261 bp, Artificial Sequence
  Description of Artificial Sequence: Synthetic coding sequence
atgatgtctgatgccagtgacatgctggccgccgccctggagcagatggatggcatcatcgccggcagcaaggccctggagtacagcaatggcatctttgactgccagagccccaccagccccttcatgggcagcctgcgggccctgcacctggtggaggacctgcggggcctgctggagatgatggagacagatgagaaggagggcctgcgctgccagatcccagacagcacagctgagaccctggtggagtggctgtag

SEQ ID NO: 37257 - DNA, 2577 bp, Artificial Sequence
  Description of Artificial Sequence: Synthetic coding sequence
atgctgcagcaggagctgctgagcaggaccagcctggagacccagaagctggacctgatggccgagatcagcaacctgaagctgaagctgacagctgtggagaaggaccggctggactatgaggacaagttccgggacacagagggcctcatccaggagatcaatgacctgcggctgaaggtgtctgagatggacagcgagcggctgcagtatgagaagaagctgaagagcaccaagagcctgatggccaagctgagctccatgaagatcaaggtgggccagatgcagtatgagaagcagaggatggagcagaagtgggagagcctgaaggatgagctggccagcctgaaggagcagctggaggagaaggagagcgaggtgaagaggctgcaggagaagctggtgtgcaagatgaagggggagggcgtggagatcgtggaccgggacatcgaggtgcagaagatgaagaaggctgtggagagcctgatggccgccaatgaggagaaggacaggaagattgaggacctgcggcagtgcctgaaccgctacaagaagatgcaggacacagtggtgctggcccagggcaaggatggagaatatgaggagctgctgaacagcagcagcatcagcagcctgctggatgcccagggcttcagtgacctggagaagagccccagccccacccctgtgatgggcagccccagctgtgaccccttcaacacctctgtgcctgaggagttccacaccaccatcctgcaggtgtccatccccagcctgctgcctgccaccgtgtccatggagaccagcgagaagagcaagctgacccccaagccagagaccagctttgaggagaatgatggcaacatcatcctgggcgccaccgtggacacccagctgtgtgacaagctgctgaccagcagcctgcagaagagcagcagcctgggcaacctgaagaaggagaccagtgatggagagaaggagaccatccagaagaccagcgaggaccgggccccagctgagagccggcccttcggcaccctgccccccaggcctcctggccaggacacctccatggatgacaaccccttcggcaccaggaaggtgcgcagcagctttggccggggcttcttcaagatcaagagcaacaagaggacagccagcgcccccaacctggccgagacagagaaggagacagctgagcacctggacctggccggggccagcagccggcccaaggacagccagaggaacagccccttccagatccccccacccagcccagacagcaagaagaagagccggggcatcatgaagctgtttgggaagctgcggcgcagccagagcaccaccttcaacccagatgacatgtctgagcctgagttcaagaggggcggcacccgggccacagctggcccccggctgggctggagccgggacctgggccagagcaacagcgacctggacatgccctttgccaagtggaccaaggagcaggtgtgcaactggctgatggagcagggcctgggcagctacctgaacagcggcaagcactggatcgccagcggccagaccctgctgcaggccagccagcaggacctggagaaggagctgggcatcaagcacagcctgcacaggaagaagctgcagctggccctgcaggccctgggcagcgaggaggagaccaaccacggcaagctggacttcaactgggtgacccgctggctggatgacatcggcctgccccagtacaagacccagtttgatgagggccgggtggatggccgcatgctgcactacatgacagtggatgacctgctgagcctgaaggtggtgtctgtgctgcaccacctgagcatcaagagggccatccaggtgctgcgcatcaacaactttgagcccaactgcctgcggcggcggcccagtgatgagaacaccatcgcccccagcgaggtgcagaagtggaccaaccaccgggtgatggagtggctgcggtctgtggacctggccgagtatgcccccaacctgcggggcagcggcgtgcatggaggcctgatggtgctggagccccgcttcaacgtggagaccatggcccagctgctgaacatcccccccaacaagaccctgctgcggcggcacctggccacccacttcaacctgctgattggagctgaggcccagcaccagaagagagatgccatggagctgcctgactatgtgctgctgacagccacagccaaggtgaagcccaagaagctggccttcagcaactttggaaacctgaggaagaagaagcaggaggatggagaggagtatgtgtgccccatggagctgggccaggccagcggcagcgccagcaagaagggcttcaagccaggcctggacatgaggctgtatgaggaggatgacctggaccggctggagcagatggaggacagcgagggcaccgtgcggcagattggagccttcagcgagggcatcaacaacctgacccacatgctgaaggaggatgacatgttcaaggactttgctgcccggagccccagcgccagcatcacagatgaggacagcaatgtgtag

SEQ ID NO: 37258 - DNA, 57 bp, Artificial Sequence
  Description of Artificial Sequence: Synthetic coding sequence
atgctgcagcaggagctgctgagcaggaccagcctggagacccagaagctggactag

SEQ ID NO: 37259 - DNA, 2943 bp, Artificial Sequence
  Description of Artificial Sequence: Synthetic coding sequence
atgatgtctgatgccagtgacatgctggccgccgccctggagcagatggatggcatcatcgccggcagcaaggccctggagtacagcaatggcatctttgactgccagagccccaccagccccttcatgggcagcctgcgggccctgcacctggtggaggacctgcggggcctgctggagatgatggagacagatgagaaggagggcctgcgctgccagatcccagacagcacagctgagaccctggtggagtggctgcagagccagatgaccaacggccacctgcctggaaatggagatgtgtaccaggagcggctggcccggctggagaatgacaaggagagcctggtgctgcaggtgtctgtgctgacagaccaggtggaggcccagggcgagaagatccgggacctggagttctgcctggaggagcaccgggagaaggtgaatgccacagaggagatgctgcagcaggagctgctgagcaggaccagcctggagacccagaagctggacctgatggccgagatcagcaacctgaagctgaagctgacagctgtggagaaggaccggctggactatgaggacaagttccgggacacagagggcctcatccaggagatcaatgacctgcggctgaaggtgtctgagatggattctgagcggctgcagtatgagaagaagctgaagagcaccaaggatgagctggccagcctgaaggagcagctggaggagaaggagagcgaggtgaagaggctgcaggagaagctggtgtgcaagatgaagggggagggcgtggagatcgtggaccgggacatcgaggtgcagaagatgaagaaggctgtggagagcctgatggccgccaatgaggagaaggacaggaagattgaggacctgcggcagtgcctgaaccgctacaagaagatgcaggacacagtggtgctggcccagggcaaggatggagaatatgaggagctgctgaacagcagcagcatcagcagcctgctggatgcccagggcttcagtgacctggagaagagccccagccccacccctgtgatgggcagccccagctgtgaccccttcaacacctctgtgcctgaggagttccacaccaccatcctgcaggtgtccatccccagcctgctgcctgccaccgtgtccatggagaccagcgagaagagcaagctgacccccaagccagagaccagctttgaggagaatgatggcaacatcatcctgggcgccaccgtggacacccagctgtgtgacaagctgctgaccagcagcctgcagaagagcagcagcctgggcaacctgaagaaggagaccagtgatggagagaaggagaccatccagaagaccagcgaggaccgggccccagctgagagccggcccttcggcaccctgccccccaggcctcctggccaggacacctccatggatgacaaccccttcggcaccaggaaggtgcgcagcagctttggccggggcttcttcaagatcaagagcaacaagaggacagccagcgcccccaacctggccgagacagagaaggagacagctgagcacctggacctggccggggccagcagccggcccaaggacagccagaggaacagccccttccagatccccccacccagcccagacagcaagaagaagagccggggcatcatgaagctgtttgggaagctgcggcgcagccagagcaccaccttcaacccagatgacatgtctgagcctgagttcaagaggggcggcacccgggccacagctggcccccggctgggctggagccgggacctgggccagagcaacagcgacctggacatgccctttgccaagtggaccaaggagcaggtgtgcaactggctgatggagcagggcctgggcagctacctgaacagcggcaagcactggatcgccagcggccagaccctgctgcaggccagccagcaggacctggagaaggagctgggcatcaagcacagcctgcacaggaagaagctgcagctggccctgcaggccctgggcagcgaggaggagaccaaccacggcaagctggacttcaactgggtgacccgctggctggatgacatcggcctgccccagtacaagacccagtttgatgagggccgggtggatggccgcatgctgcactacatgacagtggatgacctgctgagcctgaaggtggtgtctgtgctgcaccacctgagcatcaagagggccatccaggtgctgcgcatcaacaactttgagcccaactgcctgcggcggcggcccagtgatgagaacaccatcgcccccagcgaggtgcagaagtggaccaaccaccgggtgatggagtggctgcggtctgtggacctggccgagtatgcccccaacctgcggggcagcggcgtgcatggaggcctgatggtgctggagccccgcttcaacgtggagaccatggcccagctgctgaacatcccccccaacaagaccctgctgcggcggcacctggccacccacttcaacctgctgattggagctgaggcccagcaccagaagagagatgccatggagctgcctgactatgtgctgctgacagccacagccaaggtgaagcccaagaagctggccttcagcaactttggaaacctgaggaagaagaagcaggaggatggagaggagtatgtgtgccccatggagctgggccaggccagcggcagcgccagcaagaagggcttcaagccaggcctggacatgaggctgtatgaggaggatgacctggaccggctggagcagatggaggacagcgagggcaccgtgcggcagattggagccttcagcgagggcatcaacaacctgacccacatgctgaaggaggatgacatgttcaaggactttgctgcccggagccccagcgccagcatcacagatgaggacagcaatgtgtag

SEQ ID NO: 37260 - DNA, 852 bp, Artificial Sequence
  Description of Artificial Sequence: Synthetic coding sequence
atgatgtctgatgccagtgacatgctggccgccgccctggagcagatggatggcatcatcgccggcagcaaggccctggagtacagcaatggcatctttgactgccagagccccaccagccccttcatgggcagcctgcgggccctgcacctggtggaggacctgcggggcctgctggagatgatggagacagatgagaaggagggcctgcgctgccagatcccagacagcacagctgagaccctggtggagtggctgcagagccagatgaccaacggccacctgcctggaaatggagatgtgtaccaggagcggctggcccggctggagaatgacaaggagagcctggtgctgcaggccatggtgtctgtgctgacagaccaggtggaggcccagggcgagaagatccgggacctggagttctgcctggaggagcaccgggagaaggtgaatgccacagaggagatgctgcagcaggagctgctgagcaggaccagcctggagacccagaagctggacctgatggccgagatcagcaacctgaagctgaagctgacagctgtggagaaggaccggctggactatgaggacaagttccgggacacagagggcctcatccaggagatcaatgacctgcggctgaaggtgtctgagatggattctgagcggctgcagtatgagaagaagctgaagagcaccaaggatgagctggccagcctgaaggagcagctggaggagaaggagagcgaggtgaagaggctgcaggagaagctggtgtgcaagatgaagggggagggcgtggagatcgtggacagagatgagaacttcaagaagaagctgaaggagaagtag

SEQ ID NO: 37261 - DNA, 846 bp, Artificial Sequence
  Description of Artificial Sequence: Synthetic coding sequence
atgatgtctgatgccagtgacatgctggccgccgccctggagcagatggatggcatcatcgccggcagcaaggccctggagtacagcaatggcatctttgactgccagagccccaccagccccttcatgggcagcctgcgggccctgcacctggtggaggacctgcggggcctgctggagatgatggagacagatgagaaggagggcctgcgctgccagatcccagacagcacagctgagaccctggtggagtggctgcagagccagatgaccaacggccacctgcctggaaatggagatgtgtaccaggagcggctggcccggctggagaatgacaaggagagcctggtgctgcaggtgtctgtgctgacagaccaggtggaggcccagggcgagaagatccgggacctggagttctgcctggaggagcaccgggagaaggtgaatgccacagaggagatgctgcagcaggagctgctgagcaggaccagcctggagacccagaagctggacctgatggccgagatcagcaacctgaagctgaagctgacagctgtggagaaggaccggctggactatgaggacaagttccgggacacagagggcctcatccaggagatcaatgacctgcggctgaaggtgtctgagatggattctgagcggctgcagtatgagaagaagctgaagagcaccaaggatgagctggccagcctgaaggagcagctggaggagaaggagagcgaggtgaagaggctgcaggagaagctggtgtgcaagatgaagggggagggcgtggagatcgtggacagagatgagaacttcaagaagaagctgaaggagaagtag

SEQ ID NO: 37262 - DNA, 1197 bp, Artificial Sequence
  Description of Artificial Sequence: Synthetic coding sequence
atgggccaggccggctgcaagggcctgtgcctgagcctgtttgactacaagacagagaagtatgtgattgccaagaacaagaaggtgggcctgctgtaccgcctgctgcaggccagcatcctggcctacctggtggtgtgggtgttcctgatcaagaagggctaccaggatgtggacaccagcctgcagagcgctgtgatcaccaaggtgaagggcgtggccttcaccaacaccagtgacctgggccagaggatctgggatgtggccgactatgtgatcccagcccagaatgaaggcatcccagatggagcctgcagcaaggacagcgactgccacgccggggaggccgtgacagctggaaatggagtgaagacaggccgctgcctgcggcgggagaacctggcccggggcacctgtgagatctttgcctggtgccccctggagaccagcagcaggcctgaggagcccttcctgaaggaggccgaggacttcaccatcttcatcaagaaccacatccgcttccccaagttcaacttcagcaagagcaatgtgatggatgtgaaggaccgctccttcctgaagagctgccacttcggccccaagaaccactactgccccatcttccggctgggcagcgtcatccgctgggccggcagtgacttccaggacatcgccctggagggcggcgtgattggcatcaacatcgagtggaactgtgacctggacaaggccgccagcgagtgccacccccactacagcttcagccggctggacaacaagctgagcaagtctgtgagcagcggctacaacttccgctttgcccgctactacagagatgctgctggggtggagttccgcaccctgatgaaggcctacggcatccgctttgatgtgatggtgaatggaaaaggagccttcttctgtgacctggtgctgatctacctgatcaagaagcgggagttctacagagacaagaagtatgaggaggtgcggggcctggaggacagcagccaggaggctgaagatgaggccagcggcctgggcctgtctgagcagctgaccagcggccctggcctgctgggcatgcctgagcagcaggagctgcaggagcccccagaggccaagaggggcagcagcagccagaagggaaatggatctgtgtgcccccagctgctggagccccacaggagcacctag

SEQ ID NO: 37263 - DNA, 1248 bp, Artificial Sequence
  Description of Artificial Sequence: Synthetic coding sequence
atgtgcccccagctggccggggccggctccatgggcagccctggggccaccaccggctggggcctgctggactacaagacagagaagtgggccctgctggccaagaagggctaccaggagcgggacctggagccccagttcagcatcatcaccaagctgaagggcgtgtctgtgacccagatcaaggagctgggcaaccggctgtgggatgtggccgactttgtgaagccaccccagggagaaaatgtgttcttcctggtgaccaacttcctggtgaccccagcccaggtgcagggccgctgcccagagcaccccagcgtgcccctggccaactgctgggtggatgaggactgcccagagggggagggcggcacccacagccacggcgtgaagacaggccagtgtgtggtgttcaacggcacccacaggacctgtgagatctggagctggtgccctgtggagagcggcgtggtgcccagccggcccctgctggcccaggcccagaacttcaccctcttcatcaagaacacagtgaccttcagcaagttcaacttcagcaagagcaatgccctggagacctgggaccccacctacttcaagcactgccgctatgagccccagttcagcccctactgccctgtgttcagaattggagacctggtggccaaggccggcggcacctttgaggacctggccctgctgggcggctctgtgggcatccgggtgcactgggactgtgacctggacaccggggacagcggctgctggccccactacagcttccagctgcaggagaagagctacaacttcagaacagccacccactggtgggagcagcccggggtggaggcccggaccctgctgaagctgtatggcatccgctttgacatcctggtgacaggccaggccggcaagtttggcctcatccccacagctgtgaccctgggcactggagctgcctggctgggcgtggtgaccttcttctgtgacctgctgctgctgtatgtggaccgggaggcccacttctactggaggaccaagtatgaggaggccaaggcccccaaggccacagccaacagcgtgtggagggagctggccctggccagccaggcccggctggctgaatgtctgcggcgcagcagcgccccagcccccacagccacagctgctggcagccagacccagaccccaggctggccctgccccagcagtgacacccacctgcccacccacagcggcagcctgtag

SEQ ID NO: 37264 - DNA, 1494 bp, Artificial Sequence
  Description of Artificial Sequence: Synthetic coding sequence
atggctgctgcccagcccaagtacccagctggggccacagcccggcggctggcccggggctgctggagcgccctgtgggactatgagacccccaaggtgattgtggtgaggaacagaaggctgggcgtgctgtacagagctgtgcagctgctgatcctgctgtactttgtgtggtacgtgttcatcgtgcagaagagctaccaggagagcgagaccggccctgagagcagcatcatcaccaaggtgaagggcatcaccaccagcgagcacaaggtgtgggatgtggaggagtatgtgaagcccccagagggcggcagcgtcttcagcatcatcaccagggtggaggccacccacagccagacccagggcacctgcccagagagcatccgggtgcacaatgccacctgcctgagtgatgctgactgtgtggccggggagctggacatgctgggcaatggcctgaggacaggccgctgtgtgccctactaccagggccccagcaagacctgtgaggtgtttggctggtgccctgtggaggatggagcctctgtgtcccagttcctgggcaccatggcccccaacttcaccatcctgatcaagaacagcatccactaccccaagttccacttcagcaagggcaacattgctgacagaacagatggctacctgaagcgctgcaccttccacgaggccagtgacctgtactgccccatcttcaagctgggcttcatcgtggagaaggccggggagagcttcacagagctggcccacaagggcggcgtcatcggggtcatcatcaactgggactgtgacctggacctgcctgccagcgagtgcaaccccaagtacagcttccggcggctggaccccaagcacgtgcctgccagcagcggctacaacttccgctttgccaagtactacaagatcaatggcaccaccaccaggaccctcatcaaggcctacggcatcagaattgatgtgattgtgcacggccaggccggcaagttcagcctcatccccaccatcatcaacctggccacagccctgacctctgtgggcgtggtgaggaaccccctgtggggccccagcggctgcggcggcagcacccggcccctgcacacaggcctgtgctggccccagggcagcttcctgtgtgactggatcctgctgaccttcatgaacaagaacaaggtgtacagccacaagaagtttgacaaggtgtgcacccccagccaccccagcggctcctggcctgtgaccctggcccgggtgctgggccaggcccctcctgagcccggccacagaagtgaggaccagcaccccagccccccatctggccaggagggccagcagggcgcagaatgtggccctgccttcccccccctgcggccctgccccatcagcgcccccagcgagcagatggtggacaccccagccagcgagcccgcccaggccagcacccccacagaccccaagggcctggcccagctgtag

SEQ ID NO: 37265 - DNA, 1215 bp, Artificial Sequence
  Description of Artificial Sequence: Synthetic coding sequence
atggctgctgcccagcccaagtacccagctggggccacagcccggcggctggcccggggctgctggagcgccctgtgggactatgagacccccaaggtgattgtggtgaggaacagaaggctgggcgtgctgtacagagctgtgcagctgctgatcctgctgtactttgtgtggtacgtgttcatcgtgcagaagagctaccaggagagcgagaccggccctgagagcagcatcatcaccaaggtgaagggcatcaccaccagcgagcacaaggtgtgggatgtggaggagtatgtgaagcccccagagggcggcagcgtcttcagcatcatcaccagggtggaggccacccacagccagacccagggcacctgcccagagagcatccgggtgcacaatgccacctgcctgagtgatgctgactgtgtggccggggagctggacatgctgggcaatggcctgaggacaggccgctgtgtgccctactaccagggccccagcaagacctgtgaggtgtttggctggtgccctgtggaggatggagcctctgtgtcccagttcctgggcaccatggcccccaacttcaccatcctgatcaagaacagcatccactaccccaagttccacttcagcaagggcaacattgctgacagaacagatggctacctgaagcgctgcaccttccacgaggccagtgacctgtactgccccatcttcaagctgggcttcatcgtggagaaggccggggagagcttcacagagctggcccacaagggcggcgtcatcggggtcatcatcaactgggactgtgacctggacctgcctgccagcgagtgcaaccccaagtacagcttccggcggctggaccccaagcacgtgcctgccagcagcggctacaacttccgctttgccaagtactacaagatcaatggcaccaccaccaggaccctcatcaaggcctacggcatcagaattgatgtgattgtgcacggccaggccggcaagttcagcctcatccccaccatcatcaacctggccacagccctgacctctgtgggcgtgggcagcttcctgtgtgactggatcctgctgaccttcatgaacaagaacaaggtgtacagccacaagaagtttgacaagatggtggacaccccagccagcgagcccgcccaggccagcacccccacagaccccaagggcctggcccagctgtag

SEQ ID NO: 37266 - DNA, 1344 bp, Artificial Sequence
  Description of Artificial Sequence: Synthetic coding sequence
atggctgctgcccagcccaagtacccagctggggccacagcccggcggctggcccggggctgctggagcgccctgtgggactatgagacccccaaggtgattgtggtgaggaacagaaggctgggcgtgctgtacagagctgtgcagctgctgatcctgctgtactttgtgtggtacgtgttcatcgtgcagaagagctaccaggagagcgagaccggccctgagagcagcatcatcaccaaggtgaagggcatcaccaccagcgagcacaaggtgtgggatgtggaggagtatgtgaagcccccagagagcatccgggtgcacaatgccacctgcctgagtgatgctgactgtgtggccggggagctggacatgctgggcaatggcctgaggacaggccgctgtgtgccctactaccagggccccagcaagacctgtgaggtgtttggctggtgccctgtggaggatggagcctctgtgtcccagttcctgggcaccatggcccccaacttcaccatcctgatcaagaacagcatccactaccccaagttccacttcagcaagggcaacattgctgacagaacagatggctacctgaagcgctgcaccttccacgaggccagtgacctgtactgccccatcttcaagctgggcttcatcgtggagaaggccggggagagcttcacagagctggcccacaagggcggcgtcatcggggtcatcatcaactgggactgtgacctggacctgcctgccagcgagtgcaaccccaagtacagcttccggcggctggaccccaagcacgtgcctgccagcagcggctacaacttccgctttgccaagtactacaagatcaatggcaccaccaccaggaccctcatcaaggcctacggcatcagaattgatgtgattgtgcacggccaggccggcaagttcagcctcatccccaccatcatcaacctggccacagccctgacctctgtgggcgtgggcagcttcctgtgtgactggatcctgctgaccttcatgaacaagaacaaggtgtacagccacaagaagtttgacaaggtgtgcacccccagccaccccagcggctcctggcctgtgaccctggcccgggtgctgggccaggcccctcctgagcccggccacagaagtgaggaccagcaccccagccccccatctggccaggagggccagcagggcgcagaatgtggccctgccttcccccccctgcggccctgccccatcagcgcccccagcgagcagatggtggacaccccagccagcgagcccgcccaggccagcacccccacagaccccaagggcctggcccagctgtag

SEQ ID NO: 37267 - DNA, 1140 bp, Artificial Sequence
  Description of Artificial Sequence: Synthetic coding sequence
atggctgctgcccagcccaagtacccagctggggccacagcccggcggctggcccggggctgctggagcgccctgtgggactatgagacccccaaggtgattgtgtccatccgggtgcacaatgccacctgcctgagtgatgctgactgtgtggccggggagctggacatgctgggcaatggcctgaggacaggccgctgtgtgccctactaccagggccccagcaagacctgtgaggtgtttggctggtgccctgtggaggatggagcctctgtgtcccagttcctgggcaccatggcccccaacttcaccatcctgatcaagaacagcatccactaccccaagttccacttcagcaagggcaacattgctgacagaacagatggctacctgaagcgctgcaccttccacgaggccagtgacctgtactgccccatcttcaagctgggcttcatcgtggagaaggccggggagagcttcacagagctggcccacaagggcggcgtcatcggggtcatcatcaactgggactgtgacctggacctgcctgccagcgagtgcaaccccaagtacagcttccggcggctggaccccaagcacgtgcctgccagcagcggctacaacttccgctttgccaagtactacaagatcaatggcaccaccaccaggaccctcatcaaggcctacggcatcagaattgatgtgattgtgcacggccaggccggcaagttcagcctcatccccaccatcatcaacctggccacagccctgacctctgtgggcgtgggcagcttcctgtgtgactggatcctgctgaccttcatgaacaagaacaaggtgtacagccacaagaagtttgacaaggtgtgcacccccagccaccccagcggctcctggcctgtgaccctggcccgggtgctgggccaggcccctcctgagcccggccacagaagtgaggaccagcaccccagccccccatctggccaggagggccagcagggcgcagaatgtggccctgccttcccccccctgcggccctgccccatcagcgcccccagcgagcagatggtggacaccccagccagcgagcccgcccaggccagcacccccacagaccccaagggcctggcccagctgtag

SEQ ID NO: 37268 - DNA, 1200 bp, Artificial Sequence
  Description of Artificial Sequence: Synthetic coding sequence
atggctgctgcccagcccaagtacccagctggggccacagcccggcggctggcccggggctgctggagcgccctgtgggactatgagacccccaaggtgattgtggtgcgcatccacagagctgagaagctgcctggagagagagatggcccccgggagctgcaccaccaccagggccagggcgaccaccacgtgcgggcccagagcgtgggccggggcggcgtgcgggaggccccccggggcctgaggacaggccgctgtgtgccctactaccagggccccagcaagacctgtgaggtgtttggctggtgccctgtggaggatggagcctctgtgtcccagttcctgggcaccatggcccccaacttcaccatcctgatcaagaacagcatccactaccccaagttccacttcagcaagggcaacattgctgacagaacagatggctacctgaagcgctgcaccttccacgaggccagtgacctgtactgccccatcttcaagctgggcttcatcgtggagaaggccggggagagcttcacagagctggcccacaagggcggcgtcatcggggtcatcatcaactgggactgtgacctggacctgcctgccagcgagtgcaaccccaagtacagcttccggcggctggaccccaagcacgtgcctgccagcagcggctacaacttccgctttgccaagtactacaagatcaatggcaccaccaccaggaccctcatcaaggcctacggcatcagaattgatgtgattgtgcacggccaggccggcaagttcagcctcatccccaccatcatcaacctggccacagccctgacctctgtgggcgtgggcagcttcctgtgtgactggatcctgctgaccttcatgaacaagaacaaggtgtacagccacaagaagtttgacaaggtgtgcacccccagccaccccagcggctcctggcctgtgaccctggcccgggtgctgggccaggcccctcctgagcccggccacagaagtgaggaccagcaccccagccccccatctggccaggagggccagcagggcgcagaatgtggccctgccttcccccccctgcggccctgccccatcagcgcccccagcgagcagatggtggacaccccagccagcgagcccgcccaggccagcacccccacagaccccaagggcctggcccagctgtag

SEQ ID NO: 37269 - DNA, 1416 bp, Artificial Sequence
  Description of Artificial Sequence: Synthetic coding sequence
atggctgctgcccagcccaagtacccagctggggccacagcccggcggctggcccggggctgctggagcgccctgtgggactatgagacccccaaggtgattgtggtgaggaacagaaggctgggcgtgctgtacagagctgtgcagctgctgatcctgctgtactttgtgtggtacgtgttcatcgtgcagaagagctaccaggagagcgagaccggccctgagagcagcatcatcaccaaggtgaagggcatcaccaccagcgagcacaaggtgtgggatgtggaggagtatgtgaagcccccagagggcggcagcgtcttcagcatcatcaccagggtggaggccacccacagccagacccagggcacctgcccagagagcatccgggtgcacaatgccacctgcctgagtgatgctgactgtgtggccggggagctggacatgctgggcaatggcctgaggacaggccgctgtgtgccctactaccagggccccagcaagacctgtgaggtgtttggctggtgccctgtggaggatggagcctctgtgtcccagttcctgggcaccatggcccccaacttcaccatcctgatcaagaacagcatccactaccccaagttccacttcagcaagggcaacattgctgacagaacagatggctacctgaagcgctgcaccttccacgaggccagtgacctgtactgccccatcttcaagctgggcttcatcgtggagaaggccggggagagcttcacagagctggcccacaagggcggcgtcatcggggtcatcatcaactgggactgtgacctggacctgcctgccagcgagtgcaaccccaagtacagcttccggcggctggaccccaagcacgtgcctgccagcagcggctacaacttccgctttgccaagtactacaagatcaatggcaccaccaccaggaccctcatcaaggcctacggcatcagaattgatgtgattgtgcacggccaggccggcaagttcagcctcatccccaccatcatcaacctggccacagccctgacctctgtgggcgtgggcagcttcctgtgtgactggatcctgctgaccttcatgaacaagaacaaggtgtacagccacaagaagtttgacaaggtgtgcacccccagccaccccagcggctcctggcctgtgaccctggcccgggtgctgggccaggcccctcctgagcccggccacagaagtgaggaccagcaccccagccccccatctggccaggagggccagcagggcgcagaatgtggccctgccttcccccccctgcggccctgccccatcagcgcccccagcgagcagatggtggacaccccagccagcgagcccgcccaggccagcacccccacagaccccaagggcctggcccagctgtag

SEQ ID NO: 37270 - DNA, 1113 bp, Artificial Sequence
  Description of Artificial Sequence: Synthetic coding sequence
atggctgctgcccagcccaagtacccagctggggccacagcccggcggctggcccggggctgctggagcgccctgtgggactatgagacccccaaggtgattgtggtgaggaacagaaggctgggcgtgctgtacagagctgtgcagctgctgatcctgctgtactttgtgtggtacgtgttcatcgtgcagaagagctaccaggagagcgagaccggccctgagagcagcatcatcaccaaggtgaagggcatcaccaccagcgagcacaaggtgtgggatgtggaggagtatgtgaagcccccagagagcatccgggtgcacaatgccacctgcctgagtgatgctgactgtgtggccggggagctggacatgctgggcaatggagccctgcaggacctgcggggcgtgcggctggtgcctgggggccgctggggcctgtgccagcccatcagcggctatgatggccccaagttccaccacccccaccaggagcagcaccccctgccccagatccccctgctgcagggccagcaccggcggccccaccggcgggtgcctgaggccctgcacgtgccccggggcctgcggcccctgctgccccacctgcaggccggcctgtacagaggagagggctggggcgagctgcaccgggcccggacccagggccggggcggcgtcatcggggtcatcatcaactgggactgtgacctggacctgcctgccagcgagtgcaaccccaagtacagcttccggcggctggaccccaagcacgtgcctgccagcagcggctacaacttccgctttgccaagtactacaagatcaatggcaccaccaccaggaccctcatcaaggcctacggcatcagaattgatgtgattgtgcacggccaggccggcaagttcagcctcatccccaccatcatcaacctggccacagccctgacctctgtgggcgtgggcagcttcctgtgtgactggatcctgctgaccttcatgaacaagaacaaggtgtacagccacaagaagtttgacaagatggtggacaccccagccagcgagcccgcccaggccagcacccccacagaccccaagggcctggcccagctgtag

SEQ ID NO: 37271 - DNA, 1056 bp, Artificial Sequence
  Description of Artificial Sequence: Synthetic coding sequence
atggctgaccaggaccctgctggcatcagccccctgcagcagatggtggccagcggcaccggggctgtggtgaccagcctcttcatgacccccctggatgtggtgaaggtgcggctgcagagccagaggcccagcatggccagcgagctgatgcccagcagccggctgtggagcctgagctacaccaagtggaagtgcctgctgtactgcaatggagtgctggagcccctgtacctgtgccccaacggggcccgctgtgccacctggttccaggaccccacccgcttcaccggcaccatggatgcctttgtgaagatcgtgagacatgagggcaccaggaccctgtggagcggcctgcctgccaccctggtgatgacagtgcctgccacagccatctacttcaccgcctatgaccagctgaaggccttcctgtgtggccgggccctgaccagtgacctgtatgcccccatggtggccggggccctggcccggctgggcaccgtgaccgtcatcagccccctggagctgatgaggaccaagctgcaggcccagcacgtgtcctaccgggagctgggcgcctgtgtgaggacagctgtggcccagggcggctggaggagcctgtggctgggctggggccccacagccctgagagatgtgcccttcagcgccctgtactggttcaactatgagctggtgaagtcctggctgaatggcttccggcccaaggaccagacctctgtgggcatgagctttgtggccggcggcatctctggaacagtggccgctgtgctgaccctgccctttgatgtggtgaagacccagaggcaggtggccctgggcgccatggaggccgtgcgggtgaaccccctgcacgtggacagcacctggctgctgctgcggcgcatccgggcagagagcggcaccaagggcctgtttgctggcttcctgccccgcatcatcaaggccgcccccagctgtgccatcatgatcagcacctatgaatttgggaagagcttcttccagaggctgaaccaggaccggctgctgggcggctag

SEQ ID NO: 37272 - DNA, 1299 bp, Artificial Sequence
  Description of Artificial Sequence: Synthetic coding sequence
atgggccaggccggctgcaagggcctgtgcctgagcctgtttgactacaagacagagaagtatgtgattgccaagaacaagaaggtgggcctgctgtaccgcctgctgcaggccagcatcctggcctacctggtggtgtgggtgttcctgatcaagaagggctaccaggatgtggacaccagcctgcagagcgctgtgatcaccaaggtgaagggcgtggccttcaccaacaccagtgacctgggccagaggatctgggatgtggccgactatgtgatcccagcccagggagaaaatgtgttctttgtggtgaccaacctgattgtgacccccaaccagaggcagaatgtgtgtgccgagaatgaaggcatcccagatggagcctgcagcaaggacagcgactgccacgccggggaggccgtgacagctggaaatggagtgaagacaggccgctgcctgcggcgggagaacctggcccggggcacctgtgagatctttgcctggtgccccctggagaccagcagcaggcctgaggagcccttcctgaaggaggccgaggacttcaccatcttcatcaagaaccacatccgcttccccaagttcaacttcagcaagagcaatgtgatggatgtgaaggaccgctccttcctgaagagctgccacttcggccccaagaaccactactgccccatcttccggctgggcagcgtcatccgctgggccggcagtgacttccaggacatcgccctggagggcggcgtgattggcatcaacatcgagtggaactgtgacctggacaaggccgccagcgagtgccacccccactacagcttcagccggctggacaacaagctgagcaagtctgtgagcagcggctacaacttccgctttgcccgctactacagagatgctgctggggtggagttccgcaccctgatgaaggcctacggcatccgctttgatgtgatggtgaatggaaaaggagccttcttctgtgacctggtgctgatctacctgatcaagaagcgggagttctacagagacaagaagtatgaggaggtgcggggcctggaggacagcagccaggaggctgaagatgaggccagcggcctgggcctgtctgagcagctgaccagcggccctggcctgctgggcatgcctgagcagcaggagctgcaggagcccccagaggccaagaggggcagcagcagccagaagggaaatggatctgtgtgcccccagctgctggagccccaccggctgcggaccccatctgccagccccctgcaccaggagtag

SEQ ID NO: 37273 - DNA, 1266 bp, Artificial Sequence
  Description of Artificial Sequence: Synthetic coding sequence
atgggccaggccggctgcaagggcctgtgcctgagcctgtttgactacaagacagagaagtatgtgattgccaagaacaagaaggtgggcctgctgtaccgcctgctgcaggccagcatcctggcctacctggtggtgtgggtgttcctgatcaagaagggctaccaggatgtggacaccagcctgcagagcgctgtgatcaccaaggtgaagggcgtggccttcaccaacaccagtgacctgggccagaggatctgggatgtggccgactatgtgatcccagcccagggagaaaatgtgttctttgtggtgaccaacctgattgtgacccccaaccagaggcagaatgtgtgtgccgagaatgaaggcatcccagatggagcctgcagcaaggacagcgactgccacgccggggaggccgtgacagctggaaatggagtgaagacaggccgctgcctgcggcgggagaacctggcccggggcacctgtgagatctttgcctggtgccccctggagaccagcagcaggcctgaggagcccttcctgaaggaggccgaggacttcaccatcttcatcaagaaccacatccgcttccccaagttcaacttcagcaacaacgtgatggatgtgaaggacaggagcttcctgaagagctgccacttcggccccaagaaccactactgccccatcttccggctgggcagcgtcatccgctgggccggcagtgacttccaggacatcgccctggagggcggcgtcatcggcatcaacatcgagtggaactgtgacctggacaaggccgccagcgagtgccacccccactacagcttcagccggctggacaacaagctgagcaagtctgtgagcagcggctacaacttccgctttgcccgctactacagagatgctgctggggtggagttccgcaccctgatgaaggcctacggcatccgctttgatgtgatggtgaatggcaagggggccttcttctgtgacctggtgctgatctacctgatcaagaagcgggagttctacagagacaagaagtatgaggaggtgcggggcctggaggacagcagccaggaggccgaggatgaggccagcggcctgggcctgtctgagcagctgaccagcggccctggcctgctgggcatgcctgagcagcaggagctgcaggagcccccagaggccaagaggggcagcagcagccagaagggaaatggatctgtgtgcccccagctgctggagccccacaggagcacctag

SEQ ID NO: 37274 - DNA, 1194 bp, Artificial Sequence
  Description of Artificial Sequence: Synthetic coding sequence
atgggccaggccggctgcaagggcctgtgcctgagcctgtttgactacaagacagagaagtatgtgattgccaagaacaagaaggtgggcctgctgtaccgcctgctgcaggccagcatcctggcctacctggtggtgtgggtgttcctgatcaagaagggctaccaggatgtggacaccagcctgcagagcgctgtgatcaccaaggtgaagggcgtggccttcaccaacaccagtgacctgggccagaggatctgggatgtggccgactatgtgatcccagcccagaatgaaggcatcccagatggagcctgcagcaaggacagcgactgccacgccggggaggccgtgacagctggaaatggagtgaagacaggccgctgcctgcggcgggagaacctggcccggggcacctgtgagatctttgcctggtgccccctggagaccagcagcaggcctgaggagcccttcctgaaggaggccgaggacttcaccatcttcatcaagaaccacatccgcttccccaagttcaacttcagcaacaacgtgatggatgtgaaggacaggagcttcctgaagagctgccacttcggccccaagaaccactactgccccatcttccggctgggcagcgtcatccgctgggccggcagtgacttccaggacatcgccctggagggcggcgtcatcggcatcaacatcgagtggaactgtgacctggacaaggccgccagcgagtgccacccccactacagcttcagccggctggacaacaagctgagcaagtctgtgagcagcggctacaacttccgctttgcccgctactacagagatgctgctggggtggagttccgcaccctgatgaaggcctacggcatccgctttgatgtgatggtgaatggcaagggggccttcttctgtgacctggtgctgatctacctgatcaagaagcgggagttctacagagacaagaagtatgaggaggtgcggggcctggaggacagcagccaggaggccgaggatgaggccagcggcctgggcctgtctgagcagctgaccagcggccctggcctgctgggcatgcctgagcagcaggagctgcaggagcccccagaggccaagaggggcagcagcagccagaagggaaatggatctgtgtgcccccagctgctggagccccacaggagcacctag

SEQ ID NO: 37275 - DNA, 1089 bp, Artificial Sequence
  Description of Artificial Sequence: Synthetic coding sequence
atgcccacctaccggccccccagccaccgctgggtgttcctgatcaagaagggctaccaggatgtggacaccagcctgcagagcgctgtgatcaccaaggtgaagggcgtggccttcaccaacaccagtgacctgggccagaggatctgggatgtggccgactatgtgatcccagcccagaatgaaggcatcccagatggagcctgcagcaaggacagcgactgccacgccggggaggccgtgacagctggaaatggagtgaagacaggccgctgcctgcggcgggagaacctggcccggggcacctgtgagatctttgcctggtgccccctggagaccagcagcaggcctgaggagcccttcctgaaggaggccgaggacttcaccatcttcatcaagaaccacatccgcttccccaagttcaacttcagcaagagcaatgtgatggatgtgaaggaccgctccttcctgaagagctgccacttcggccccaagaaccactactgccccatcttccggctgggcagcgtcatccgctgggccggcagtgacttccaggacatcgccctggagggcggcgtgattggcatcaacatcgagtggaactgtgacctggacaaggccgccagcgagtgccacccccactacagcttcagccggctggacaacaagctgagcaagtctgtgagcagcggctacaacttccgctttgcccgctactacagagatgctgctggggtggagttccgcaccctgatgaaggcctacggcatccgctttgatgtgatggtgaatggaaaaggagccttcttctgtgacctggtgctgatctacctgatcaagaagcgggagttctacagagacaagaagtatgaggaggtgcggggcctggaggacagcagccaggaggctgaagatgaggccagcggcctgggcctgtctgagcagctgaccagcggccctggcctgctgggcatgcctgagcagcaggagctgcaggagcccccagaggccaagaggggcagcagcagccagaagggaaatggatctgtgtgcccccagctgctggagccccacaggagcacctag

SEQ ID NO: 37276 - DNA, 1296 bp, Artificial Sequence
  Description of Artificial Sequence: Synthetic coding sequence
atgggcagccctggggccaccaccggctggggcctgctggactacaagacagagaagtatgtgatgaccaggaactggagggtgggcgccctgcagaggctgctgcagtttggaattgtggtgtatgtggtgggctgggccctgctggccaagaagggctaccaggagcgggacctggagccccagttcagcatcatcaccaagctgaagggcgtgtctgtgacccagatcaaggagctgggcaaccggctgtgggatgtggccgactttgtgaagccaccccagggagaaaatgtgttcttcctggtgaccaacttcctggtgaccccagcccaggtgcagggccgctgcccagagcaccccagcgtgcccctggccaactgctgggtggatgaggactgcccagagggggagggcggcacccacagccacggcgtgaagacaggccagtgtgtggtgttcaacggcacccacaggacctgtgagatctggagctggtgccctgtggagagcggcgtggtgcccagccggcccctgctggcccaggcccagaacttcaccctcttcatcaagaacacagtgaccttcagcaagttcaacttcagcaagagcaatgccctggagacctgggaccccacctacttcaagcactgccgctatgagccccagttcagcccctactgccctgtgttcagaattggagacctggtggccaaggccggcggcacctttgaggacctggccctgctgggcggctctgtgggcatccgggtgcactgggactgtgacctggacaccggggacagcggctgctggccccactacagcttccagctgcaggagaagagctacaacttcagaacagccacccactggtgggagcagcccggggtggaggcccggaccctgctgaagctgtatggcatccgctttgacatcctggtgacaggccaggccggcaagtttggcctcatccccacagctgtgaccctgggcactggagctgcctggctgggcgtggtgaccttcttctgtgacctgctgctgctgtatgtggaccgggaggcccacttctactggaggaccaagtatgaggaggccaaggcccccaaggccacagccaacagcgtgtggagggagctggccctggccagccaggcccggctggctgaatgtctgcggcgcagcagcgccccagcccccacagccacagctgctggcagccagacccagaccccaggctggccctgccccagcagtgacacccacctgcccacccacagcggcagcctgtag

SEQ ID NO: 37277 - DNA, 213 bp, Artificial Sequence
  Description of Artificial Sequence: Synthetic coding sequence
atgggcagccctggggccaccaccggctggggcctgctggactacaagacagagaagtgggccctgctggccaagaagggctaccaggagcgggacctggagccccagttcagcatcatcaccaagctgaagggcgtgtctgtgacccagatcaaggagctgggcaaccggctgtgggatgtggccgactttgtgaagccaccccaggtgtag

SEQ ID NO: 37278 - DNA, 1326 bp, Artificial Sequence
  Description of Artificial Sequence: Synthetic coding sequence
atgtgcccccagctggccggggccggctccatgggcagccctggggccaccaccggctggggcctgctggactacaagacagagaagtatgtgatgaccaggaactggagggtgggcgccctgcagaggctgctgcagtttggaattgtggtgtatgtggtgggctgggccctgctggccaagaagggctaccaggagcgggacctggagccccagttcagcatcatcaccaagctgaagggcgtgtctgtgacccagatcaaggagctgggcaaccggctgtgggatgtggccgactttgtgaagccaccccagggagaaaatgtgttcttcctggtgaccaacttcctggtgaccccagcccaggtgcagggccgctgcccagagcaccccagcgtgcccctggccaactgctgggtggatgaggactgcccagagggggagggcggcacccacagccacggcgtgaagacaggccagtgtgtggtgttcaacggcacccacaggacctgtgagatctggagctggtgccctgtggagagcggcgtggtgcccagccggcccctgctggcccaggcccagaacttcaccctcttcatcaagaacacagtgaccttcagcaagttcaacttcagcaagagcaatgccctggagacctgggaccccacctacttcaagcactgccgctatgagccccagttcagcccctactgccctgtgttcagaattggagacctggtggccaaggccggcggcacctttgaggacctggccctgctgggcggctctgtgggcatccgggtgcactgggactgtgacctggacaccggggacagcggctgctggccccactacagcttccagctgcaggagaagagctacaacttcagaacagccacccactggtgggagcagcccggggtggaggcccggaccctgctgaagctgtatggcatccgctttgacatcctggtgacaggccaggccggcaagtttggcctcatccccacagctgtgaccctgggcactggagctgcctggctgggcgtggtgaccttcttctgtgacctgctgctgctgtatgtggaccgggaggcccacttctactggaggaccaagtatgaggaggccaaggcccccaaggccacagccaacagcgtgtggagggagctggccctggccagccaggcccggctggctgaatgtctgcggcgcagcagcgccccagcccccacagccacagctgctggcagccagacccagaccccaggctggccctgccccagcagtgacacccacctgcccacccacagcggcagcctgtag

SEQ ID NO: 37279 - DNA, 243 bp, Artificial Sequence
  Description of Artificial Sequence: Synthetic coding sequence
atgtgcccccagctggccggggccggctccatgggcagccctggggccaccaccggctggggcctgctggactacaagacagagaagtgggccctgctggccaagaagggctaccaggagcgggacctggagccccagttcagcatcatcaccaagctgaagggcgtgtctgtgacccagatcaaggagctgggcaaccggctgtgggatgtggccgactttgtgaagccaccccaggtgtag

SEQ ID NO: 37280 - DNA, 1167 bp, Artificial Sequence
  Description of Artificial Sequence: Synthetic coding sequence
atgtggtgggccctgctggccaagaagggctaccaggagcgggacctggagccccagttcagcatcatcaccaagctgaagggcgtgtctgtgacccagatcaaggagctgggcaaccggctgtgggatgtggccgactttgtgaagccaccccagggagaaaatgtgttcttcctggtgaccaacttcctggtgaccccagcccaggtgcagggccgctgcccagagcaccccagcgtgcccctggccaactgctgggtggatgaggactgcccagagggggagggcggcacccacagccatggagtgaagacaggccagtgtgtggtgttcaacggcacccacaggacctgtgagatctggagctggtgccctgtggagagcggcgtggtgcccagccggcccctgctggcccaggcccagaacttcaccctcttcatcaagaacacagtgaccttcagcaagttcaacttcagcaagagcaatgccctggagacctgggaccccacctacttcaagcactgccgctatgagccccagttcagcccctactgccctgtgttccgcatcggggacctggtggccaaggccggcggcacctttgaggacctggccctgctgggcggctctgtgggcatccgggtgcactgggactgtgacctggacacaggagacagcggctgctggccccactacagcttccagctgcaggagaagagctacaacttcagaacagccacccactggtgggagcagcccggggtggaggcccggaccctgctgaagctgtatggcatccgctttgacatcctggtgacaggccaggccggcaagtttggcctcatccccacagctgtgaccctgggcaccggggccgcctggctgggcgtggtgaccttcttctgtgacctgctgctgctgtatgtggaccgggaggcccacttctactggaggaccaagtatgaggaggccaaggcccccaaggccacagccaacagcgtgtggagggagctggccctggccagccaggcccggctggccgagtgcctgcggcgcagcagcgccccagcccccacagccacagctgctggcagccagacccagaccccaggctggccctgccccagcagtgacacccacctgcccacccacagcggcagcctgtag

SEQ ID NO: 37281 - DNA, 1020 bp, Artificial Sequence
  Description of Artificial Sequence: Synthetic coding sequence
atggccaacctggacaagtacacagagaccttcaagatgggcagcaacagcaccagcacagctgagatctactgcaatgtgaccaacgtgaagttccagtacagcctgtatgccaccacctacatcctgatcttcatccctggcctgctggccaacagcgctgccctgtgggtgctgtgccgcttcatcagcaagaagaacaaggccatcatcttcatgatcaacctgtctgtggccgacctggcccacgtgctgagcctgcccctgcgcatctactactacatcagccaccactggcccttccagagggccctgtgcctgctgtgcttctacctgaagtacctgaacatgtatgccagcatctgcttcctgacctgcatcagcctgcagcgctgcttcttcctgctgaagcccttccgggcccgggactggaagagaagatatgatgtgggcatctctgctgccatctggatcgtggtgggcacagcctgcctgcccttccccatcctgcggagcacagacctgaacaacaacaagagctgctttgctgacctgggctacaagcagatgaatgctgtggccctggtgggcatgatcaccgtggccgagctggccggctttgtgattcctgtgatcatcatcgcctggtgcacctggaagaccaccatcagcctgcggcagccccccatggccttccagggcatcagcgagcggcagaaggccctgaggatggtgttcatgtgtgccgctgtgttcttcatctgcttcaccccctaccacatcaacttcatcttctacaccatggtgaaggagaccatcatcagcagctgccctgtggtgcgcatcgccctgtacttccaccccttctgcctgtgcctggccagcctgtgctgcctgctggaccccatcctgtactacttcatggccagcgagttccgggaccagctgagcagacatggcagctctgtgaccaggagccggctgatgagcaaggagagcggcagctccatgattggatag

SEQ ID NO: 37282 - DNA, 1020 bp, Artificial Sequence; identical to SEQ ID NO: 37281
  Description of Artificial Sequence: Synthetic coding sequence

SEQ ID NO: 37283 - DNA, 1065 bp, Artificial Sequence
  Description of Artificial Sequence: Synthetic coding sequence
atgacagctgccatccggcggcagcgggagctgagcatcctgcccaaggtgaccctggaggccatgaacaccaccgtgatgcagggcttcaacagaagtgagcgctgcccccgggacacccgcatcgtgcagctggtgtttcctgccctgtacacagtggtgttcctgaccggcatcctgctgaacaccctggccctgtgggtgtttgtgcacatccccagcagcagcaccttcatcatctacctgaagaacaccctggtggccgacctgatcatgaccctgatgctgcccttcaagatcctgagtgacagccacctggccccctggcagctgcgggcctttgtgtgccgcttcagcagcgtcatcttctatgagaccatgtatgtgggcatcgtgctgctgggcctgattgcctttgaccgcttcctgaagatcatccggcccctgaggaacatcttcctgaagaagcctgtgtttgccaagacagtgtccatcttcatctggttcttcctgttcttcatcagcctgcccaacaccatcctgagcaacaaggaggccacccccagctctgtgaagaagtgtgccagcctgaagggccccctgggcctgaagtggcaccagatggtgaacaacatctgccagttcatcttctggacagtgttcatcctgatgctggtgttctacgtggtgattgccaagaaggtgtatgacagctacaggaagagcaagagcaaggacaggaagaacaacaagaagctggagggcaaggtgtttgtggtggtggccgtgttctttgtgtgctttgcccccttccactttgcccgggtgccctacacccacagccagaccaacaacaagacagactgccgcctgcagaaccagctgttcatcgccaaggagaccaccctcttcctggccgccaccaacatctgcatggaccccctcatctacatcttcctgtgcaagaagttcacagagaagctgccctgcatgcagggcaggaagaccacagccagcagccaggagaaccacagcagccagacagacaacatcaccctgggctag

SEQ ID NO: 37284 - DNA, 1017 bp, Artificial Sequence
  Description of Artificial Sequence: Synthetic coding sequence
atgatcaacagcaccagcacccagcccccagatgagagctgcagccagaacctgctgatcacccagcagatcatccctgtgctgtactgcatggtgttcatcgccggcatcctgctgaatggagtgtctggctggatcttcttctacgtgcccagcagcaagagcttcatcatctacctgaagaacatcgtgattgctgactttgtgatgagcctgaccttccccttcaagatcctgggggacagcggcctgggcccctggcagctgaatgtgtttgtgtgccgggtgtctgctgtgctcttctacgtgaacatgtatgtgtccatcgtgttcttcggcctcatcagctttgaccgctactacaagatcgtgaagcccctgtggaccagcttcatccagagcgtgtcctacagcaagctgctgagcgtcatcgtgtggatgctgatgctgctgctggccgtgcccaacatcatcctgaccaaccagagcgtgcgggaggtgacccagatcaagtgcatcgagctgaagtctgagctgggcaggaagtggcacaaggccagcaactacatctttgtggccatcttctggatcgtgttcctgctgctgattgtgttctacacagccatcaccaagaagatcttcaagagccacctgaagagcagcaggaacagcacctctgtgaagaagaagagcagcaggaacatcttcagcatcgtgtttgtgttctttgtgtgctttgtgccctaccacatcgcccgcatcccctacaccaagagccagacagaggcccactacagctgccagagcaaggagatcctgcgctacatgaaggagttcaccctgctgctgtctgctgccaacgtgtgcctggaccccatcatctacttcttcctgtgccagcccttccgggagatcctgtgcaagaagctgcacatccccctgaaggcccagaatgacctggacatcagccgcatcaagaggggcaacaccaccctggagagcacagacaccctgtag

SEQ ID NO: 37285 - DNA, 1017 bp, Artificial Sequence; identical to SEQ ID NO: 37284
  Description of Artificial Sequence: Synthetic coding sequence

SEQ ID NO: 37286 - DNA, 291 bp, Artificial Sequence
  Description of Artificial Sequence: Synthetic coding sequence
atgatcaacagcaccagcacccagcccccagatgagagctgcagccagaacctgctgatcacccagcagatcatccctgtgctgtactgcatggtgttcatcgccggcatcctgctgaatggagtgtctggctggatcttcttctacgtgcccagcagcaagagcttcatcatctacctgaagaacatcgtgattgctgactttgtgatgagcctgaccttccccttcaagatcctgggggacagcggcctgggcccctggcagctgaatgtgtttgtgtgccgggtgtag

SEQ ID NO: 37287 - DNA, 2358 bp, Artificial Sequence
  Description of Artificial Sequence: Synthetic coding sequence
atggccagcaaggtgacagatgccatcgtgtggtaccagaagaaggagttcctgtctgtggccaccacagcccctggcccccagcaggtgctgcccggctactgccagtgcagcctgaaggaccagggcctcttcatccagtgcctgattggagcctatgaccagcagatctgggagaagtctgtggagcagcgggagatcaagttcatcaagctgggcctgaggaacaagcccaagaagacagcccacgtgaagccagacctgattgatgtggacctggtgcggggcagcgcctttgccaaggccaagccagagagcccctggaccagcctgaccaggaagggcatcgtgcgggtggtgttcttccccttcttcttccgctggtggctgcaggtgaccagcaaggtgatcttcttctggctgctggtgctgtacctgctgcaggtggccgccatcgtgctcttctgcagcaccagcagcccccacagcatccccctgacagaggtgattggccccatctggctgatgctgctgctgggcaccgtgcactgccagatcgtgtccaccaggacccccaagccacccctgagcactggaggcaagagaagaaggaagctgaggaaggccgcccacctggaggtgcaccgggagggagatggcagcagcaccacagacaacacccaggagggcgctgtgcagaaccacggcaccagcaccagccacagcgtgggcaccgtcttccgggacctgtggcatgctgccttcttcctgagcggcagcaagaaggccaagaacagcattgacaagagcacagaaacagacaatggctacgtgtccctggatggcaagaagacagtgaagagcggggaggatggcatccagaaccacgagccccagtgtgagaccatccggcctgaggagacagcctggaacacaggcaccctgagaaatggccccagcaaggacacccagaggaccatcaccaacgtgtctgatgaggtgagcagcgaggagggccctgagaccggctacagcctgcggagacatgtggacaggaccagcgagggcgtgctgaggaacaggaagagccaccactacaagaagcactacccaaatgaagatgcccccaagagcggcaccagctgcagcagccgctgcagcagcagccggcaggacagcgagagcgcccggcctgagagcgagacagaagatgtgctgtgggaggacctgctgcactgtgccgagtgccacagcagctgcaccagcgagacagatgtggagaaccaccagatcaacccctgtgtgaagaaggagtacagagatgaccccttccaccagagccacctgccctggctgcacagcagccaccctggcctggagaagatcagcgccatcgtgtgggagggcaatgactgcaagaaggctgacatgtctgtgctggagatcagcggcatgatcatgaacagagtgaacagccacatccctggcatcggctaccagatctttggaaatgctgtgtccctcatcctgggcctgaccccatttgtgttccggctgagccaggccacagacctggagcagctgacagcccacagcgccagcgagctgtatgtgattgccttcggcagcaatgaagatgtgattgtgctgtccatggtgatcatcagctttgtggtgcgggtgtccctggtgtggatcttcttcttcctgctgtgtgtggccgagaggacctacaagcagaggctgctgtttgccaagctgtttggccacctgaccagcgcccggcgggccaggaagtctgaggtgccccacttccggctgaagaaggtgcagaacatcaagatgtggctgagcctgcggagctacctgaagagaagaggcccccagaggtctgtggatgtgattgtgagcagcgccttcctgctgaccatctctgtggtgttcatctgctgtgcccagctgctgcacgtgcatgagatcttcctggactgccactacaactgggagctggtgatctggtgcatcagcctgaccctcttcctgctgcgctttgtgaccctgggcagcgagaccagcaagaagtacagcaacaccagcatcctgctgacagagcagatcaacctgtacctgaagatggagaagaagcccaacaagaaggaggagctgaccctggtgaacaacgtgctgaagctggccaccaagctgctgaaggagctggacagccccttccggctgtatggcctgaccatgaaccccctgctgtacaacatcacccaggtggtgatcctgtctgctgtgtctggagtcatcagtgacctgctgggcttcaacctgaagctgtggaagatcaagagctag

SEQ ID NO: 37288 - DNA, 2088 bp, Artificial Sequence
  Description of Artificial Sequence: Synthetic coding sequence
atggccagcaaggtgacagatgccatcgtgtggtaccagaagaagatcggggcctatgaccagcagatctgggagaagtctgtggagcagcgggagatcaagggcctgaggaacaagcccaagaagacagcccacgtgaagccagacctgattgatgtggacctggtgcggggcagcgcctttgccaaggccaagccagagagcccctggaccagcctgaccaggaagggcatcgtgcgggtggtgttcttccccttcttcttccgctggtggctgcaggtgaccagcaaggtgatcttcttctggctgctggtgctgtacctgctgcaggtggccgccatcgtgctcttctgcagcaccagcagcccccacagcatccccctgacagaggtgattggccccatctggctgatgctgctgctgggcaccgtgcactgccagatcgtgtccaccaggacccccaagccacccctgagcactggaggcaagagaagaaggaagctgaggaaggccgcccacctggaggtgcaccgggagggagatggcagcagcaccacagacaacacccaggagggcgctgtgcagaaccacggcaccagcaccagccacagcgtgggcaccgtcttccgggacctgtggcatgctgccttcttcctgagcggcagcaagaaggccaagaacagcattgacaagagcacagaaacagacaatggctacgtgtccctggatggcaagaagacagtgaagagcggggaggatggcatccagaaccacgagccccagtgtgagaccatccggcctgaggagacagcctggaacacaggcaccctgagaaatggccccagcaaggacacccagaggaccatcaccaacgtgtctgatgaggtgagcagcgaggagggccctgagaccggctacagcctgcggagacatgtggacaggaccagcgagggcgtgctgaggaacaggaagagccaccactacaagaagcactacccaaatgaagatgcccccaagagcggcaccagctgcagcagccgctgcagcagcagccggcaggacagcgagagcgcccggcctgagagcgagacagaagatgtgctgtgggaggacctgctgcactgtgccgagtgccacagcagctgcaccagcgagacagatgtggagaaccaccagatcaacccctgtgtgaagaaggagtacagagatgaccccttccaccagagccacctgccctggctgcacagcagccaccctggcctggagaagatcagcgccatcgtgtgggagggcaatgactgcaagaaggctgacatgtctgtgctggagatcagcggcatgatcatgaacagagtgaacagccacatccctggcatcggctaccagatctttggaaatgctgtgtccctcatcctgggcctgaccccatttgtgttccggctgagccaggccacagacctggagcagctgacagcccacagcgccagcgagctgtatgtgattgccttcggcagcaatgaagatgtgattgtgctgtccatggtgatcatcagctttgtggtgcgggtgtccctggtgtggatcttcttcttcctgctgtgtgtggccgagaggacctacaagcagaggctgctgtttgccaagctgtttggccacctgaccagcgcccggcgggccaggaagtctgaggtgccccacttccggctgaagaaggtgcagaacatcaagatgtggctgagcctgcggagctacctgaagagaagaggcccccagaggtctgtggatgtgattgtgagcagcgccttcctgctgaccatctctgtggtgttcatctgctgtgcccagatcaacctgtacctgaagatggagaagaagcccaacaagaaggaggagctgaccctggtgaacaacgtgctgaagctggccaccaagctgctgaaggagctggacagccccttccggctgtatggcctgaccatgaaccccctgctgtacaacatcacccaggtggtgatcctgtctgctgtgtctggagtcatcagtgacctgctgggcttcaacctgaagctgtggaagatcaagagctag

SEQ ID NO: 37289 - DNA, 2244 bp, Artificial Sequence
  Description of Artificial Sequence: Synthetic coding sequence
atggccagcaaggtgacagatgccatcgtgtggtaccagaagaagatcggggcctatgaccagcagatctgggagaagtctgtggagcagcgggagatcaagggcctgaggaacaagcccaagaagacagcccacgtgaagccagacctgattgatgtggacctggtgcggggcagcgcctttgccaaggccaagccagagagcccctggaccagcctgaccaggaagggcatcgtgcgggtggtgttcttccccttcttcttccgctggtggctgcaggtgaccagcaaggtgatcttcttctggctgctggtgctgtacctgctgcaggtggccgccatcgtgctcttctgcagcaccagcagcccccacagcatccccctgacagaggtgattggccccatctggctgatgctgctgctgggcaccgtgcactgccagatcgtgtccaccaggacccccaagccacccctgagcactggaggcaagagaagaaggaagctgaggaaggccgcccacctggaggtgcaccgggagggagatggcagcagcaccacagacaacacccaggagggcgctgtgcagaaccacggcaccagcaccagccacagcgtgggcaccgtcttccgggacctgtggcatgctgccttcttcctgagcggcagcaagaaggccaagaacagcattgacaagagcacagaaacagacaatggctacgtgtccctggatggcaagaagacagtgaagagcggggaggatggcatccagaaccacgagccccagtgtgagaccatccggcctgaggagacagcctggaacacaggcaccctgagaaatggccccagcaaggacacccagaggaccatcaccaacgtgtctgatgaggtgagcagcgaggagggccctgagaccggctacagcctgcggagacatgtggacaggaccagcgagggcgtgctgaggaacaggaagagccaccactacaagaagcactacccaaatgaagatgcccccaagagcggcaccagctgcagcagccgctgcagcagcagccggcaggacagcgagagcgcccggcctgagagcgagacagaagatgtgctgtgggaggacctgctgcactgtgccgagtgccacagcagctgcaccagcgagacagatgtggagaaccaccagatcaacccctgtgtgaagaaggagtacagagatgaccccttccaccagagccacctgccctggctgcacagcagccaccctggcctggagaagatcagcgccatcgtgtgggagggcaatgactgcaagaaggctgacatgtctgtgctggagatcagcggcatgatcatgaacagagtgaacagccacatccctggcatcggctaccagatctttggaaatgctgtgtccctcatcctgggcctgaccccatttgtgttccggctgagccaggccacagacctggagcagctgacagcccacagcgccagcgagctgtatgtgattgccttcggcagcaatgaagatgtgattgtgctgtccatggtgatcatcagctttgtggtgcgggtgtccctggtgtggatcttcttcttcctgctgtgtgtggccgagaggacctacaagcagaggctgctgtttgccaagctgtttggccacctgaccagcgcccggcgggccaggaagtctgaggtgccccacttccggctgaagaaggtgcagaacatcaagatgtggctgagcctgcggagctacctgaagagaagaggcccccagaggtctgtggatgtgattgtgagcagcgccttcctgctgaccatctctgtggtgttcatctgctgtgcccagctgctgcacgtgcatgagatcttcctggactgccactacaactgggagctggtgatctggtgcatcagcctgaccctcttcctgctgcgctttgtgaccctgggcagcgagaccagcaagaagtacagcaacaccagcatcctgctgacagagcagatcaacctgtacctgaagatggagaagaagcccaacaagaaggaggagctgaccctggtgaacaacgtgctgaagctggccaccaagctgctgaaggagctggacagccccttccggctgtatggcctgaccatgaaccccctgctgtacaacatcacccaggtggtgatcctgtctgctgtgtctggagtcatcagtgacctgctgggcttcaacctgaagctgtggaagatcaagagctag

SEQ ID NO: 37290 - DNA, 2256 bp, Artificial Sequence
  Description of Artificial Sequence: Synthetic coding sequence
atggccagcaaggtgacagatgccatcgtgtggtaccagaagaagatcggggcctatgaccagcagatctgggagaagtctgtggagcagcgggagatcaagttcatcaagctgggcctgaggaacaagcccaagaagacagcccacgtgaagccagacctgattgatgtggacctggtgcggggcagcgcctttgccaaggccaagccagagagcccctggaccagcctgaccaggaagggcatcgtgcgggtggtgttcttccccttcttcttccgctggtggctgcaggtgaccagcaaggtgatcttcttctggctgctggtgctgtacctgctgcaggtggccgccatcgtgctcttctgcagcaccagcagcccccacagcatccccctgacagaggtgattggccccatctggctgatgctgctgctgggcaccgtgcactgccagatcgtgtccaccaggacccccaagccacccctgagcactggaggcaagagaagaaggaagctgaggaaggccgcccacctggaggtgcaccgggagggagatggcagcagcaccacagacaacacccaggagggcgctgtgcagaaccacggcaccagcaccagccacagcgtgggcaccgtcttccgggacctgtggcatgctgccttcttcctgagcggcagcaagaaggccaagaacagcattgacaagagcacagaaacagacaatggctacgtgtccctggatggcaagaagacagtgaagagcggggaggatggcatccagaaccacgagccccagtgtgagaccatccggcctgaggagacagcctggaacacaggcaccctgagaaatggccccagcaaggacacccagaggaccatcaccaacgtgtctgatgaggtgagcagcgaggagggccctgagaccggctacagcctgcggagacatgtggacaggaccagcgagggcgtgctgaggaacaggaagagccaccactacaagaagcactacccaaatgaagatgcccccaagagcggcaccagctgcagcagccgctgcagcagcagccggcaggacagcgagagcgcccggcctgagagcgagacagaagatgtgctgtgggaggacctgctgcactgtgccgagtgccacagcagctgcaccagcgagacagatgtggagaaccaccagatcaacccctgtgtgaagaaggagtacagagatgaccccttccaccagagccacctgccctggctgcacagcagccaccctggcctggagaagatcagcgccatcgtgtgggagggcaatgactgcaagaaggctgacatgtctgtgctggagatcagcggcatgatcatgaacagagtgaacagccacatccctggcatcggctaccagatctttggaaatgctgtgtccctcatcctgggcctgaccccatttgtgttccggctgagccaggccacagacctggagcagctgacagcccacagcgccagcgagctgtatgtgattgccttcggcagcaatgaagatgtgattgtgctgtccatggtgatcatcagctttgtggtgcgggtgtccctggtgtggatcttcttcttcctgctgtgtgtggccgagaggacctacaagcagaggctgctgtttgccaagctgtttggccacctgaccagcgcccggcgggccaggaagtctgaggtgccccacttccggctgaagaaggtgcagaacatcaagatgtggctgagcctgcggagctacctgaagagaagaggcccccagaggtctgtggatgtgattgtgagcagcgccttcctgctgaccatctctgtggtgttcatctgctgtgcccagctgctgcacgtgcatgagatcttcctggactgccactacaactgggagctggtgatctggtgcatcagcctgaccctcttcctgctgcgctttgtgaccctgggcagcgagaccagcaagaagtacagcaacaccagcatcctgctgacagagcagatcaacctgtacctgaagatggagaagaagcccaacaagaaggaggagctgaccctggtgaacaacgtgctgaagctggccaccaagctgctgaaggagctggacagccccttccggctgtatggcctgaccatgaaccccctgctgtacaacatcacccaggtggtgatcctgtctgctgtgtctggagtcatcagtgacctgctgggcttcaacctgaagctgtggaagatcaagagctag

SEQ ID NO: 37291 - DNA, 2256 bp, Artificial Sequence; identical to SEQ ID NO: 37290
  Description of Artificial Sequence: Synthetic coding sequence

SEQ ID NO: 37292 - DNA, 2256 bp, Artificial Sequence
  Description of Artificial Sequence: Synthetic coding sequence
atggccagcaaggtgacagatgccatcgtgtggtaccagaagaagatcggggcctatgaccagcagatctgggagaagtctgtggagcagcgggagatcaagttcatcaagtatggcctgaggaacaagcccaagaagacagcccacgtgaagccagacctgattgatgtggacctggtgcggggcagcgcctttgccaaggccaagccagagagcccctggaccagcctgaccaggaagggcatcgtgcgggtggtgttcttccccttcttcttccgctggtggctgcaggtgaccagcaaggtgatcttcttctggctgctggtgctgtacctgctgcaggtggccgccatcgtgctcttctgcagcaccagcagcccccacagcatccccctgacagaggtgattggccccatctggctgatgctgctgctgggcaccgtgcactgccagatcgtgtccaccaggacccccaagccacccctgagcactggaggcaagagaagaaggaagctgaggaaggccgcccacctggaggtgcaccgggagggagatggcagcagcaccacagacaacacccaggagggcgctgtgcagaaccacggcaccagcaccagccacagcgtgggcaccgtcttccgggacctgtggcatgctgccttcttcctgagcggcagcaagaaggccaagaacagcattgacaagagcacagaaacagacaatggctacgtgtccctggatggcaagaagacagtgaagagcggggaggatggcatccagaaccacgagccccagtgtgagaccatccggcctgaggagacagcctggaacacaggcaccctgagaaatggccccagcaaggacacccagaggaccatcaccaacgtgtctgatgaggtgagcagcgaggagggccctgagaccggctacagcctgcggagacatgtggacaggaccagcgagggcgtgctgaggaacaggaagagccaccactacaagaagcactacccaaatgaagatgcccccaagagcggcaccagctgcagcagccgctgcagcagcagccggcaggacagcgagagcgcccggcctgagagcgagacagaagatgtgctgtgggaggacctgctgcactgtgccgagtgccacagcagctgcaccagcgagacagatgtggagaaccaccagatcaacccctgtgtgaagaaggagtacagagatgaccccttccaccagagccacctgccctggctgcacagcagccaccctggcctggagaagatcagcgccatcgtgtgggagggcaatgactgcaagaaggctgacatgtctgtgctggagatcagcggcatgatcatgaacagagtgaacagccacatccctggcatcggctaccagatctttggaaatgctgtgtccctcatcctgggcctgaccccatttgtgttccggctgagccaggccacagacctggagcagctgacagcccacagcgccagcgagctgtatgtgattgccttcggcagcaatgaagatgtgattgtgctgtccatggtgatcatcagctttgtggtgcgggtgtccctggtgtggatcttcttcttcctgctgtgtgtggccgagaggacctacaagcagaggctgctgtttgccaagctgtttggccacctgaccagcgcccggcgggccaggaagtctgaggtgccccacttccggctgaagaaggtgcagaacatcaagatgtggctgagcctgcggagctacctgaagagaagaggcccccagaggtctgtggatgtgattgtgagcagcgccttcctgctgaccatctctgtggtgttcatctgctgtgcccagctgctgcacgtgcatgagatcttcctggactgccactacaactgggagctggtgatctggtgcatcagcctgaccctcttcctgctgcgctttgtgaccctgggcagcgagaccagcaagaagtacagcaacaccagcatcctgctgacagagcagatcaacctgtacctgaagatggagaagaagcccaacaagaaggaggagctgaccctggtgaacaacgtgctgaagctggccaccaagctgctgaaggagctggacagccccttccggctgtatggcctgaccatgaaccccctgctgtacaacatcacccaggtggtgatcctgtctgctgtgtctggagtcatcagtgacctgctgggcttcaacctgaagctgtggaagatcaagagctag

SEQ ID NO: 37293 - DNA, 1059 bp, Artificial Sequence
  Description of Artificial Sequence: Synthetic coding sequence
atggccagcaaggtgacagatgccatcgtgtggtaccagaagaagatcggggcctatgaccagcagatctgggagaagtctgtggagcagcgggagatcaagggcctgaggaacaagcccaagaagacagcccacgtgaagccagacctgattgatgtggacctggtgcggggcagcgcctttgccaaggccaagccagagagcccctggaccagcctgaccaggaagggcatcgtgcgggtggtgttcttccccttcttcttccgctggtggctgcaggtgaccagcaaggtgatcttcttctggctgctggtgctgtacctgctgcaggtggccgccatcgtgctcttctgcagcaccagcagcccccacagcatccccctgacagaggtgattggccccatctggctgatgctgctgctgggcaccgtgcactgccagatcgtgtccaccaggacccccaagccacccctgagcactggaggcaagagaagaaggaagctgaggaaggccgcccacctggaggtgcaccgggagggagatggcagcagcaccacagacaacacccaggagggcgctgtgcagaaccacggcaccagcaccagccacagcgtgggcaccgtcttccgggacctgtggcatgctgccttcttcctgagcggcagcaagaaggccaagaacagcattgacaagagcacagaaacagacaatggctacgtgtccctggatggcaagaagacagtgaagagcggggaggatggcatccagaaccacgagccccagtgtgagaccatccggcctgaggagacagcctggaacacaggcaccctgagaaatggccccagcaaggacacccagaggaccatcaccaacgtgtctgatgaggtgagcagcgaggagggccctgagaccggctacagcctgcggagacatgtggacaggaccagcgagggcgtgctgaggaacaggaagagccaccactacaagaagcactacccaaatgaggtgtacaccctgagcctgtctgtgtacatccgcatctacttcatctgctactag

SEQ ID NO: 37294 - DNA, 1071 bp, Artificial Sequence
  Description of Artificial Sequence: Synthetic coding sequence
atggccagcaaggtgacagatgccatcgtgtggtaccagaagaagatcggggcctatgaccagcagatctgggagaagtctgtggagcagcgggagatcaagttcatcaagctgggcctgaggaacaagcccaagaagacagcccacgtgaagccagacctgattgatgtggacctggtgcggggcagcgcctttgccaaggccaagccagagagcccctggaccagcctgaccaggaagggcatcgtgcgggtggtgttcttccccttcttcttccgctggtggctgcaggtgaccagcaaggtgatcttcttctggctgctggtgctgtacctgctgcaggtggccgccatcgtgctcttctgcagcaccagcagcccccacagcatccccctgacagaggtgattggccccatctggctgatgctgctgctgggcaccgtgcactgccagatcgtgtccaccaggacccccaagccacccctgagcactggaggcaagagaagaaggaagctgaggaaggccgcccacctggaggtgcaccgggagggagatggcagcagcaccacagacaacacccaggagggcgctgtgcagaaccacggcaccagcaccagccacagcgtgggcaccgtcttccgggacctgtggcatgctgccttcttcctgagcggcagcaagaaggccaagaacagcattgacaagagcacagaaacagacaatggctacgtgtccctggatggcaagaagacagtgaagagcggggaggatggcatccagaaccacgagccccagtgtgagaccatccggcctgaggagacagcctggaacacaggcaccctgagaaatggccccagcaaggacacccagaggaccatcaccaacgtgtctgatgaggtgagcagcgaggagggccctgagaccggctacagcctgcggagacatgtggacaggaccagcgagggcgtgctgaggaacaggaagagccaccactacaagaagcactacccaaatgaggtgtacaccctgagcctgtctgtgtacatccgcatctacttcatctgctactag

SEQ ID NO: 37295 - DNA, 1449 bp, Artificial Sequence
  Description of Artificial Sequence: Synthetic coding sequence
atggccaggaagctgtctgtgctggaggtgctgctgatcatcttctgcctgattgtggtgaccatcgacatcctgctgctgctgctggtgctggaggagaccagtgacaccagcttcaccccagagtgcccagagatcccccagagcgagagaattgactgcaccccagaccaggaggtgacagaggacatctgccgctggcagtacaagtgctgctggagccctgtggctgatgccaacgtgccccgctgcttcttcccctggaactggggctatgaggccagcaatggccacaccaacaccagcacaggcttcaccgcccagctgaagaggctgcccagccccagcctgtttggaaatgatgtggccaccaccctcttcaccgctgagtaccagaccagcaaccgcttccacttcaagatcacagacttcaacaacatccgctatgaggtgtcccatgagaacatcaacctggtggatggcattgctgatgccagcaacctgagctactacgtggaggtgacagacaagcccttcagcatcaagatcatgaggaccagcaacagaagagtgctgctggacaccagcatcggccccctgcagtttgcccagcagtacctgcagctgtccttccggctgcccagcgccaacgtgtatggcctgggggagcacgtgcaccagcagtaccgccacaacatgacctggaagacctggcccatcttcaccagagatgccacccccacagagggcatgatcaacctgtatggagcccacaccttcttcctgtgcctggaggatgcccggggcagcagctttggagtcttcctgatgaacagcaatgccatggaggtgaccctgcagcctgccccagccatcacctaccgcaccatcggcggcatcctggacttctacgtgttcctgggcaacaccccagagcaggtggtgcaggagtacctggagctggtgggccggcccttcttccccccctactggagcctgggcttccagctgagcagaagagattatggaggcatcaacaagctgaaggaggtggtgtccaggaaccggctggccgagatcccctatgatgtgcagtacagcgacatcgactacatggatggcaagaaggacttcaccgtggatgaggtggcctacagcggcctgcctgactttgtgaaggagctgcatgacaatggccagaagtacctgatcatcatgaaccctggcatcagcaagaacagcaactatgagccctacaacaacggcagcctgaagagggtgtggatcctgggcagcaatggatttgctgtgggggagggctacccaggccccaccgtcttcccagactacaccaaccctgtgtgcacagagtggtggacagaccaggtggccaagttccatgaccacctggagtttgatggagtgtggatcgtgtcctactacagctag

SEQ ID NO: 37296 - DNA, 1941 bp, Artificial Sequence
  Description of Artificial Sequence: Synthetic coding sequence
atgttcctgagcatcagcacccggctgcccagccagtacatctacggctttggagaaacagagcacaccaccttcagaagaaacatgaactggaacacctggggcatgtttgcccatgatgagcccccagcctacaagaagaacagctatggagtgcacccctactacatggccctggaggaggatggcagcgcccacggcgtgctgctgctgaacagcaatgccatggatgtgaccctgcagcccaccccagccctgacctaccgcaccactggaggcatcctggacttctacatcgtgctgggccccaccccagagctggtgacccagcagtacacagagctgattggccgcccagccatgatcccctactgggccctgggcttccacctgagccgctatggctaccagaatgatgctgagatcagcagcctgtatgatgccatggtggccgcccagatcccctatgatgtgcagcacgtggacatcgactacatgaacaggaagctggacttcaccctgagcgccaacttccagaacctgagcctgctgattgagcagatgaagaagaatggcatgaggttcatcctgatcctggaccctgccatctctggaaatgagacccagtacctgcccttcatccggggccaggagaacaacgtgttcatcaagtggccagacaccaatgacatcgtgtggggcaaggtgtggccagacctgcccaacgtcatcgtggatggcagcctggaccacgagacccaggtgaagctgtaccgggcctacgtggccttcccagacttcttcaggaacagcacagctgcctggtggaagaaggagattgaggagctgtatgccaacccccgggagcctgagaagagcctgaagtttgatggcctgtggattgacatgaatgagcccagcaactttgtggatggctctgtgcggggctgcagcaatgagatgctgaacaaccccccctacatgccctacctggagagccgggacaagggcctgagcagcaagaccctgtgcatggagagccagcagatcctgcctgacagcagccctgtggagcactacaacgtgcacaacctgtatggctggagccagacccggcccacctatgaagctgtgcaggaggtgacaggccagaggggcgtcatcatcaccaggagcaccttccccagcagcggccgctggggcggccaccggctgggcaacaacacagctgcctgggaccagctgggcaagagcatcatcggcatgatggagttcagcctgtttggcatcccctacacaggagctgacatctgtggcttctttggagatgctgaatatgagatgtgtgtgcgctggatgcagctgggcgccttctaccccttcagcaggaaccacaacaacatcggcacccggcggcaggaccctgtggcctggaacagcacctttgagatgctgagcaggaaggtgctggagacccgctacaccctgctgccctacctgtacaccctgatgcacaaggcccacgtggagggcagcacagtggtgcggcccctgctgcacgagttcacagatgacaggaccacctgggacatcgaccggcagttcatgctgggccctgccatcctgatcagccctgtgctggagaccagcacctttgagatcagcgcctacttcccccgggcccgctggtatgactacagcacaggcaccagcagcaccagcacaggccagaggaagatcctgaaggcccccctggaccacatcaacctgcacgtgcggggcggctacatcctgccctggcaggagcccgccatgaacacccacagcagccggcagaacttcatgggcctcatcgtggccctggatgacaatggaacagctgagggccaggtgttctgggatgatggccagagcatcgtgttcaacaccacagccatgtag

SEQ ID NO: 37297 - DNA, 3381 bp, Artificial Sequence
  Description of Artificial Sequence: Synthetic coding sequence
atggtgaagctgagcatcgtgctgaccccccagttcctgagccatgaccagggccagctgaccaaggagctgcagcagcacgtgaagtctgtgacctgcccctgtgagtacctgaggaaggtgatcaacaccctggccgaccaccaccaccggggcacagactttggaggcagcccctggctgcacgtgatcatcgccttccccaccagctacaaggtggtgatcaccctgtggatcgtgtacctgtgggtgtccctgctgaagaccatcttctggagcagaaatggacatgatggcagcacagatgtgcagcagagggcctggaggagcaacagaagacggcaggagggcctgcggagcatctgcatgcacaccaagaagagggtgtcctccttccggggcaacaagattggcctgaaggatgtgatcaccctgcggcggcacgtggagaccaaggtgcgggccaagatcaggaagaggaaggtgaccaccaagatcaaccaccacgacaagatcaatggcaagaggaagacagccaggaagcagaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccaccagaatgtgtgctgacccccctgcccccatctgcagatgacaacctgaagaccccaccagaatgtctgctgacccccctgccccccagcgcagatgacaacctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacagccctgcccccatctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagacccccctgcccccatctgcagatgacctgaagaccccatctgagcggcagctgacccccctgcccccatctgcccctccttctgcagatgacaacatcaagatccctggcttccaccaccagcccatgatcatcagccgccacctgcccagcgtgagcagcctgcccttccacccccagctgcacccccagcagatgatcatcagccgccacctgcccagcgtgtgtggcggccgcttccaccctgagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 37298 - DNA, 2220 bp, Artificial Sequence
  Description of Artificial Sequence: Synthetic coding sequence
atgttctgctgcctgggctatgagtggctgagcggcggctgcaagacctggcacagcgcctgggtgatcaacaccctggccgaccaccaccaccggggcacagactttggaggcagcccctggctgcacgtgatcatcgccttccccaccagctacaaggtggtgatcaccctgtggatcgtgtacctgtgggtgtccctgctgaagaccatcttctggagcagaaatggacatgatggcagcacagatgtgcagcagagggcctggaggagcaacagaagacggcaggagggcctgcggagcatctgcatgcacaccaagaagagggtgagcagcttccggggcaacaagattggcctgaaggatgtgatcaccctgcggagacatgtggagaccaaggtgcgggccaagatcaggaagaggaaggtgaccaccaagatcaaccaccacgacaagatcaacgggaagaggaagacagccaggaagcagaagatgttccagagggcccaggagctgcggcggcgggcagaggactaccacaagtgcaagatccccccatctgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccaccagaatgtctgctgacccccctgccccccagcgcagatgacaacctgaagaccccaccagaatgtgtgctgacccccctgcccccatctgcagatgacaacctgaagaccccaccagaatgtgtgctgacccccctgccccccagcgcagatgacaacctgaagaccccacctgagtgcctgctgacccccctgcccccatctgcagatgacaacctgaagaccccaccagaatgtctgctgacccccctgccccccagcgccctgcccagcgccccacccagcgcagatgacaacctgaagaccagggctgagtgcctgctgcaccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacagccctgccccccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 37299 - DNA, 3402 bp, Artificial Sequence
  Description of Artificial Sequence: Synthetic coding sequence
atggtgaagctgagcatcgtgctgaccccccagttcctgagccatgaccagggccagctgaccaaggagctgcagcagcacgtgaagtctgtgacctgcccctgtgagtacctgaggaaggtgatcaacaccctggccgaccaccaccaccggggcacagactttggaggcagcccctggctgcacgtgatcatcgccttccccaccagctacaaggtggtgatcaccctgtggatcgtgtacctgtgggtgtccctgctgaagaccatcttctggagcagaaatggacatgatggcagcacagatgtgcagcagagggcctggaggagcaacagaagacggcaggagggcctgcggagcatctgcatgcacaccaagaagagggtgtcctccttccggggcaacaagattggcctgaaggatgtgatcaccctgcggcggcacgtggagaccaaggtgcgggccaagatcaggaagaggaaggtgaccaccaagatcaaccaccacgacaagatcaatggcaagaggaagacagccaggaagcagaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccaccagaatgtgtgctgacccccctgcccccatctgcagatgacaacctgaagaccccaccagaatgtctgctgacccccctgccccccagcgcagatgacaacctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacagccctgcccccatctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagccttccacccccagaggatgatcagccgccacctgcccagcgtgagcagcctgcccttccacccccagctgcacccccagcagatgatcatcagccgctacctgctgtctgtgtgtggcttccgcttccaccaccagcccatgatcatcagccgccacctgcccagcgtgagcagcctgcccttccacccccagctgcacccccagcagatgatcatcagccgccacctgcccagcgtgtgtggcggccgcttccaccctgagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagacccccagcgagcggcagctgacccccctgccccccagcgccccacccagcgcagatgacaacatcaagaccccagctgagcggctgcggggccccctgcccccatctgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 37300 - DNA, 2037 bp, Artificial Sequence
  Description of Artificial Sequence: Synthetic coding sequence
atggtgaagctgagcatcgtgctgaccccccagttcctgagccatgaccagggccagctgaccaaggagctgcagcagcacgtgaagtctgtgacctgcccctgtgagtacctgaggaaggtgatcaacaccctggccgaccaccaccaccggggcacagactttggaggcagcccctggctgcacgtgatcatcgccttccccaccagctacaaggtggtgatcaccctgtggatcgtgtacctgtgggtgtccctgctgaagaccatcttctggagcagaaatggacatgatggcagcacagatgtgcagcagagggcctggaggagcaacagaagacggcaggagggcctgcggagcatctgcatgcacaccaagaagagggtgtcctccttccggggcaacaagattggcctgaaggatgtgatcaccctgcggcggcacgtggagaccaaggtgcgggccaagatcaggaagaggaaggtgaccaccaagatcaaccaccacgacaagatcaatggcaagaggaagacagccaggaagcagaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccaccagaatgtgtgctgacccccctgcccccatctgcagatgacaacctgaagaccccaccagaatgtctgctgacccccctgccccccagcgcagatgacaacctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 37301 - DNA, 2547 bp, Artificial Sequence
  Description of Artificial Sequence: Synthetic coding sequence
atggtgaagctgagcatcgtgctgaccccccagttcctgagccatgaccagggccagctgaccaaggagctgcagcagcacgtgaagtctgtgacctgcccctgtgagtacctgaggaaggtgatcaacaccctggccgaccaccaccaccggggcacagactttggaggcagcccctggctgcacgtgatcatcgccttccccaccagctacaaggtggtgatcaccctgtggatcgtgtacctgtgggtgtccctgctgaagaccatcttctggagcagaaatggacatgatggcagcacagatgtgcagcagagggcctggaggagcaacagaagacggcaggagggcctgcggagcatctgcatgcacaccaagaagagggtgtcctccttccggggcaacaagattggcctgaaggatgtgatcaccctgcggcggcacgtggagaccaaggtgcgggccaagatcaggaagaggaaggtgaccaccaagatcaaccaccacgacaagatcaatggcaagaggaagacagccaggaagcagaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagccttccacccccagaggatgatcatcagccgccacctgcccagcgtgagcagcctgcccttccacccccagctgcacccccagcagatgatcatcagccgccacctgcccagcgtgtgtggcggccgcttccaccctgagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 37302 - DNA, 3033 bp, Artificial Sequence
  Description of Artificial Sequence: Synthetic coding sequence
atgcacaccaagaagagggtgtcctccttccggggcaacaagattggcctgaaggatgtgatcaccctgcggcggcacgtggagaccaaggtgcgggccaagatcaggaagaggaaggtgaccaccaagatcaaccaccacgacaagatcaatggcaagaggaagacagccaggaagcagaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccacctgagtgcctgctgacccccctgcccccatctgcagatgacaacctgaagaccccaccagaatgtgtgctgacccccctgccccccagcgcagatgacaacctgaagaccccaccagaatgtgtgctgacccccctgcccccatctgcagatgacaacctgaagaccccaccagaatgtctgctgacccccctgccccccagcgcagatgacaacctgaagaccccacctgagtgcctgctgacccccctgcccccatctgccctgcccagcgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacagccctgcccccatctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagccttccacccccagaggatgatcagccgccacctgcccagcgtgagcagcctgcccttccacccccagctgcacccccagcagatgatcatcagccgctacctgctgtctgtgtgtggcttccgcttccaccaccagcccatgatcatcagccgccacctgcccagcgtgagcagcctgcccttccacccccagctgcacccccagcagatgatcatcagccgccacctgcccagcgtgtgtggcggccgcttccaccctgagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagcagatgatcatcagccgccacctgcccagcgtgagcagcctgcccttccacccccagctgcacccccagcagatgatcatcagccgccacctgcccagcgtgtgtggccccctgccccccagcgcagatgacaacctgaagaccccatctgagcggcagctgacccccttccccccatctgcccctccttctgcagatgacaacatcaagaccccagctgagcggctgcgggagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 37303 - DNA, 3402 bp, Artificial Sequence; identical to SEQ ID NO: 37299
  Description of Artificial Sequence: Synthetic coding sequence

SEQ ID NO: 37304 - DNA, 708 bp, Artificial Sequence
  Description of Artificial Sequence: Synthetic coding sequence
atgcccaagggccgggccggcagcctgcccaccaccagcatcggctggaggttccagctgtggttcctgggcctgacctgcccagagcggcacctggcccggcggctgaagaacaacagcttctacccctttgtgcagcaggagcccaacgtgtttgtgctggagtactacctggacaccctgtggaagggcatgctgctcttcatcatctctgtggtgctggtgtccttcagcagcctgcgggaggtgcagaagcaggagacctgggtgttcctggtgtatggagtgggcgtgggcctgtggctggtgatcagcagcctgccccggcggcggctggtgctgaaccacacccggggcgtgtaccacttcagcatccagggccgcacagtgtgccagggccccctgcacctggtgtatgtgcggctggccctgagcagtgatgcccacggccgctgcttcttccacctggtgctgggcggccaccggctggagcccctggtgctggtgcagctgtctgagcactatgagcagatggagtacctgggccgctacatcgccaggaagctgaacatcaactactttgactacctggccaccagctacagacatgtggtgcgccactggcccccacctggagctggcaccgtgatgggcaagagccccatgggccacaagcccagcagcagccagagcagcctggaggtgtag

SEQ ID NO: 37305 - DNA, 708 bp, Artificial Sequence; identical to SEQ ID NO: 37304
  Description of Artificial Sequence: Synthetic coding sequence

SEQ ID NO: 37306 - DNA, 180 bp, Artificial Sequence
  Description of Artificial Sequence: Synthetic coding sequence
atgacctctgtgtccacccagctgagcctggtgctgatgagcctgctgctggtgctgcctgtggtggaggccgtggaggccggagatgccatcgccctgctgctgggcgtggtgctgagcatcaccggcatctgtgcctgcctgggcgtgtatgccaggaagagaaatggccagatgtag

SEQ ID NO: 37307 - DNA, 180 bp, Artificial Sequence; identical to SEQ ID NO: 37306
  Description of Artificial Sequence: Synthetic coding sequence

SEQ ID NO: 37308 - DNA, 180 bp, Artificial Sequence; identical to SEQ ID NO: 37306
  Description of Artificial Sequence: Synthetic coding sequence

SEQ ID NO: 37309 - DNA, 399 bp, Artificial Sequence
  Description of Artificial Sequence: Synthetic coding sequence
atgaccggggagctggaggtgaagaacatggacatgaagccaggcagcaccctgaagatcaccggcagcattgctgatggaacagatggctttgtgatcaacctgggccagggcacagacaagctgaacctgcacttcaacccccgcttcagcgagagcaccatcgtgtgcaacagcctggatggcagcaactggggccaggagcagcgggaggaccacctgtgcttcagccctggcagcgaggtgaagttcaccgtgacctttgaaagtgacaagttcaaggtgaagctgcctgatggccacgagctgaccttccccaaccggctgggccacagccacctgagctacctgtctgtgcggggcggcttcaacatgagcagcttcaagctgaaggagtag

SEQ ID NO: 37310 - DNA, 240 bp, Artificial Sequence
  Description of Artificial Sequence: Synthetic coding sequence
atgtttgagtgcatcacagagaacttcagcattgatcctgcccggaccctgatggtgggggaccggctggagacagacatcctgtttggccaccgctgtggcatgaccaccgtgctgaccctgactggagtgtcccggctggaggaggcccaggcctacctggccgccggccagcacgacctggtgccccactactacgtggagagcattgctgacctgacagagggcctggaggactag

SEQ ID NO: 37311 - DNA, 1296 bp, Artificial Sequence
  Description of Artificial Sequence: Synthetic coding sequence
atgcaggccctgaacatcaccccagagcagttcagccggctgctgcgggaccacaacctgacccgggagcagttcatcgccctgtaccgcctgcggcccctggtgtacaccccagagctgcccggccgggccaagctggccctggtgctgactggagtgctgatctttgccctggccctgtttggaaatgccctggtgttctacgtggtgaccaggagcaaggccatgaggacagtgaccaacatcttcatctgcagcctggccctgagtgacctgctgatcaccttcttctgcatccctgtgaccatgctgcagaacatcagtgacaactggctgggcggggccttcatctgcaagatggtgccctttgtgcagagcacagctgtggtgacagagatcctgaccatgacctgcatcgctgtggagcggcaccagggcctggtgcaccccttcaagatgaagtggcagtacaccaacagaagagccttcaccatgctgggcgtggtgtggctggtggccgtgattgtgggcagccccatgtggcacgtgcagcagctggagatcaagtatgacttcctgtatgagaaggagcacatctgctgcctggaggagtggaccagccctgtgcaccagaagatctacaccaccttcatcctggtgatcctcttcctgctgcccctgatggtgatgctgatcctgtacagcaagattggctatgagctgtggatcaagaagagggtgggagatggctctgtgctgcggaccatccacggcaaggagatgagcaagatcgccaggaagaagaagagagctgtgatcatgatggtgacagtggtggccctgtttgctgtgtgctgggcccccttccacgtggtgcacatgatgattgagtacagcaactttgagaaggagtatgatgatgtgaccatcaagatgatctttgccatcgtgcagatcatcggcttcagcaacagcatctgcaaccccatcgtgtatgccttcatgaatgaaaacttcaagaagaatgtgctgtctgctgtgtgctactgcatcgtgaacaagaccttcagccctgcccagagacatggcaacagcggcatcaccatgatgaggaagaaggccaagttcagcctgcgggagaaccctgtggaggagaccaagggggaggccttcagtgatggcaacatcgaggtgaagctgtgtgagcagacagaggagaagaagaagctgaagaggcacctggccctcttccgctctgagctggccgagaacagccccctggacagcggccactag

SEQ ID NO: 37312 - DNA, 825 bp, Artificial Sequence
  Description of Artificial Sequence: Synthetic coding sequence
atggccgcctcctggaggctgggctgtgacccccggctgctgcgctacctggtgggcttccctggaagaagatctgtgggcctggtgaagggggccctgggctggagcgtgtccagaggagccaactggcgctggttccacagcacccagtggctgcggggggaccccatcaagatcctgatgcccagcctgagccccaccatggaggagggcaacatcgtgaagtggctgaagaaggagggggaggccgtgtctgctggagatgccctgtgtgaaattgaaacagacaaggctgtggtgaccctggatgccagtgatgatggcatcctggccaagatcgtgcagatgccagatgtgaatgtgtcctgggatggagagggccccaagcagctgcccttcatcgacatctctgtggccgtggccacagacaagggcctgctgacccccatcatcaaggatgctgctgccaagggcatccaggagattgctgacagcgtgaaggccctgagcaagaaggccagagatggcaagctgctgcctgaggagtaccagggcggcagcttcagcatcagcaacctgggcatgtttggaattgatgagttcaccgctgtgatcaaccccccccaggcctgcatcctggccgtgggccgcttccggcctgtgctgaagctgacagaagatgaggagggcaatgccaagctgcagcagaggcagctgatcaccgtgaccatgagcagtgacagccgggtggtggatgatgagctggccacccgcttcctgaagagcttcaaggccaacctggagaaccccatccggctggcctag

SEQ ID NO: 37313 - DNA, 1857 bp, Artificial Sequence
  Description of Artificial Sequence: Synthetic coding sequence
atgcacaagacagccagccagaggctcttccctggccccagctaccagaacatcaagagcatcatggaggacagcaccatcctgagtgactggaccaacagcaacaagcagaagatgaagtatgacttcagctgtgagctgtacaggatgagcacctacagcaccttccctgctggggtgcctgtgtctgagaggagcctggcccgggccggcttctactacacaggagtgaatgacaaggtgaagtgcttctgctgcggcctgatgctggacaactggaagctgggggacagccccatccagaagcacaagcagctgtaccccagctgcagcttcatccagaacctggtgtctgccagcctgggcagcaccagcaagaacaccagccccatgaggaacagctttgcccacagcctgagccccaccctggagcacagcagcctcttcagcggcagctacagcagcctgagccccaaccccctgaacagcagagctgtggaggacatcagcagcagcaggaccaacccctacagctatgccatgagcacagaggaggcccgcttcctgacctaccacatgtggcccctgaccttcctgagccccagcgagctggcccgggccggcttctactacatcggccctggggacagagtggcctgctttgcctgtggcggcaagctgagcaactgggagcccaaggatgatgccatgtctgagcacagaagacacttccccaactgccccttcctggagaacagcctggagaccctgcgcttcagcatcagcaacctgtccatgcagacccacgccgccaggatgaggaccttcatgtactggcccagctctgtgcctgtgcagcctgagcagctggccagcgctggcttctactacgtgggcagaaatgatgatgtgaagtgcttctgctgtgatggcggcctgcgctgctgggagagcggagatgacccctgggtggagcacgccaagtggttcccccgctgtgagttcctgatccgcatgaagggccaggagtttgtggatgagatccagggccgctacccccacctgctggagcagctgctgagcaccagtgacaccaccggggaggagaatgctgacccccccatcatccacttcggccctggagagagcagcagtgaagatgctgtgatgatgaacacccctgtggtgaagagcgccctggagatgggcttcaacagagacctggtgaagcagacagtgcagagcaagatcctgaccaccggggagaactacaagacagtgaatgacatcgtgtctgccctgctgaatgcagaagatgagaagcgggaggaggagaaggagaagcaggccgaggagatggccagtgatgacctgagcctcatcaggaagaacaggatggccctcttccagcagctgacctgtgtgctgcccatcctggacaacctgctgaaggccaacgtcatcaacaagcaggagcatgacatcatcaagcagaagacccagatccccctgcaggcccgggagctgattgacaccatcctggtgaagggaaatgctgctgccaacatcttcaagaactgcctgaaggagattgacagcaccctgtacaagaacctgtttgtggacaagaacatgaagtacatccccacagaagatgtgtctggcctgagcctggaggagcagctgcggcggctgcaggaggagaggacctgcaaggtgtgcatggacaaggaggtgtctgtggtgttcatcccctgtggccacctggtggtgtgccaggagtgtgcccccagcctgaggaaatgtcccatctgccggggcatcatcaagggcaccgtgaggaccttcctgtcctag

SEQ ID NO: 37314 - DNA, 1461 bp, Artificial Sequence
  Description of Artificial Sequence: Synthetic coding sequence
atgcagagcggcggcgctgagggcagccctggggccggccgcacaggccggggccctggcagcggcaaggcccctcctgctgagatcagcagcggggccccagacttccctggaggagaccccatcaagatcctgatgcccagcctgagccccaccatggaggagggcaacatcgtgaagtggctgaagaaggagggggaggccgtgtctgctggagatgccctgtgtgaaattgaaacagacaaggctgtggtgaccctggatgccagtgatgatggcatcctggccaagatcgtggtggaggagggcagcaagaacatccggctgggcagcctgattggcctcatcgtggaggagggggaggactggaagcacgtggagatccccaaggatgtgggccccccacctcctgtgtccaagcccagcgagccccggcccagccctgagccccagatcagcatccctgtgaagaaggagcacatccctggcaccctgcgcttccggctgagccctgctgccaggaacatcctggagaagcacagcctggatgccagccagggcacagccaccggcccccggggcatcttcaccaaggaggatgccctgaagctggtgcagctgaagcagacaggcaagatcacagagagccggcccaccccagcccccacagccacccccacagcccccagccccctgcaggccacagctggccccagctaccccaggcctgtgatcccccctgtgtccaccccaggccagcccaatgctgtgggcaccttcacagagatcccagccagcaacatcagaagagtcatcgccaagaggctgacagagagcaagagcacagtgccccacgcctatgccacagctgactgtgacctgggcgctgtgctgaaggtgcggcaggacctggtgaaggatgacatcaaggtgtctgtgaatgacttcatcatcaaggctgctgctgtgaccctgaagcagatgccagatgtgaatgtgtcctgggatggagagggccccaagcagctgcccttcatcgacatctctgtggccgtggccacagacaagggcctgctgacccccatcatcaaggatgctgctgccaagggcatccaggagattgctgacagcgtgaaggccctgagcaagaaggccagagatggcaagctgctgcctgaggagtaccagggcggcagcttcagcatcagcaacctgggcatgtttggaattgatgagttcaccgctgtgatcaaccccccccaggcctgcatcctggccgtgggccgcttccggcctgtgctgaagctgacagaagatgaggagggcaatgccaagctgcagcagaggcagctgatcaccgtgaccatgagcagtgacagccgggtggtggatgatgagctggccacccgcttcctgaagagcttcaaggccaacctggagaaccccatccggctggcctag

SEQ ID NO: 37315 - DNA, 1221 bp, Artificial Sequence
  Description of Artificial Sequence: Synthetic coding sequence
atgaggctcttccgctggctgctgaagcagcctgtgcccaagcagatcgagcgctacagccgcttcagccccagccccctgagcatcaagcagttcctggactttggccgggacaatgcctgtgagaagaccagctacatgttcctgaggaaggagctgcctgtgcggctggccaacaccatgagggaggtgaacctgctgcctgacaacctgctgaaccggcccagcgtgggcctggtgcagagctggtacatgcagagcttcctggagctgctggagtatgagaacaagagccctgaggacccccaggtgctggacaacttcctgcaggtgctgatcaaggtgaggaacagacacaatgatgtggtgcccaccatggcccagggcgtgattgagtacaaggagaagtttggatttgaccccttcatcagcaccaacatccagtacttcctggaccgcttctacaccaaccgcatctccttcaggatgctgatcaaccagcacaccctgctgtttggaggagacaccaaccctgtgcaccccaagcacatcggcagcattgaccccacctgcaatgtggctgatgtggtgaaggatgcctatgaaacagccaagatgctgtgtgagcagtactacctggtggcccctgagctggaggtggaggagttcaatgccaaggccccagacaagcccatccaggtggtgtatgtgcccagccacctgttccacatgctgtttgagctgttcaagaacagcatgagggccaccgtggagctgtatgaggacaggaaggagggctacccagctgtgaagaccctggtgaccctgggcaaggaggacctgagcatcaagatcagtgacctgggcggcggcgtgcccctgaggaagattgacaggctcttcaactacatgtacagcacagccccccggcccagcctggagcccacccgggccgcccccctggccggcttcggctacggcctgcccatcagccggctgtatgcccgctacttccagggcgacctgaagctgtacagcatggagggcgtgggcacagatgctgtgatctacctgaaggccctgagcagcgagagctttgagcggctgcccgtcttcaacaagagcgcctggaggcactacaagaccaccccagaggctgatgactggagcaaccccagcagcgagcccagagatgccagcaagtacaaggccaagcagtag

SEQ ID NO: 37316 - DNA, 1248 bp, Artificial Sequence
  Description of Artificial Sequence: Synthetic coding sequence
atgaggctcttccgctggctgctgaagcagcctgtgcccaagcagatcgagcgctacagccgcttcagccccagccccctgagcatcaagcagttcctggactttggccgggacaatgcctgtgagaagaccagctacatgttcctgaggaaggagctgcctgtgcggctggccaacaccatgagggaggtgaacctgctgcctgacaacctgctgaaccggcccagcgtgggcctggtgcagagctggtacatgcagagcttcctggagctgctggagtatgagaacaagagccctgaggacccccaggtgctggacaacttcctgcaggtgctgatcaaggtgaggaacagacacaatgatgtggtgcccaccatggcccagggcgtgattgagtacaaggagaagtttggatttgaccccttcatcagcaccaacatccagtacttcctggaccgcttctacaccaaccgcatctccttcaggatgctgatcaaccagcacaccctgctgtttggaggagacaccaaccctgtgcaccccaagcacatcggcagcattgaccccacctgcaatgtggctgatgtggtgaaggatgcctatgaaacagccaagatgctgtgtgagcagtactacctggtggcccctgagctggaggtggaggagttcaatgccaaggccccagacaagcccatccaggtggtgtatgtgcccagccacctgttccacatgctgtttgagctgttcaagaacagcatgagggccaccgtggagctgtatgaggacaggaaggagggctacccagctgtgaagaccctggtgaccctgggcaaggaggacctgagcatcaagatcagtgacctgggcggcggcgtgcccctgaggaagattgacaggctcttcaactacatgtacagcacagccccccggcccagcctggagcccacccgggccgcccccctggccggcttcggctacggcctgcccatcagccggctgtatgcccgctacttccagggcgacctgaagctgtacagcatggagggcgtgggcacagatgctgtgatctacctgaaggccctgagcagcgagagctttgagcggctgcccgtcttcaacaagagcgcctggaggcactacaagaccaccccagaggctgatgactggagcaaccccagcagcgagcccagagatgccagcaagtacaaggccaagcaggacaagatcaagaccaacagaaccttctag

SEQ ID NO: 37317 - DNA, 1590 bp, Artificial Sequence
  Description of Artificial Sequence: Synthetic coding sequence
atgagcagcacagtgtcctactggatcctgaacagcaccaggaacagcatcgccaccctgcagggcggccggcggctgtacagccgctacgtgagcaacagaaacaagctgaagtggaggctcttcagccgggtgccccccaccctgaacagcagcccctgtggcggcttcaccctgtgcaaggcctaccgccacaccagcacagaggaggatgacttccacctgcagctgagccctgagcagatcaatgaggtgctgcgggccggggagaccacccacaagatcctggacctggagagccgggtgcccaacagcgtgctgcgctttgagagcaaccagctggccgccaacagccctgtggaggacagaagaggagtggccagctgcctgcagaccaacggcctgatgtttggcatctttgatggccatggaggccacgcctgtgcccaggccgtgtctgagcggctcttctactacgtggccgtgtccctgatgagccaccagaccctggagcacatggagggcgccatggagagcatgaagcccctgctgcccatcctgcactggctgaagcaccctggggacagcatctacaaggatgtgacctctgtgcacctggaccacctgcgggtgtactggcaggagctgctggacctgcacatggagatgggcctgagcattgaggaggccctgatgtacagcttccagaggctggacagcgacatcagcctggagatccaggcccccctggaggatgaggtgaccaggaacctgagcctgcaggtggccttcagcggggccacagcctgcatggcccacgtggatggcatccacctgcacgtggccaatgctggggactgccgggccatcctgggcgtgcaggaggacaatggcatgtggagctgcctgcccctgacccgggaccacaatgcctggaaccaggccgagctgagccggctgaagcgggagcaccctgagagcgaggacaggaccatcatcatggaggaccggctgctgggcgtgctgatcccctgccgggcctttggagatgtgcagctgaagtggagcaaggagctgcagaggagcatcctggagcggggcttcaacacagaggccctgaacatctaccagttcaccccaccccactactacaccccaccctacctgacagctgagcctgaggtgacctaccaccggctgcggccccaggacaagttcctggtgctggccagtgatggcctgtgggacatgctgagcaatgaagatgtggtgcggctggtggtgggccacctggccgaggccgactggcacaagacagacctggcccagaggcctgccaacctgggcctgatgcagagcctgctgctgcagaggaaggccagcggcctgcacgaggccgaccagaatgctgccaccaggctcatcagacatgccatcggcaacaatgaatatggagagatggaggccgagcggctggccgccatgctgaccctgcctgaggacctggccaggatgtacagagatgacatcaccgtgacagtggtgtacttcaacagcgagagcatcggggcctactacaagggcggctag

SEQ ID NO: 37318 - DNA, 978 bp, Artificial Sequence
  Description of Artificial Sequence: Synthetic coding sequence
atggtgggggagatggagaccaaggagaagcccaagcccaccccagactacctgatgcagctgatgaatgacaagaagctgatgagcagcctgcccaacttctgtggcatcttcaaccacctggagcggctgctggatgaggagatcagccgggtgaggaaggacatgtacaatgacaccctgaatggcagcacagagaagaggtctgctgagctgcctgatgctgtgggccccatcgtgcagctgcaggagaagctgtatgtgcctgtgaaggagtacccagacttcaactttgtgggccgcatcctgggcccccggggcctgacagccaagcagctggaggccgagaccggctgcaagatcatggtgcggggcaagggctccatgagggacaagaagaaggaggagcagaacagaggcaagcccaactgggagcacctgaatgaagacctgcacgtgctgatcaccgtggaggatgcccagaacagagctgagatcaagctgaagagagctgtggaggaggtgaagaagctgctggtgcctgctgctgagggggaggacagcctgaagaagatgcagctgatggagctggccatcctgaatggcacctacagagatgccaacatcaagagccctgccctggccttcagcctggccgccacagcccaggccgccccccgcatcatcaccggccctgcccctgtgctgcccccagctgccctgcggacccccaccccagctggccccaccatcatgcccctcatccggcagatccagacagctgtgatgcccaacggcaccccccaccccacagctgccatcgtgcccccaggccctgaggccggcctcatctacaccccctatgagtacccctacaccctggccccagccaccagcatcctggagtaccccatcgagcccagcggcgtgctggagtggattgagatgcctgtgatgccagacatcagcgcccactag

SEQ ID NO: 37319 - DNA, 1002 bp, Artificial Sequence
  Description of Artificial Sequence: Synthetic coding sequence
atggtgggggagatggagaccaaggagaagcccaagcccaccccagactacctgatgcagctgatgaatgacaagaagctgatgagcagcctgcccaacttctgtggcatcttcaaccacctggagcggctgctggatgaggagatcagccgggtgaggaaggacatgtacaatgacaccctgaatggcagcacagagaagaggtctgctgagctgcctgatgctgtgggccccatcgtgcagctgcaggagaagctgtatgtgcctgtgaaggagtacccagacttcaactttgtgggccgcatcctgggcccccggggcctgacagccaagcagctggaggccgagaccggctgcaagatcatggtgcggggcaagggctccatgagggacaagaagaaggaggagcagaacagaggcaagcccaactgggagcacctgaatgaagacctgcacgtgctgatcaccgtggaggatgcccagaacagagctgagatcaagctgaagagagctgtggaggaggtgaagaagctgctggtgcctgctgctgagggggaggacagcctgaagaagatgcagctgatggagctggccatcctgaatggcacctacagagatgccaacatcaagagccccacagcccaggccgccccccgcatcatcaccggccctgcccctgtgctgcccccagctgccctgcggacccccaccccagctggccccaccatcatgcccctcatccggcagatccagacagctgtgatgcccaacggcaccccccaccccacagctgccatcgtgcccccaggccctgaggccggcctcatctacaccccctatgagtacccctacaccctggccccagccaccagcatcctggagtaccccatcgagcccagcggcgtgctgggcgctgtggccaccaaggtgagaagacatgacatgagggtgcacccctaccagagaattgtgacagctgacagagctgccactggaaattag

SEQ ID NO: 37320 - DNA, 1026 bp, Artificial Sequence
  Description of Artificial Sequence: Synthetic coding sequence
atggtgggggagatggagaccaaggagaagcccaagcccaccccagactacctgatgcagctgatgaatgacaagaagctgatgagcagcctgcccaacttctgtggcatcttcaaccacctggagcggctgctggatgaggagatcagccgggtgaggaaggacatgtacaatgacaccctgaatggcagcacagagaagaggtctgctgagctgcctgatgctgtgggccccatcgtgcagctgcaggagaagctgtatgtgcctgtgaaggagtacccagacttcaactttgtgggccgcatcctgggcccccggggcctgacagccaagcagctggaggccgagaccggctgcaagatcatggtgcggggcaagggctccatgagggacaagaagaaggaggagcagaacagaggcaagcccaactgggagcacctgaatgaagacctgcacgtgctgatcaccgtggaggatgcccagaacagagctgagatcaagctgaagagagctgtggaggaggtgaagaagctgctggtgcctgctgctgagggggaggacagcctgaagaagatgcagctgatggagctggccatcctgaatggcacctacagagatgccaacatcaagagccctgccctggccttcagcctggccgccacagcccaggccgccccccgcatcatcaccggccctgcccctgtgctgcccccagctgccctgcggacccccaccccagctggccccaccatcatgcccctcatccggcagatccagacagctgtgatgcccaacggcaccccccaccccacagctgccatcgtgcccccaggccctgaggccggcctcatctacaccccctatgagtacccctacaccctggccccagccaccagcatcctggagtaccccatcgagcccagcggcgtgctgggcgctgtggccaccaaggtgagaagacatgacatgagggtgcacccctaccagagaattgtgacagctgacagagctgccactggaaattag

SEQ ID NO: 37321 - DNA, 960 bp, Artificial Sequence
  Description of Artificial Sequence: Synthetic coding sequence
atggtgggggagatggagaccaaggagaagcccaagcccaccccagactacctgatgcagctgatgaatgacaagaagctgatgagcagcctgcccaacttctgtggcatcttcaaccacctggagcggctgctggatgaggagatcagccgggtgaggaaggacatgtacaatgacaccctgaatggcagcacagagaagaggtctgctgagctgcctgatgctgtgggccccatcgtgcagctgcaggagaagctgtatgtgcctgtgaaggagtacccagacttcaactttgtgggccgcatcctgggcccccggggcctgacagccaagcagctggaggccgagaccggctgcaagatcatggtgcggggcaagggctccatgagggacaagaagaaggaggagcagaacagaggcaagcccaactgggagcacctgaatgaagacctgcacgtgctgatcaccgtggaggatgcccagaacagagctgagatcaagctgaagagagctgtggaggaggtgaagaagctgctggtgcctgctgctgagggggaggacagcctgaagaagatgcagctgatggagctggccatcctgaatggcacctacagagatgccaacatcaagagccctgccctggccttcagcctggccgccacagcccaggccgccccccgcatcatcaccggccctgcccctgtgctgcccccagctgccctgcggacccccaccccagctggccccaccatcatgcccctcatccggcagatccagacagctgtgatgcccaacggcaccccccaccccacagctgccatcgtgcccccaggccctgaggccggcctcatctacaccccctatgagtacccctacaccctggccccagccaccagcatcctggagtaccccatcgagcccagcggcgtgctgggcaagttcttcagcccctggggctag

SEQ ID NO: 37322 - DNA, 960 bp, Artificial Sequence
  Description of Artificial Sequence: Synthetic coding sequence
atggtgggggagatggagaccaaggagaagcccaagcccaccccagactacctgatgcagctgatgaatgacaagaagctgatgagcagcctgcccaacttctgtggcatcttcaaccacctggagcggctgctggatgaggagatcagccgggtgaggaaggacatgtacaatgacaccctgaatggcagcacagagaagaggtctgctgagctgcctgatgctgtgggccccatcgtgcagctgcaggagaagctgtatgtgcctgtgaaggagtacccagacttcaactttgtgggccgcatcctgggcccccggggcctgacagccaagcagctggaggccgagaccggctgcaagatcatggtgcggggcaagggctccatgagggacaagaagaaggaggagcagaacagaggcaagcccaactgggagcacctgaatgaagacctgcacgtgctgatcaccgtggaggatgcccagaacagagctgagatcaagctgaagagagctgtggaggaggtgaagaagctgctggtgcctgctgctgagggggaggacagcctgaagaagatgcagctgatggagctggccatcctgaatggcacctacagagatgccaacatcaagagccctgccctggccttcagcctggccgccacagcccaggccgccccccgcatcatcaccggccctgcccctgtgctgcccccagctgccctgcggacccccaccccagctggccccaccatcatgcccctcatccggcagatccagacagctgtgatgcccaacggcaccccccaccccacagctgccatcgtgcccccaggccctgaggccggcctcatctacaccccctatgagtacccctacaccctggccccagccaccagcatcctggagtaccccatcgagcccagcggcgtgctgggcatggccttccccaccaagggctag

SEQ ID NO: 37323 - DNA, 1137 bp, Artificial Sequence
  Description of Artificial Sequence: Synthetic coding sequence
atggtggactacagcgtgtgggaccacatcgaggtgtctgatgatgaagatgagacccaccccaacatcgacacagccagcctcttccgctggaggcaccaggcccgggtggagaggatggagcagttccagaaggagaaggaggagctggaccggggctgccgggagtgcaagaggaaggtggccgagtgccagaggaagctgaaggagctggaggtggccgagggcggcaaggccgagctggagcggctgcaggccgaggcccagcagctgaggaaggaggagaggtcctgggagcagaagctggaggagatgaggaagaaggagaagtccatgccctggaatgtggacaccctgagcaaggatggcttcagcaagtccatggtgaacaccaagccagagaagacagaggaggacagcgaggaggtgcgggagcagaagcacaagacctttgtggagaagtatgagaagcagatcaagcacttcggcatgctgcggcgctgggatgacagccagaagtacctgagtgacaacgtgcacctggtgtgtgaggagacagccaactacctggtgatctggtgcatcgacctggaggtggaggagaagtgtgccctgatggagcaggtggcccaccagaccatcgtgatgcagttcatcctggagctggccaagagcctgaaggtggacccccgggcctgcttccggcagttcttcaccaagatcaagacagctgaccggcagtacatggagggcttcaatgatgagctggaggccttcaaggagcgggtgcggggccgggccaagctgagaattgagaaggccatgaaggagtatgaggaggaggagaggaagaagaggctgggccctgggggcctggaccctgtggaggtgtatgagagcctgcctgaggagctgcagaagtgctttgatgtgaaggatgtgcagatgctgcaggatgccatcagcaagatggaccccacagatgccaagtaccacatgcagcgctgcattgattctggcctgtgggtgcccaacagcaaggccagcgaggccaaggagggggaggaggccggccctggggaccccctgctggaggccgtgcccaagacaggagatgagaaggatgtgtctgtgtag

SEQ ID NO: 37324 - DNA, 1962 bp, Artificial Sequence
  Description of Artificial Sequence: Synthetic coding sequence
atggccctggtgagaggagctgagcctgctgctggccccagccgctggctgcccacccacgtgcaggtgacagtgctgcgggcccggggcctgcggggcaagagcagcggggccggcagcaccagtgatgcctacaccgtcatccaggtgggccgggagaagtacagcacctctgtggtggagaagacccacggctgcccagagtggagggaggagtgcagctttgagctgcccccaggggccctggatggcctgctgcgggcccaggaggctgatgctggccctgccccctgggccgccagcagcgctgctgcctgtgagctggtgctgaccaccatgcacaggagcctcatcggcgtggacaagttcctgggccaggccaccgtggccctggatgaggtgtttggagctggccgggcccagcacacccagtggtacaagctgcacagcaagccaggcaagaaggagaaggagcggggggagattgaggtgaccatccagttcaccaggaacaacctgagcgcctccatgtttgacctgtccatgaaggacaagcccaggagccccttcagcaagatccgggacaagatgaagggcaagaagaagtatgacctggagagcgccagcgccatcctgcccagcagcgccatcgaggaccctgacctgggcagcctgggcaagatgggcaaggccaagggcttcttcctgaggaacaagctgaggaagagcagcctgacccagagcaacaccagcctgggcagtgacagcaccctgagcagcgccagcggcagcctggcctaccagggccctggagctgagctgctgaccaggagccccagccgcagctcctggctgagcacagaaggaggccgggacagcgcccagagccccaagctgttcacccacaagaggacctacagtgatgaggccaaccagatgagggtggccccaccccgggccctgctggacctgcagggccacctggatgctgccagccgcagcagcctgtgtgtgaatggcagccacatctacaatgaggagccccagggccctgtgcgccacaggagcagcatcagcggcagcctgcccagcagcggcagcctgcaggccgtgagcagccgcttcagcgaggagggccccaggagcacagatgacacctggccccggggcagccgcagcaacagcagcagcgaggccgtgctgggccaggaggagctgagcgcccaggccaaggtgctggcccctggggccagccaccctggagaggaggagggcgcccggctgcctgagggcaagcctgtgcaggtggccacccccatcgtggccagcagcgaggccgtggccgagaaggagggcgccaggaaggaggagaggaagcccaggatgggcctcttccaccaccaccaccagggcctgagccgctctgagctgggcagaagaagcagcctgggggagaagggcggccccatcctgggcgccagcccccaccacagcagcagcggggaggagaaggccaagagctcctggtttggcctgcgggaggccaaggaccccacccagaagcccagcccccaccctgtgaagcccctgtctgctgcccctgtggagggcagcccagacaggaagcagagccgcagcagcctgagcatcgccctgagcagcggcctggagaagctgaagacagtgaccagcggcagcatccagcctgtgacccaggccccccaggccggccagatggtggacaccaagaggctgaaggacagcgctgtgctggaccagagcgccaagtactaccacctgacccatgatgagctgatcagcctgctgctgcagcgggagcgggagctgagccagagagatgagcacgtgcaggagctggagagctacatcgaccggctgctggtgcgcatcatggagaccagccccaccctgctgcagatccccccaggcccccccaagtag

SEQ ID NO: 37325 - DNA, 657 bp, Artificial Sequence
  Description of Artificial Sequence: Synthetic coding sequence
atgggcaccagagatgatgaatatgactacctgttcaaggtggtgctgattggagacagcggcgtgggcaagagcaacctgctgagccgcttcaccagaaatgagttcaacctggagagcaagagcaccatcggcgtggagtttgccaccaggagcatccaggtggatggcaagaccatcaaggcccagatctgggacacagctggccaggagcgctaccgggccatcaccagcgcctactacagaggagctgtgggcgccctgctggtgtatgacatcgccaagcacctgacctatgaaaatgtggagcgctggctgaaggagctgcgggaccatgctgacagcaacatcgtcatcatgctggtgggcaacaagagtgacctgcggcacctgcgggctgtgcccacagatgaggcccgggcctttgctgagaagaacaacctgtccttcatcgagaccagcgccctggacagcaccaacgtggaggaggccttcaagaacatcctgacagagatctacagaattgtgtcccagaagcagattgctgacagagctgcccatgatgagagccctggcaacaacgtggtggacatctctgtgccccccaccacagatggccagaagcccaacaagctgcagtgctgccagaacctgtag

SEQ ID NO: 37326 - DNA, 627 bp, Artificial Sequence
  Description of Artificial Sequence: Synthetic coding sequence
atggccaagcagtatgatgtgctcttccggctgctgctgattggagacagcggcgtgggcaagacctgcctgctgtgccgcttcacagacaatgagttccacagcagccacatcagcaccatcggcgtggacttcaagatgaagaccatcgaggtggatggcatcaaggtgcgcatccagatctgggacacagctggccaggagcgctaccagaccatcaccaagcagtactacagaagagcccagggcatcttcctggtgtatgacatcagcagcgagaggagctaccagcacatcatgaagtgggtgtctgatgtggatgaggtgggagatgccaccagcctgcccggctgtggggagggcgccagccctgggaaggcccggcggggcccagatggcaaggccaatgccagcaggaagctgtgcctgccccagccctggatgaagaccagcggcacccaccagaaggccagcagaagaagcctgctgggcatccggctgatgaggagcagaaatggccgctgggaggagagcaagggcagctcctggaggaggtccatggcctggacctccatgaagcaggtgcctgcccccaccagcaccctgaagagccacagccgggtgtag

SEQ ID NO: 37327 - DNA, 639 bp, Artificial Sequence
  Description of Artificial Sequence: Synthetic coding sequence
atggccaagcagtatgatgtgctcttccggctgctgctgattggagacagcggcgtgggcaagacctgcctgctgtgccgcttcacagacaatgagttccacagcagccacatcagcaccatcggcgtggacttcaagatgaagaccatcgaggtggatggcatcaaggtgcgcatccagatctgggacacagctggccaggagcgctaccagaccatcaccaagcagtactacagaagagcccagggcatcttcctggtgtatgacatcagcagcgagaggagctaccagcacatcatgaagtgggtgtctgatgtggatgaatatgcccctgagggcgtgcagaagatcctgattggcaacaaggcagatgaggagcagaagaggcaggtgggccgggagcagggccagcagctggccaaggagtatggcatggacttctatgagaccagcgcctgcaccaacctgaacatcaaggagagcttcacccggctgacagagctggtgctgcaggcccacaggaaggagctggagggcctgaggatgagggccagcaatgagctggccctggccgagctggaggaggaggagggcaagccagagggccctgccaacagcagcaagacctgctggtgctag

SEQ ID NO: 37328 - DNA, 795 bp, Artificial Sequence
  Description of Artificial Sequence: Synthetic coding sequence
atgcacttcagcagcagcgcccgggcagcagatgagaactttgactacctgttcaagatcatcctgattggagacagcaatgtgggcaagacctgtgtggtgcagcacttcaagtctggagtgtacacagagacccagcagaacaccatcggcgtggacttcaccgtgcgcagcctggacattgatggcaagaaggtgaagaacagcagcgccagcatcatcacctttgccagcatccagatccacggccagacccagaagatgagcccccagatctggaccaagagcagccactacctgtgggagcccctcatctggaccctgctgcctgtgctgctgcagatgcaggtgtgggacacagctggccaggagcgcttccgcaccatcacccagagctactaccgcagcgcccatgctgccatcatcgcctatgacctgacccggcgcagcacctttgagagcatcccccactggatccacgagattgagaagtatggagctgccaacgtggtgatcatgctgattggcaacaagtgtgacctgtgggagaagagacatgtgctgtttgaagatgcctgcaccctggccgagaagtatggcctgctggccgtgctggagaccagcgccaaggagagcaagaacatcgaggaggtgtttgtgctgatggccaaggagctgattgccaggaacagcctgcacctgtatggagagagcgccctgaatggcctgcccctggacagcagccctgtgctgatggcccagggccccagcgagaagacccactgcacctgctag

SEQ ID NO: 37329 - DNA, 654 bp, Artificial Sequence
  Description of Artificial Sequence: Synthetic coding sequence
atgcacttcagcagcagcgcccgggcagcagatgagaactttgactacctgttcaagatcatcctgattggagacagcaatgtgggcaagacctgtgtggtgcagcacttcaagtctggagtgtacacagagacccagcagaacaccatcggcgtggacttcaccgtgcgcagcctggacattgatggcaagaaggtgaagatgcaggtgtgggacacagctggccaggagcgcttccgcaccatcacccagagctactacagaagtgcccacgccgccatcatcgcctatgacctgaccaggaggagcacctttgagagcatcccccactggattcatgaaattgagaagtacggggccgccaacgtggtgatcatgctgattggcaacaagtgtgacctgtgggagaagagacatgtgctgtttgaagatgcctgcaccctggccgagaagtatggcctgctggccgtgctggagaccagcgccaaggagagcaagaacatcgaggaggtgtttgtgctgatggccaaggagctgattgccaggaacagcctgcacctgtatggagagagcgccctgaatggcctgcccctggacagcagccctgtgctgatggcccagggccccagcgagaagacccactgcacctgctag

SEQ ID NO: 37330 - DNA, 450 bp, Artificial Sequence
  Description of Artificial Sequence: Synthetic coding sequence
atgcacttcagcagcagcgcccgggcagcagatgagaactttgactacctgttcaagatcatcctgattggagacagcaatgtgggcaagacctgtgtggtgcagcacttcaagtctggagtgtacacagagacccagcagaacaccatcggcgtggacttcaccgtgcgcagcctggacattgatggcaagaaggtgaagatgcaggtgtgggacacagctggccaggagcgcttccgcaccatcacccagagctactacagaagtgcccacgccgccatcatcgcctatgacctgaccaggaggagcacctttgagagcatcccccactggattcatgaaattgagaagtacggggccgccaacgtggtgatcatgctgattggcaacaagtgtgacctgtgggagaagagacatgtgctgtttgaagatgcctgcaccctggcctag
